United States Patent 10,221,454 (METHODS AND COMPOSITIONS FOR SCREENING AND TREATING DEVELOPMENTAL DISORDERS) - sequence listing, part 15

SEQ ID NO: 120 - DNA, 1380246 bp, Homo sapiens
ctgtgcaaataatactgtgattcatgttcatgtgtagtggatgatcttgcttttttgtttttgttttttttttttttttgagacagagtctcactctgttgcccaggctggagttcagtggcgtgatctcggctcactgcaacctctgccccccgggttcaagtgattctcctgcctcagcctcccaggaagctgggattacaggtgcctgccaccacgcccagctaatttttgtatttttaatagagacggggtttcatcatcttggccaggctggtcttgaactcctgacctcgtgatccacccacctcggcctcccaaagtgctgggattacaggcatgagccaccgcgcccggcctgctctaacttattttaagaatcactgttctattctggaaagggaaaagaccaccaccaagaagggaaaggagaccatgctggacagcctaatagtctaacaggggatcctagggtgcctgagctcatgggagcaaaccttgttcaggcaccgcaagcccaacgcagcatgcagattgggaaggcgcaataatgcaaacaccatcaggaagaaagctatggatgatggaaaacactgtgtgctccacgtgacagaagggagccacctgatttgtcgcatcgggccagtgtaaggaagtgtaatttagtgggactgccagtgacactaagtcaggccttgatcagggtctggactcagtatggacacgagccactgggtgcagggggctcatgcctgccacctctctttttttcccttactatagagactttgatctgtccaccatttctatgtgagctttgggcttcctgtcacaggtctgttgtcaccgtggggccatgttggagtcggtagattttcagacagtgaagccacatgaagctgtgaatgctgatgtggctgctgcagagcccagtctctccccggtgcagggcctctgagacgacgggactgtcctcagatggttggaagaaatgggttatcttaggcagttaggaaaagagggacaggtgtcccaggatgtggaaaacttgagttcatcccctctcttccctccagcaaggatttcagtgctacatctaaaaagagaagccctgttgccgatttaataatttacagtctctaaatccaaaagggcctccatgtgctagtgagactcatgccctcagttatgttcacgatcttcctgagaagtcagacaatacaggtagaacaaaagatagtggttgtactttctcttctgcgtagtgtgggtaagagcatgcggtttgccgcatgcagtgttgttaatcttttgattgtgttgtgaatggctgaaaaaaaagctgaaagtttgattgaactgaaatccaatccatgtcaacataaggaatattctagtgagtttactgtcctaagagaaggtctctcctggggaacccctggtatgcagagctccctgggacttgcagattggacagagagggtgtgccaaaggggtataaacccttctgatggagagagtcgggcgtgtcttcattttggtagttctggaaaggctcctctttaaagattctgatttaataatgttcacttttgttaagattgaatatcattttgaaatcatttctaaacgtgtttcctttataggcactttatctattaaatttacagtggagccaaatgtattagcaaaatctccaagttgcaaaatgaatactcagaatcaaactatagattttttggtgatactttcagaaaaacaatttctttctaaagttgcaaatcatgaaagggaatgaaagtacattaacttgatttcttccctgtaattcaaacattcaacattcaaattaactttcataatttctcactttgtgacaagttgatttacgcatagttggtatttcattaatgcgatttatatagatggaattcttaaggataaacaaatgtttttgactattgcctggggttctttgggaatagatgctttctgaaaatttaaataagaacattactgttaaagccatgaatctagtttggagaacccactgcagttcattttacagagaaacaccttgtcaatggcatcttcatggtgtttactgaaggtaaaaggcaggatattaaatgtgagaactctctctccagctactgattctgcctgtctcgaattcaggtgagaatgacccatacagatacatggattgcacttgaatctgtgctctggtatttgtgtcatccggaggctgagaacgcctgttggtggtgtcgcagatggctctgctgtcttgtgtggacaaactgaaagggattcaggagcttcttctgtaattttactctgctgtttttcatggacatagtgaaagggatccaggagtttcttctgcaatttggctgtagttggactttgaaaaaaacttgaagagtgtgtgtgcgcgcgcgcgcgtgtgtgtgtgtgtttgaaaagagaattagaaaatgaaggtagacactgggtatgctcccccaggatgtggcgatggggcgcccggccgccctggctacacgtcgaaccagtggtcccccatgcagacgcggttccactcgcagccacagttccagcaccactcgagcctgcactggggctgcggacacttcatgtgcatgcagcctcctgttgggggcagaaaacaaaggtgtggtgggttcgcagcaagtacctggaaaacacgcattcccaaaccagcacgctagcctagacatcactttctgagcgaataatcacaagcaatacaagggcagagagaaacttaactgaggggaaaaacttcataaagcacaatagggcagctctaaagtgatgatattcattaagaaatgaatgaaattgaagcatgtcacttttgtcgggaacaaattttatttgtaaatctgactttattctcctgaaaggggatttagagacaaacacttcatgtttcatagataggggtcaattcctcatttaaatatattcaaatattaatatatttatatttaaaatatataaatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatatatttttatatatttatatttaaaatatatataaatatattttatatatttatatttaaaatatatataaatatattttatatatttatatttaaaatatatataaatatattttatatatttatatttaaaatatatataaatatattttatatatttatatttaaaatatatataaatatattttatatatttatatttaaaatatatataaatatatttttatatatttatatttaaaatatatataaatatatttttatatatttatatttaaaatatatataaatatatttatatttaaatatattgataaaatttgatgatataacctaatataatgtataataatttaaatatattttgatttatttttgctctttctatagtgccacttacttggcttggccaaattcataaaacaggaactgggatagcatattgtaattattattatttctatttttttttttgagatggagttttgctcttgtcgtccaggctggagtgcagtggcgagatcttggctcactgcaacccccacctcccaggttcaagtgattctctggcctcagcctcccgagtagctgggattacaggcgcccaccaacatgcccagctaatttttgaatttttcgtagagacagggttttgccatgttggccaggctggtctcaaactcctgacctcaagtcatcctcccgcctcggcctcccaaagtgctgggattacaggcgtgagctaccgcacccagccagcatattatttttaatagggaatatgttccttaatgctatccaaaattttaattaagatgagagggatagaaaggaagtaattaataatgctaggtgttctatgtatattatctcatttgcttcccaaagcactttgagataagagcatcactctgctatagaatttccccaaggtgaagcacttttaaatggtgaagacaatgatctcaccaaggtctgtgtgattccaatgtcctgtcattcacagaacaggttattttcagcataagaggaaaagtcccttatcttggaacttattttggaattattcacctccctcacttgttaaacatagactccatgagtttctggagtgcacacagccctgcttcagtcgctgtgggggaactgaagggaggaggaagtgatttgtatgaggatgtacagagaactgtttctgtccaaatttcctggaaaaccccggcaaacgcagtttctttgcttgaatcccacctagcgttgaaggtgctccattactcactcttaccaattatcttgttaattgatttttcctgccaaattttccaagtaattggttcggtgctgtctcacttttattattagaaacctggcatgagaactttcactaatttaaaatatttatgaatatataggaataggcatttgttttaagataacttgccgacatgcaaaatctcctgttttcctaatcctttctggcttgttttaaagatcataaattacagatctgtggaaaataaaggagaaaacttacaacacttttatcttcatactttccacttaggtttgtgccattttcagcacatattgcatggttgtatatttatgatgtaaataatatgttatatggtgtgacattataaaaccacttgtttctctaaaatatcataaatattttatcatatcataaatatatcattattatatcatgtatcgtaaaatatattcaatcaaaattattgagcaatacattaaaacttaatgaactattaaagcaattctaaatgaaagggtaagaaactttcctattgtgatatttaatatatataagcatatataaacacaaatatgtatgaagagtgtgtgtgtgtgtgtgtgtgtgtgtgtgtatatatatatatatattttattttattttattttatttttttgagatggagtctcgctctgtcgcccaggctggagtacagggcgcgatctgggctcactgccacctctgcctcccgggttcaagcaattctcctgcctcagcctctcgagtagttggaattacaggcacctgccaccacgcctggctaaattttgtatttttagtagagacggggtttcaccatgttgaccaggctggtctcaaactcctgacctcgtgatctgcctgccttggcctcccaaagtgctgggattacaggcatgagccaccgcgcctggctgatagatgtgtttttcatacacagtccctggcttataactcccatagctcttgttacagtcttttgtcataatgttggggcaattcaggcctcagaaacaggcgccagaaaagagaatctctccctccgacctttccttgccctccttttaccagcccagggcaggactggaaccatccgcagctgttctgactgtgggttataagacccggatttcagaaagagtcctgtccatcccctggaggaaggaatgctgcacagggaggccaagaagaatctagaccggcaggccttgcagggtctccccactccatcttttagcgtgagatcaaagcctttctgtcccaccgcatttcaacacggctgtccatgcttccatcgtgcctatcccaggaagtctccatagagggccccagaggacagggtttggggagcttccaggttgctgaacacatggaggtttctgatgggcggagcacccagggaaggcttggaagctccgcgacccttcccccatacctcgccctctgcatctcttcatctgtatcttttgtaatatcctttataataaactggtaaatgtgtttccctgagttctgtgagccactgtagcaaataacagaacccaaagagggagtcatgggaatctcaacttgaagccagtcgatcagaacttccggaagcccagacttgagaccggtgagtggcagtcctgtgggactgagcccccagcctgagggatcagacactatttcctggtagacagcgccagggttgaagagcaggacactcagccggtgtccactgcagaactgattgcttgcttggtgcgtggggaaaaacccccgcacattccgtcacagaagtcttctgtgctgactgttgttattgaatgagagaatagaagaagcatgttgtttgttctacacttagaccgaatgccaaaaattaataccaagcatttaatgaatctgggatactagcattgtaaatgatatcttggtacagaagctagaattacaatggcctggtacagtaagaatggaaatgggaagagaagatattcacgtcattagctttcttttctccctagggcttaatatacacaaggccatagagctagacccaggccatggaggagcatggaggaccgcaattctaaaagctttgccagcttaaaagtaagtgcatccaggaagcagctgaaacttcacgcagatttgtggatatagacatgaagggaatatggcttcctttgtagtgagttctgtctgcagatggacactcaaaccatgaaaagctcagcctacgccgggcagtcgacatcgtggctccggccagcaattcttccactagatttaatgagagcgtggaagtccctgaacaacctgaaggcacatttgaggagaagcacacactcagtcagggaatggagccagaatttcatctgcttgagatggaagtgaagaaatttctggagactggagtggattataggagaaagtaccagggtttagcctgtgcttaaaatggaaattcctcgcattctcatttcagcttctctgagggaggaagggcattcctgaaacacagctgagtatgtaacaggccacgaaccttggtgacaaccaggtaacatccttggtcatagaggctatgtcggtttcggttacagtgatgcacttttaaacagtttaggccatcgctaataagcttcaagtctcagcttttctgtttgtaagttaaaaatttggaggtaaaaaattagtgctttcatttatagtacatcacaatatttccaagaaatagcccgacagggagaaactttcctacagtcacgaaccatttgactcctacaactccatctttggaggctgccagcatgttctgagtccagggcagatccgatgaataattttcctgcttctcatcctagaatatctgcctgcctcacaggatcaagtccaagccccaaacctgccattcagggacctcaattctgcatcctacctactgcttcagctgaggctcctgcgtgcggtgcctggaacacgagcagcaggggctgcctccgcacaccggcgcgcgcacacccggtgtctttgctcatgcagtcctggggcctaggacgcctcctcctgctcttccttgccttgctcatatctgctcattcttcaattcttggctggtatcatctcttccaggaagcctcctcctccgggtctgtgtgccctgatagcttgcttcctctatgttattttattaaaaagatcggtttatgtgtatatctctaaactttacaagctaagtttttgtgtgtttgtgttttatttattctttttgagacggagtctcactgtgtcacccaggccgaagtgcaatggtgcaatcttggctcactgcaacctccacctcctgggttcaaccaattcttgtgtctcggcctcccgagtagctgggatcacaggtgcctgccaccacacctagctattttttttttgtatttttactagagacagggtttcaccatgttagtcaggctggtcctgaattcttgaactcaagcgatctgccagcctcggcctcccaaagtgctgggattacaggcgtgagtcaccacgcccggcctacaagctaagttttaattcagcaaatattttttgtccgggctctcttctgggattggagcctagacggtcaaggtccctgatctcaccggcttatgttctaaagagcgacagatggggaacatgtaaatgaacaaattaagcaatgatctgggaaggaagtggtgctatgaaattattattaaactggtgggtgggactcgttgggtaaagggggaagcagacactgagatggaaagggaggagggcagactgggcagaggagaagcccagctcgggcacagcctaagaggcctgagctgacgtccaggagctctggggatggggcagctctcagggtggtcctgaatttcgttagtgggttgggtattatgaccaaccagtagtcatgggacatgagctctccggggaaggggagggagccagaactaattgtcttggcagaggtgatttcccagagggctcaaggccatccacaggcaggccccctgcagagggaatggcagtgcctccccctcgagagatgggatggtgttgacagtgccccccaacaggagggcaggggtctttggcagggtggtaaggggcggtctgactgagaagaggtcagctggggtaagatctgaaggacaggaaggagccagccatgggcagtgacgacacagaagcgtcctggggagaggagcgggactgtgtggttgcaatgtcagtggggacccccggggggaagggcaggactgacatggcctttgagaagtctacacgtctatgtagaggacggatcataaatatgcgagagtggaggcgagagcccttttgggaagctgtgcttggaagaggaggcgggcaagcagggcactggctggggacgtggagtcagaggtgggcagacgctggatcagagcacggggaaggccgtggtgaccggggattgaatgcagggtgaggaagagcatggaatgaaggatgagctttagcttagcggcttgaggaactgggcggtgctgttgactgaggtggggtgcaccctagaggaaaaggttttctaggagcagctagcactctgctttgtgaaatttgagctgtccattgaacaatcagtggagacactaaggaagcagctggctattggagtcggaccgaggggcgagatgagggtggggtgtagatttgggagccatcagtatgtggatagtatttaaggccacaagactgggctgtatgttatgtgtcacaaaggtgaagtgtctcaggtgtccccacaagccgacagtaagtgctgaaccaaacaaccacggaggagagaaacagaaagcaacaggtccaggttcgctgaccacttcctttttttttttttttttttttgagacagagtcttgctctgtcactcaggctggagtgcaatggcatgatctcagctcactgcaaattccgcctcccaggttcaagtaattctcctgcctcaggttcccaagcagttgggactacaggcatgtaccaccatgcccagctaacttttctatttttagtggagacggggtttcgccatgttggccaggctggtctcgaactcctgacctcaggtgatccgcctgccttggcctcccaaagtgctgggattaccggtgtgagccaccactcccagcctcgctgaccacttcttatcttgcaaactgccaccaccagagtctgggctaccgaggaggccactaaggcatggaccccagacctgctgggtaaattctccacctgccgtgcctgtgacgcctgccagaagtgggaacatgggtgggtgtttaaggatcccctttccctccccactgcagacagagacctggctgatttttactaattttctaaggttatacgtcacacatgtttattacagaaaagcataaaaagaaataaagtcctctttggtcctgttatgcctagagctactcactatgacatggtaacatcttgtttccagtctttttcttctgattctattttttcccacacacacatttgtttcaaaacagacatatgtgccacttgctttgaaattctgatttctcactgaggatggatgtaaacctttccgccatgccttcataaccttcatccacacgaatcagagcacgtctcacggagcgtgtttgatgcaccgtctctgttactcctcctgcccatgctgtgaggaagtcccattgaaacccatcttatgaacgagcaaactggtgctcacacagccacagtccatggcagagtcctaactcctgcaacactgcagtgccgggctgtgtgaagctttaccaccgatttatcacaaaataaaccaatctttctcatactgaggcctttagacacttcgatgattttcagtttacgctaatataaataatgctgcagttggcaccttttttcctaaaatgtgtgtgggggtgtgggtgtgtttgcctattatatatttcaggttagtcctttaggatagattttcaaaggtagaattattgggtcaaataatataaagtctttatataggtattgccaaagtggtttccagaaaagttacgctaacttatgatgtcctcaccaaccttgagaattattattaaaaaacaaaacaaacaaaaattaaggccgggcacagtggctcacacccgtaatcccagcttggctttgggaggccaaggcgggtagatcacctgaggtcaggagttcgagaccagcctggccgacatatagtgaaatcccgtctctactaaaaaatataaaaattagctgggtgtgttgcgtacacctgtagtcccagctacttgggaagctgaggcaggagaatctcttgaactcgggaggtggaggttgcagtgaaccgagattacgccattgcaccccagcctgggctacagatcaagactgtctaatctctgtgctttacacccttgtcagcgaaataccaggcctgtttatcccaaaccatcacatatcttctcctgggaagggcccttccgtgttctttccctcccacttcccagtgcacccagtggtggtggagactagagaagctctttccttccatcccatcagtgccttctgctcttttttttttttttttttttttttgagatggagtctcactctgtcgcccaggctggagtgcagtggtgcaatctcggctcactgcaagctctgcctcccgggttcacaccattctcctgcctcagcctccagagtagctgggactacaggcgcccgccaccacacccggctaattttttgtatttttagtagagacggggtttcactgtgttagccaggatggtctcgacctcctgaccttgtgatccacccgcctccgcctcccaaagtgctgggattacaggcgtgagccaccgcgcccggccgccttctgctctttataggtgcatgccaatcccttcattttctaggagcactgctgcatgcaatggagtaataaggacacgctgggtaaattatttattttctctgcaggaagccactgatacagcactaaggacttgtactgagctaagccagcacctgcggctctgggatgtgttcaagcaccgtcttgtttgtattaatgaaaacttcctgaaggacataactgaaaagagagaggcttgagtgcccatcctgggatggccgggcttccctcccgcaagtcagctctgggcaacctgccagccagggcgtagctgatgctcattaaggagaagctgggagaggctgcgcctggcttcgtgtcattgctcatctgtgatggtgccgctgactctgccttgcacacgtacaagtgcatcacattgagaaagggctctcggaccactggttgtgatggctttgccctgagtggcatgtccaggatagacagcaggaagtcccccactggtactgtgagtcatcaggggcaggccacagggatctttaaatatagacgagggtttaattttgaataatgttgcaaagctggggaaggctacagactgacggccggcagacaacagggtcatacggtgcagccatcagcgctggggaaggtcaccagggaggacagaaaaaccacagctgcctcctgactgccacttatcctcaaccactttccatatcttggttctagtttctatatttattccctttccaaccacataaatgctaactgtgtgcctcacatagccatggaactactcactcattaaatatttctgtgtaacaaaaacaataataatagtgataatgggtaacattaatcgaggggttacccaacacaccaggcaccttcagacagcatctcctttaatcctggaatccctgatgggtatgattctcccccaaagagcacacgacatcctcattctctgctcagcacagactcaccatttttttccactggtacatggcagcggggacagggcttggtggttttcttgatggtttctttggaggctgcttcccaacgagcctgctcggcggctctttcatcgactctgtaggcctggggaaacaaagaggaaaggcgtttaatctcagctttctattactgggatcagagtttatgttccctgtacgtcggtacaggaaattcttgaagacaggagtgccttcgggcaagaagcctaaatatcaatgcacttgacaaatgctagacagctactaggcggatggggacactctccctggcatgtggcgtatgcgtaggagcggggaagagattgtttggttttgtagtgtgagctcctctattctgttgttttgcataattgtaataaataacacctatcaggtgcttaaaatgcaggcaaggtgatcaatgctcaaatacacttctcattagacacttcatcagatgtgaagtgaggatctagtttttattccacattgaggattcgatgggtgaaaacatggcccaaagctggtaagtgggagtatcagtgtgactctggaatctttgcttttaaactttgctctacatcttgttatccttccttgcacctggcaaatggggaactccaaatgttgtcacagaagggacaggagcaagaacaggaaatgaagtcgatgtgccagagagggcagtgggagctgtgagtgaagactgtggccctggaaccagctgtctggttcaaatcccagctctacccagacgggtgactctggaaacattccctaagctctctgacagtctttatctctcagatgaaacaccttgtgcattgggggtatggaggattctatgagttaatttcttcaaagactcagaatgactccagtgtggcaagcttttaatacatttgctgacattattcatgtcaccgagagctgggtgctgcctgcaccatcatgtataaggaggttttctggtgggggtggaagcaagaggtcctgggctagctgtgcttgacatctgtgaccttaaggaccagccattcgctgattatccccagataagatgcagcatcaccaaaaacatgaatccaaactttgtcatttcactttcgaattccaagcctttttgaaatgttaaagtttttgagtctttatagatgaagtattatgaggaaaataactgtactgcatttaatagtttctttaggaattagtgttcatgtttctgttatttctgtggaaagtcaattcttccagagccaagatcacatttgagacatcctcatatccccagtttctggcatagaatctggtacacagcaggcgatcagtacatttcaggcaagtgaatgaatgaatgacgcagcccaggaaggcactaaactttcaggggttaccaaatttcaggggttaccaaactttcaggggttaccactaaactttcaggggttaccaaacatccaaaataggaccccgtgaaatgggcagggcacatgggtggtatccctgacagtggtgggggcaccacagacaagctttgcctagggctggtcactgggtgaagccaatttcgtttctgttaatgagccatcatgggcacaaaggaaacacccttgagaactgccagggtgtcacgtgatttgtgaatactttgctagaataacgtggagtcagctgctcggaggcaacggtaggtcaatgagtgcttcctttgctaagatccactcacggcagaggcccagtgagggcgctgtggttagtgagggccatttcacaacttggtaactaggtatgcatcttcatggcacgccttccagtcaccacagagtcttgggtggtcctaaccgtcagtgacacgtggcaaacacccatccccccaccgacctgcaccccaacgccaccccggcctcatgttccacgctgttctttttcaggtctagggctctgtagctctgcagcaatggtttagattgcttgttggtggcaagttggtaagtcatacaaattggagaaaaatacaattttacttatcagaaaataatttcaaaatgccattttttagcaacatggcatactgcatgtgaagggcaatttctcccaggtccacacacctaaaaatgctggatcaaatatggaaaaaaatcttttttaaacgtacggctgatagggtgggaaggcaaaggaaacccttaaagacagcaaatcctcctggttcgggaggaaggaacctggcatttgctgtggggctatcttcttagtcccgcgctgcccatcatctgggtcttcccaggccctaagggcacaggcaggagacaaagcctccagccagagccaggtgggaggtggaatccagttttactacacacagaggacctggactcctgagggtgacgttctcagtggaggaagccagggcaaaagcccgccctgaagagataattgacagatatgtgctggtctcaggctgggttctgtgaggcagcaggtttggaaaacatttttctgaacattcctaaccatcaggcctcggacacgagggttggtgaaaagaattcatcctatctgattagctttaaaaaacctcaagtcaaaaattaatttgaaatattaccagattggcatataccctggaaccaggcggaagcaaaaatatcttttgtggagcacagcactttaaaaagccaaacctcaaggaaattacacaaataaaattctaagaaatctgggatcataataaaaaagttaaaaagtcacctaatacaggagaaaactagctacatgagtgaaagtcacagaattacagaaactacagaatctaaccagcaaaggttgtagatattggaatggccagagacagagtactggccaggcatggtggctcacacctgtaatcccagcactttgggaggctgaggcaggtggatcacttgaggccgggtgttcaagaccagcctggccaacatggtgaaacctcgtctctgctaaaaacacaacgattagccaagcgtggtggtgtgcacctgtagtcccaggtacttgggaggctgaggcaggagaagtacctgaacctggggggcagaggttgcagtgagccgagattttgccactgcattccagtcccggtgatggagtgggactctgtctcaaaaaaacttaactgagtataaactaaatatgtttgttatatttaaataaataaataaaggtgatgataatggaataagagactgtcacaattaaccagggagatgtaaaaaagaaacaaatttctttgttttgtccatttttctggacatgaaacactaataattaaaattagaaactcagttgatgagttacataacaaattagatacaaatgaagagagaatttgtgaactgaaagatggagctgaagaaattacataaaatgccaagaagtaaaaaatatgaaaaggagattaagagatggggggataaggtgagaaggtccagtgtttttctaagtagagttctggaaggagataacaaagagcatgagagagaaacagtgtttggagagagtggcaaaaaaacacacaaattatctacaaagaagttacaattattccccccagctgatttcttaatgcatgggtgctggcagacagtgatggtatcttcaaagcactgacagaaaataccagcccacttagaattctatccaagcaaaattaatttttaagaatgagcataaataaaaacacagtaataaaaaacagcatttcccatcaacagaagttcattaaagaaacatgatttggggccggatgtggtggttcacgcctgtaatccaagcactttgggaggccaaggcaggcggatcatgaggtcaggagattgagaccatcctggctaacatgctgaaaccccatctctactaaaaatacaaaaaattacaaaaaattagctgggcatggtggtgggcgcctgtagtcccagctactcaggaggctgaggcagaagaatggcgtgaacccgggaggctgagcttgcagtgagccgagatcacgccactgcactccagcctgggcagcagagggagactccgtctcaaaaaaaaaaaaaaaaaaagaaaagaaaacaaacaaacaaacatggatgtgggaggccaaggcaggcagatcaccaagtcaggagtttgagaccgtcctgaccaacatggtgaaaccccgtctctactaaaaatacaaaaattagctgggcgcggtggtgggtgcctgtagtcccagctactcaggaggctgaggcaggagaatcatttgaaccgggaggcggaggttgcagtgagccgagatcataccactacactccagcctgggcaacagaacgagactccatctgccaccacccgccccgcaaaaaaaaaaaaaaaaaaaaaaaaaagaaacatggaaataggaaaagtccagaaggagccaggagctgcaagaagaaactgtgagaaaagaaaaagaaaatgggtaacgtatggtaaatcacaggaaatactgattgtctaaaactgtaaacgatgcttaatttgctggttaaaaaaaaaaaatccaagtaggctgtgtgtggtggctcacgcctgtaatcctagcactttgcgaggccaaggcgggtggatcatctgaggtcaggagttcaagatcagcctggccaacacagcgaaaccgtctctactaaaaatacaaaaagtagctgggtgtggtgcccacactactcgaaaggctgaggcaggagaattgcttgaacctgggaggtggaggttgcagtgagccgagatggtgccagtacactccagcctgggcaacggagtgagactttgtctcaaaaaaaaaaaaaaaatcagagtagaactagatgccggacaagaatagcacagaagtgtgagaattggatgattctaatgcgctggcatgattcaggcagagggtccttagatttttttacattaatatatgtttacattctagggtaatcaatacaagagaaagcaatttgcttctaaacaaggaaaaatacagtggaaatggcaaacaaaagagtcaaaagaaaggcaagaagtaaaagtaaaactatagaaatgtagaatgtaatagaaagtataaaataaaatggcagaaatgactgcaaatatcccagcactcccaacccgtgtggacagattatcattgagggcaggtcttgctaaactctagagtcttagcacttatctgggaggccttgtctgcaagaggagcactcaggggctgaagtttctggctcaggtgtgtgcacacctaaagcctttgttacatgttgccaagttaagagcattttcaactgggcgaatacaatgtttattctaacaaaggatgttatactcagcccaagagaaagattcagagctcaacttgaagaaacctcctgcctgtcaatagcacattactggagaggaattacaaactggaaaattgcaaatttatattaatatgctttgttctgtccaggaagaaagattaaagttacagcaaaagaagagaaataattacttttcaaaataccaattttctctgacttccgatcccccgagcacacaaggcagagtgggtataacttgcaggcccaccagaaagccactaggatttccccaaacggctctggatgtaacacctccagcagcaagcgtccttcaaatcaggacactgcaagtttaatacctaggagtgattacaaaagactacccgtgtaaacatttccacactagtgtgcactgagctactggatgggccagttcactcaggggagagggaggtagctaggagggtttgatccttagactggaagagggaaaattgagagcagcaatttctgttttcacctgcaaggatatgtacccttatcatttccttcacagactctgcaactgggccaatgttacttcttccccggatcgatatgttgaaatcctacccaccaaggtgatgctactggaaggtggggcctttgggaggtgattaggtcatgagggtggagctcttatgaagggattcgtgcccttattaaagcaaccccagagagctctcttgcctcttccactgtgagaagatgcagtgagatgccagcagtttgcaggaagagagacctccccagatctagagcctgaggttgaggcttcctgggctgagctttggttcctgtaagccatgggcagcagcgtgggttaagaggcaccctcatgtccacaggacaccagagctgctgaggggccgaggcacacgtgagccaaggagtcaaggaccccctcatggagatgcccacactgaaggtcagagacagagaagaaagcctagggaagagaaaataccccaaaccctaggaaaagaccaaaatgctgatgtcgcaaaatggtttttaatactgttaaagcaaactaagtatggcctaagaaggactccgtacttctgtatttgagtccttgtggtcgaacttagccaagattgaaaacccaacttaggagtgtgtctgacttaatatgtagacaagattgaaagtctaactctagagtatgcaactgtaacaacagctgggtcttggccaatcccagcagccatgcttcagccactcatacactgctgagtgttcaaactgtgttcaaatgaggccgacaccaacttgtaaccagcccgggtgtttctgtacctgacttccgatttctgtccatcacttccctttttgtctataaatttgttctgaccccgaggcacccttggagtctctctgaatctgctgtaattgtgaaggctacccaatttacgaatcgcttttttgttttttttcttgctcaattaaactctgctagatttaatgtgtctgaagttttttggggtttttttgtttccttttttttttttttttttttttttttgagacagagtgtggctctgtcgcccaggctggactgcagtggcgtgatctcggctcactgcaagctccgcctcccgggttcacgccattctcctgcctcagcctcccgagtagctgggactacaggcgcccgccaccacgcccggctaatttttagtagagacggggtttcaccatgttagccgggatggtctcgatctcctgaccttgtgatccacccgcctcggcctcccaaagtgctgggattacaggcgtgagccaccgcgcccggccgtgtctgaagttttaacagtaccaagctaggggagggtgttttagccggcaggacagctacccactttcttttgcagtgggggtggggttcacgctgacctcctgggactgtcaagggcccaggcagatcttggccttgattggagagttaggggttacggtgtagaaaactaataagatgtgtcttttcttttttttttttttctggtagacagtatgtgctcaaaggttatggttttattcctccatagggcatgaagcagttctgttatctaacttagaagtcaaagttcagcattcctttcccaatgaacgacatggcattctgttcctcaaacgctacttgtgctgattttcccattaatctgatgactcagacctcggcacgggctaacacagagctgtgtaggcatggcgctgggacagctgcagggtgttagagggaggggcggccggcgggtccgagaccctgctgcccaggaggggaaggctttgaagaagtaaggacgcttctgttacatgaggaagggcactgtgcggcaggggctctgcccacatcacagaatgtagtaactgcgcatccctgaaggacggagcttgtcattaactatttcagctggagagatcagtctcagaaaactaaataacttcagacccaggccgcctggcctgcgagcagtcggttcagaatcggagccccgagctgcctgggttcatactccaggcccctgcagccttgatttcttcctgtcattatcaagtcacatgctacaaagagggctaagggactaaggctaagatgctgtcatggagatctggaagtccccggggacttttgagagcacagttttcaaacagcttgtggccaggcgcagtggctcacacctgtaatcccagcactctgggaggccagtgcgacggtcaggagttcaagaccagcctgcgaaacatggtgaaaccctgtctctactaaaaatacatataatatttatatatatgtatatatttatatatatttatatatatttgtatatatatttatatatatttgtatatatatttgtatatatatttgtgtatatatatagcaacctcagtcttgatatatatatatatatatatatatatgctgggcctggtggcgcacacatatagtcccagctactcaggaggttgaggcatgagaatcacttgaatccagaaggtggagattgcaccgagccgagctggtgccactgcaatccagactaggcgacagggcaagaatctgtctcaaaacaacaacaacgaaagcaactaccaccaccaccagcacccagcttgtggtaaagacagtgggagaagccacccagcccccctcccctcactgcagtggctcacctgccctccacttgcctgcttcccctggcaccagcactgcaactccactcccagctgcccacccgcccttctgccctgggccatcgctgctgcctggccggttctcccttccccaacctgccgaaagtgctttcaagaaggacaccaggaggccacggctgccaaagctcatgccctttctttgtcattgtctccaactgtcccactgcacctaacatgtgggaaagggtcaccaagaaggcccttggagttcctgcccttctcagcatcacagctcttcctgtgcttcctatcctcacccagcggatccacggggagggaggggagtcccagacccagtgactgctgccactgctgccagccccagggacctggggggcaggagaagcagctctatgacaccccgggagtgggcggtgcccaggccactggtttagacctttgactgccacttccgagaggggatttctaccaggaggagcacatctttgctttgcatccttcatgagtgtcttaatgctgatgtttaaatccttctggagtgatctcaagcagtggctgggtgcccacaggttcaagatcaccaaagcgattctaaaaatgatcccaaggcttgtgtccagactctggagattgggattcagtaggtctgtggcggggtacagaaattagaatccctaaaaatgccctaaggggttgcgaggggcgggaggtttgggaaccattcatcctctggagggcgattctccctttgcgcctgaagaggaacatggtgagctgggtaacttaccctctgttcccgccttagtcatcaagctctaaagcaatgcctgcttattgtgttgccaggaggggaaggttttgttgtgattcagcatcaccgcccgattgtgcaataaagtgtggctctcacggggcagtgtaactgttaggtaattgcatagaattctgtgcctgtctactgctcacccgtggcaggaggaattgcatgcatgcatgtgtgtacgcacgcgtggtggaggtgggggtggaacaggacaagtctctctcctaatatacttcatggctgaaaatagcgatttcataaatatatatatgaaacatctataatatacttatatatagatgtttcatatatatatttcatatgattataggaaatatatttcatatacatatagagagagacagagagaatcaaaattccctcagaaaggtaaaggcatgatcgtccatctgtggctcaagaggaataacctcacaagggtcatcgtgagtaagatcaacacacaaacggcttagcacagagccaggtgcaccctgaatgctaaccgtgtgttttctatgatcaccaccattattactttgttattgtaatcatcacgatcatctctaaagagatgggaatatgaccctgtgggagtttgtacacatggaaaagaccactgaaggcctggattggccttaaatctcctttaaaaacacaagtatgggaggccgaggcaggaggaacacttgagtctaggagttcaaggccagactggtcaatataatgagaccctgtctctataaacacacacacacacacaaaactccactggtaaatcaaaatgtacttatataggttttaaaagctgaattaggctgggcacggtggctcacacctgtaatcccagcactttgggaggccgaggcgggtggatcacgaggtcagatcaaaccatcctggctaacacgatgaaaccccatctctactcaaaatacaaaaaaaaaaaaaaaaaattagccgggcgtggtggcaggcacctgtagtcccacctacttgggaggctgagatgggagaatgacgtgaacctgggaggcagagcttgcagtgagccgagatcgcgccactgcactccagcctgggcgacagagcaagactctgtgtcaaaaaaaaaaaaaaaaaaaagccgaattagcgcctaggagacacattgatatacattgaagctagaataacttaaggaactgcatatgtgttatctttcctgctttaagagaaactcatttgtgacacctgtgtagccaataattagacaagtctattctaatcctaaaaatccatttaagcctgttttccaaaaaagagcagttgtcattaatcatgaaaacagagttggcttaattcagctatgaatgctttcaggtgaatgacagcttttaaatgtcagctttctcatcaacgctcgcctctcttctcacaaacactgaaaccttccacctttgcagacagcagccttcctggctcagtcaagcaggtgggccagttgagcactgctgcgtgtgagcagcccgcctcctgctggtgagtaagaaaatggcatcacttttcaggggccttgagctagtcaacgttactgcttggcaacgggtgtcaccaaaacatgttttgttgttctcacattgtcttatgactatctctttttggagaatatgtatatatgtatatatttaaatgtattttgttatttttttttttgagacgttgtttcgctcctgttgcccaggctggagtgcaatggtgaaatctccgctcactgcaacctccacctcctgggttcaaatgattctgctgcctcggcctctcaagtagctggggttacaggtgcctgctaccacacccggctacttgggaggctgagggaggagacggagtttcaccatgttggccaggctagttttgaactcctgacctcaggtgatctgcccgcctccgtctcccaaagtgcttggattacaggtgtgagccactgcgcccggcctattttgttattttttttaagagaaatcatcagagtgttgggatttaatggggtgtctagccaagggctccggggaatacaaggctacactgtaagcaatacaaggctactccactaagctccaaactccccaagccatgctttagaatgcaattcagaagggcatttgtttttatttatttatctatttttgagacggagttttgctctgtcacctaggctggagtgcaatgacacaatctcggctcactacaacctccacctcctgggttcaagcgattctcatgcctcagcctcctgagtagctgggattacaggcatgcaccaccccacctcgctaatttttgtatttttagtagagatgggatttcatcactttggccaggctgatctcgaattcttgacctcaggtgatctgcctgcctcggcctcccaaagtgctgggattacaggcatgagccaccatgcctggcccagaagggcatttttgacaatgattctaacagtggtgatttctgctaggagtggaatgtgtgccaagtgccacagacgagatcttacagagtcttgccccatggggccctaaatgcttcctaaaggggaagtgaattaaaataatatctatcaacctattttgagattaatgggggaaatggaacaacataaatattaagtagcagaattattaataggtaccatttattggttattttaaaagtgctttgtgttcaactattgttacaagttgacatatgggaaaaatctacacttgagctagaaaatatgctgatttgtatttttgataatgacattctctagtttttggttggcttaggtcagcagtgaccaaaattatccacatagatgggattctgaatgcggaatcatcactaataggatgtgagaggggtcaaagccgaccacagagcctaccttttgtgcaaagtatagttattctggcacaaagtagactattatttttgctagagtgaatgcagaaatattttcattcaagaaacatgtgttgggtgtctaagatgtgccaggcactgtcctggaccctggggatacatcccagtaaacaagagagatgacaaatagcaagccaacaatccctgccttgtggagcttccccattagcagaacggcggctctcagaccagcggcaccggaagcgcttgtgctgtggctcccccactacccctctgggtctgaatccataggtctgggattgcgctcaaggactggcagttcaacaaattcctaggtgatgccgatgtcgctagcctgcagagcttcggagaactactgctcgcagaaggtctacatacactgtggtcaacaaagacagagagaccctattttttttttttttttttttttgagacagggtctcactctgttgcccaggctggagtgctgtggcaagatcatagctcactctagcctggaaatcctgggctctcgagtagctgggactacaggcacatgcttctgtcctctgctgatctttaaaaaatattttttgtagagatggggtctcactttgttgcccaggctggtttcgaattcttagcttcaagtgatcctcccaccctggcctcccaaagtgtggggctgccggtgtgaaccaccacactcggtagggcagaatttttctcttctctgggaaaccgaggtctttgctcgtcaggccttccatggactgggtgaggcccacccacattatagagggtcatctccttgacctcaaagttaactgagtatagatgttaaccacgtctacaaaaataccttcacagcgacaccttgactactgctggttccaacaactgggctgtgtggcccagctacattgacacagaaaattacccatcacagctaggctgaaactcatgtttaagactagatctgtttgacttcaagccccctctgcttgtcttggattcctcagacacgggtgggaacacctagtccttgctgaaagaaggtaaatgcaaccctggagaacagcagtgctgagcctaaatgggctatgcctctgtgcttacaggggtgctgagtttaaacgagctatgcctctgtgtttgcaggggtgctgagtttaaatgtgctatacctctgtgctttgcaggggtgatgagttaaatggccatgcctctgtgcttgcaggggtgatgagttaaatgggctacacctctgtgcttgcggggtgctgagtttaaacgggctatgcctctgtgcttgcaaggaacaagtgtagagcaggtgaaccgttttcctcacacatggtcaacatgcttttctgtggagtgacaatattttgtcccccctgccagccccgtttttaatgaaggaattatgggggccaggatccagctgttagcttttcaaatctgcacacctctcagaaatgctcctcctggggacacagtccttcgattccctcttgcctgttgtcggctgggccactatgcaggcgtggctggggtgcctttcaaagtggcgttcactcccttttcccccaggtcattttatttttgtttctggacaaatccagcattttccttaagggtttagcgccatctggtgcatcagaggcgcactgcagctgcttccctcctgatactgagtggggtgtgcagagaattgccaggggcgctttcctttgaggagctccaaatgcccgtggggtatgcggtgtgtatgtgagtggcgagtgtgtgcagtgttatgtatctgtgtgtggtgtgtgttctgtgtgtatgtgtgttgtgtatatgcgtatgctgtatgtgcagtgtgtgtggtgtgtatgtatgtgtgtgtggtatatgtggtgcgcgtgtgttgtgtgtgtaacgcatggtgtgcatgttatgtatatgtgtgcgccgtgtgtgttgtgtatgtgtggtgtatgtggatgtggtgtgtatgtttatgtgtgtgtggtgcatatgtgtggtgtgtgtgatgggtgtgtggtgcatatgggtggtgtgtgtgatgggtgtgtggtgtgtgtggtgtgtgtgatgtatgtgtggtgtgtgtaatgggtgtgtggtgcatgtgtgtggtgtgtgatgtgtgtgtggtgtgtgtaatgggtgtgtggtgcatgtgtgtggtgtgtgtatgtgtgtatgtgtgtggcatgtgtgatgtatgtgtggtgtgtgtgtatgtgtgatgtgtgttatatatgtgtggtgtgtatgtgtgatgtgtgcgttatgtttatgtgtgtggcatgtgtgacatatgtgtggtgtgtgtgtgtgtgtggtgtgtagctgtgacaataagtttctataaaaatattttccacattgcgaacttgttctagctgcttgtttatggagtctagtacacagggtatacagggtatagacttgcaaagtcggttcagaatttacattcagaccttttttaccaactctgctgggatcctgaaacccctctggaatccaaaagccttcaggacagcatcattttcagaggagggtcccatgtgtcaggccaggcaggcatctggtggaggctgcactgtggccgtgcagaggaagactcaggggacccgcaggctgtgacccctacaggtgagtgagctcaggggacccgcaggccgtgacccccacaggtgagcgagctcaggggacccgcaggccatgcccctcaaggcagaactcctgggggtggagggaaccccccgggggtgctgaggctcctgcagagggaggacgcccctggccggaagctgcaccccagggaagtgcgttgcagagccttggtgctctgccgtgctggagtgacagtccagaagagaagaagggtttctgcagtgcaggagagcgcttggagagccccagccccaggtctgcatggtcaggatcggcctccaggggcaggcgtgtggtgtcactgtgtgtgtacccacgcaagcatgccttcacttgtctttcaatcccagtcaatcttatctttcctttcctctctccacagtgcctgacagttttagcattcagccttaaaaacccaaacccccaagtttcaccattttgtaatactttgcaacttacaaacggcgaaacacacactcatttcattatttatagcttggtagatcttactggctctgtgtggcaggcgacgaaaaggctgtgagcctttgagcaacttgcctggaagaggaggaaatgaaaccgggcctttgacgacctgccaagggccatttctgctgccccagagcaaaccttcgcacacaagctgagtgccttggaaacgcactgcagaggggcgggtgctgtcctggcactgactcagcttttcacagcgcaaggccgagcccgaacgacgcgctggctttaatggagatctgtcgcagccgttccatcccatctgcacatccacttaggcggcgggtccagggtcatggattcaagagaagtggcatcaaacctgctttacttaaaccaacaagcagttcagaaaatacactcccaaataaccggggatctagatctccgggaataataaattacacccatctcccaatactgggactgcatttgtgtgtgaaggcagtcaatggctgagagacggctctgcggtgagatgctggggcaaaatagatcaaaaaagatctcagctccctggagccactgctgcttcagtgtcctccactgagggaggtgcacctcctagcctctcctggactgtaactctgaaggggtgggtgtgggtgtggggagcatggataaggggcagttcgttggagattgtcagtcttgcatcttgatcgctggctccagcctggattctcctctgaggtggtctaggcatccactcctttccccactgaacccctagctgagatgtccacaatgaatgtgtgtctccccgaacaacctgcttttgtttctgtctcctcttccagccaatggcaccaccatcgttctaagctagacattcatgcatcaacattaacccgtctcctctcatcctgtcttctaatccactgccaagttctgcagatccgacctcaagcccatcccctcctctgtattccctggccggattcctggtgcctggtgtgtctctggtttggcccttttagggggtgctctgctctgctcccagtcccaccaccttgggactgaggtcacaccgtcacatcacggcgatagggcagctcacgcccagtggtggagggtggatgcgaagggctcacctctagcctcctacctctggctcccctcagtcttctgtggcaaccgcactgcagtgggactccacctctgcccaaccctgcttccttctcttcctgaaggtgctgttgagagcaccccaagacactccctgcctgcaagtctcagagcctgttctcctgggaacctataacctgtggcacttggtgcctggatagtcctaggaagcaaactctaaaatggagttagagctggaatccctcccgccagtggccaaagaggagcctgtcactgttggaagaaagtgctggaagctctgagtggggccccgaggagcaaagggcagggtcaggcggcatgcaagcgccctgtctctgcggctgtgcacgcaggcagaccctgtggattccaggtgtctgtggagggaaaagaggtcacgtggggctacctgcgggccaataagagcatcccagcaaagattttgggggttcagcagctgagaacgatggaccatttgaaagagagcccctggcacgctaccgagccctgtggagttggagcatctgtgcagcaattgtcataagacagaagtggggcatctaggcccaggcccaagcaggcccacggggcgtgagcgagctgcacaagcaggtcctcagacccccgtgccatccacaccgtggcatgactgcctctccttgggctcacaaccatggccccacggtggtagtggccgggctggggagattccttatgacacactgagggatccaagcttggttcacaattgagttagcttaacatacggctgcaagccaaaaatgcactgtcgctatcctgtaatcctctttagggttgaaagagtggtgaggggagaccctgtcaataagcagagccttgggcaacgcaactgctatggtccgagtgtttgtgtctccccagattcctatgtcgaaacctaatcaccaaggcggtgggattaggaggtgaggcctttgcaaggtgattgggtcataagtcagagccctcgggaatgggattagtgcccttataaagagagggcattaaccagtcacctctcatcctgtgaggccccagagagctgtcttgccccttctaccatgtgagggtatagctagaagacgtcatctacaaaccaaaaagtggtccctcatgagaccccaaatctgctagtgcattcatctttgacttctgagcctccagaactggaaggaataaatgtgtgttgtttataagccagccagtctacggtattgagtgacagcagcccaaacagatgaggcagcagctgacagtggactgtgtgtggaaaggaaagagtcctgagttaggaagagatacaagctcctaagcagtggcaaacgtcttggcagcctctttaagggcagggacagagaaaatctggaagactgaggacaggtaagacaaggagctctgcagagcaggcacgtggacagacccatgggaggggcaggacatgtccgcatgtttgcacagcatggcagagctcacaggagagcacttcaacaagcagatggagggatccggccagtggaccactgccagcctccgccactggccacagcagtcctgggccagggcactcccgtgtggaggaagcgtggtggtgaggtgaagccctgccaggccccccagctcgggcatccccccatctgccacaccgccaacattcaacctgccggcaacaaagagcggcacggagtcctgtgtgtcctccactcctcgaggagaccaactaactggccagtgggtgtcaggtggatcacagtgacaccagggaagatgaagacactccatcttgacaggaagtgactccttttctgggtgtgggtttgcctttcttggcaacagagcctcagccagcactagcatctgcaggctgccggcaccctgcatggcactgcattgtgtcccagtgggtgcatacccatgggaacactggtcctgtcacacatcctactgcccagaagctgttgacctgatgagacggatggaccaggcttgcacgatgccgctggagctgcactgtgatgtgggcgctatcctctaaggtgagatttacactctgaatcaacaactaccatggtgcagggtgtgtctccagcaggtagaacgcaatggttcaggaatcaaggggtggaagtagggacggccccacttctcactcccagtggtccacttggagtttatgctctccatctgtgcaacctggccttgcatatataggggccctggcttccagcaagagagtacttttgccagagaacacagcaagagttctggtcactttatgttgcattgccaagggattagcaggctagaaagggagttgccatcctggaaggggtaactgactctcaggagcaggcagggctgcagttatagaatggggtatttaaatgggaagaatgcatttggcacccaggtggttcactgtggcatctcttggtcctcccctgcccaatgttgatagcaaatcattcagtagtcatggctttagaatggcacccaggagcctggacccatcagggatgatgtctgtgtcaccccaccaggtaagccacctagaggtcttctctaagggcgaggggaatctagaatgagtaggagagaaggaagtcaatgggagtcagctgcaacttcaagaccagctgtggcagcatgagctacatatagtttaccctgctaaccttccatttgtacatttctccagtctctctcattccacaagcaaatgtctccaggcagtgcaaggggcagacgacagcagatgctgtgaggctggccagacccctcctccaggactgatatccctgctgctgggtatgtccgcagcagacagctctctgccaagtctctacccgggaagtgcccccagctgaagaaagctgcttcacccaaagcctttcttccttctgcgggaagcccacatcgaaaacctggtctatgcatagggatgtaaggcctgaccactctgtgtccatgcacaacaactcagaaggctcatccagctccagagctccttctaggacctgctgtggcaactgcacggcagttcagccttccttcaaactgcttcatgcgattccccacagcatcctccagtacacagtctgcactcgaatctcaagcagctcagggttttcttcctggaaaacatgtactattacaattccctactaagtgtttttcatattacagccagagatctttcgaaagcacccatctgatgacgtcaatctttaaaaaatctccagatgccttctcactgccctaaatcccaagctcctgcctgtggctgataaggcccttcatttcctggctccgtctccagcctagtctgtggccacagccaccatcactttatggcacagtcaagggagtgtcttccacctccctgaacgtgtcattcatgctcatctccagaactttacacaccctgtccctttgcttaggacacccataagttccttccctgcctgaagagctcatccctgtaggtctcaaatttcacttctttcaatgaacaattcctccaaccccgtggagaactggccaggtcccacttttatgcttccaaagcatcctgaacactctctcgtgcctcttagcatacaacattttaattatttgtcaaactgtttttctacttcactagattacaaaccctatgagaacagtggccaagtccaaagtccaagtctatcttttttttttttttttttttttggagacagagtcttgcactgttgcctgggctggagtgcagtggcaacctccacctcccagctttaagcgattttcctgcctcagcctcccaccaagtctatctttaatgttgtatccaaaatgcctagtactatgcgtggtaataaaaggtgctttataaatgtgtactgagcatccttcttcttccttctttccactaattataagaaattcacagttgaaatgaggttcaaaggcacataatgtaggaagtgtaacacaacgttgcagccaaaattccacttatagatgtgtttaagatttaaaaaaatgttaattctcaacatttaaaaataaagatatttaacaaaaacgcatggattttatgctactgacatcacaaaatcacactggaaggcctggtaccattgggctcacatttctgctgggtaaacatggacctgaactggggagctgtgtagcaggtgtctccccaacaccccacaacaagccatgcccactccagtttgccacagaccacccccacccgccccagcatggggctatgtgtcattatgcttgcaggcttttgtgttgatgtgtttttgttgttctgtttgttttaataggaaaagcagaagaaaatgaaatttatctttgcatccttatcaaaatattgacaggtccatgaagcaggcttcaactctgcctcactcatttaagggttgtgttgctgttggcatttgagttggccatccctggtattgtgtttgacaagccaacaacagcccactcatccccctctttcaaaaggcagagtgaccagtaagaacaatggaagcgcatttctgcttcactgggactggagtggtcatcagtgctggctggtgcagctcccaaagacctgggtaaaataatggtctggggcttgtcaactctatgcccctgggtggccactctccctccctctcccttgcctatggacaaaatctatcacaaaaacttgagataagcctcagaataagatggtgtacgtgaaagtgctttgtaatcaagcacgatacaagtgcatatcccaagcaaattattatatttatcccaagcaaatggtgggtttatttttctaatttaggaggcagatggaaggaactgaggtttactgtggaaatctaattttcttttatgattcaaaagattactgagacataatccagccctgaagctactgtctattcttttcctgtacttacccagcttcatggtagggagggaggtgtgtggatgaaggagggatttgtcattcattcaacaaacacttaatgagcacctactctgtgccaggcactgcaggatacaggatgcgacaggcacaaaccctccactaacaaagcccagactttttaggccgggcgcagtggctcatgcctgtaatcccagcacttcgggaggccaaggcgggtggatcacgaggtcaggagattgagaccatcctggctaacacagtgaaaccccgtctctaccaaaaatacaaaaaattagccgggtgcagtagcaggtgcctgtagtttcagctacttggaaggctggggcaggagaatggcgtgaacccgggaggcagagcttgcagtgagccaagatagcgccattgtagtccggcctgggtgaaagagcgagactccatctcaaaaaaaaaaaaaaaaaaaaaatcaaaacaaaaacaaacaaacaaacaaacaaaacaaagcccagactttttgtgaagatacagagaaacgatatttcaagtgacgaatgtatcagaatgtacagttgtctgaaagcttacaggatgtagtggggagggcagatggcttctgggaggaggtaacatgatctgggcctagaatgttgagcaggaggcatggttggtaggcaggcatgggcacattcccctcagacactgtagatctattagagagagcagttgctgatccccaactacttaggtaaagtatagccactgaaattgatctcttctgcggctttagagagcaccactaaaaatctggaagtctcagtctgcactcctgctgaatagggagaggaacatcaactacctagaaccagtttatgtggcttttgcaagagcaagtgtgtagttattagcaagcctccaggggcaatacgcggaaggaactggaacacggggaggagaacaagcagggaaaaacaaggaaagcaaacgggactggactctcgttagtctgtgatggattgatcttctgtcactgctttcccaaactcccagcagtttcaacgtaaagcttgttcaatattttaaaaccaatttaaagccaatttttgagtttgctttaaagaattattgcattaatcaaaaaatacattaagttttaggtccaacagtctaactgataggaaaagctgattgggactcaagagaaatgggctctcctggctggagcatgtaatgtgcaagaacagaaaccaatcaatgctaaagggaagaacagcagaaacgagtcacaaatggctcaaagcaaagaaccctgcaactgaatggaattgaaagaaagtgtgaagagggctgatgagggtatttagttattattagcaaaattcagatgtgagaacacatctaaagccttcggttccaagggaggctgcaattgggctttcattgtgagatgtgtagagtgtcatcctttcaaagatttcaggtcaatgaaactgcagaggtcatcctcctggagaccatgctgcttgagagaaatgtagggaacagaaaataagccagctctatgaaaataaaagcccttcattctgttatcaaatcgaattgggtcatgaaatttgaagaaatagcttgtttggttcgtgccttcccacatccaaaagcagctatggttgaaataaggaaacttgggaagattggtaaattcgctcatagagaaggtgctggtaattctgtattctttcccctctctgctttgcatctggaaggctggctcccatgggctgtgcccctaggatcccttgtgtctggcttcggtggggtatggcccatgggagacattagcaagagatcggatggcaggaggcaggaggcaagatgtccatgctcactcccttcctgtgtggggctacttccaggcaacgctggatgctccgtgatgacacctcctgtcatgaggccccttctccatggctgcagctcatggggttcatgggactcttcctccccctgcctttacaggcctggggtggtcatggctccccagtgatgctcgctctgaggccctcagccctgtgatggttcctgtgtccccagcccgcctctgcaggtcatccctttcattaacatctcctcctgtgcccatctgggttggcttctctctcccgagggaccctgaccgaatcagagacgtaggaaaacatggcagcaaagaccccaattagttgctttccgttgtctggcaactgttcaccagcagacatctttttagtttggctggttggtttgctttgttttcaaataagaggaattggaggctggccctgtgatcaggaaccagaagcaggaagagcctcatctcctgggggggtctaactgcagggctgcttcatcctgagttctttctgggatgaccctgatgtggattaactatacctcctcagaattcctatcatgtcagttgcttgtgcaacctctgtggcatctattgaagccgtagaaactccatgggagcagggacgttgtcttactctttgtcccgagggcctagaaccatgcctaacatattacgggtgtttaatgcatatttgttgaatgaatgaaataatgtctcatggggcgcagtggctcacgcctgtcatctcagtactttgggaggcttgcttgagctcaggagttcaagaccccagcctgggcaacatgctgaaaccctgtctctacaaaaaatacaaaaagtagcctggtgtggtggcatgtgcctgcagttccagttacttgggaggctgaggtggcagggttgcctgagccaaggataaggagtctgcagtgagccaagatcataccactgcaccccagcctgggcaacacagtgagaccctggttcaaaaaaaatgaaataatgtctctttctttatagatgctgccatcactcaacaaaccatctattaaatgtctgtgcagcagatgtcatcttgggcctggagacacaggggaacagaggacacagtctggttgaagaggttctggcttctgcaactttgcccatgtggcaccctctgctggaatgtcctttaccacaccatcctgctgtcctgaccaactctgacccatcttctgtgacttttccagggaaacctggaagtgttttatataaagctatagagttgctaagctttggtttagcatattactgtaattacgatattcattttccagtaaatctccccccatggctcccctatgagcctctaaagggaaatacacttttcttttctttttttgagggggtggggatggagtctcactctgtcaccaggctggagtgcagtggtgcgatctcagctcactgcaacctccacctcccgggttcaagcgattctcctgcctcagcctcctgaatagctgggattacaggtgcacgccaccacacccagctaatttttgtatttttagtagagacggggtttcaccatgttggccaggctgatctcaatctcttgacctcatgatccgcccacctcggcctcccaaagtgctgggattacaggcataagccacctcgcccggccgggaaatatacttttcaatgcatttttctagagagtctagcagctgcttgacccacccaaatgctcaacttaatgtctgctaattgacactatttgcagacacagttcccccgatgctggacatctatggtttaggtcatctctaactttctttttcctatttttctgaatccaatattaaggttttaacaatttaaaaacatttaatttgggctaccttaatctttaacaccaaggctggatggttcctcttgactgaagaatgaatgggattagagggagggtcaggcgcctggatggctttaggttaagcaatgctcttctttcccttacagctactgtttccaaataaatactgtagatgccagagtatcactttgtggaagcctctgccatgtttgcagtctcagagcatatggatgtaaattgctagactaactccgtttcccagagcctcaggtatacccgcctccattacagcggtcctgaggcaggggtctctgggccattattgcttttgctgtcagtacctggtaagctcgcgtttgaatgtccctgagctaaaataaaattaacagaaagagcatttgctgcctgggctatggaaatggcaactcagtcctaaatccactcatatgctcatggctggcaatttaggagcagacgagaagacccaaattcaccagttctatttatttagttatgctaatattggataaactcatctgcagaattccatatagggatacacttattcatgctctgattttagagcattcagatctttaacattctctattgtaaaatcaaaatattctgggatttctatgtctgtttactaggttcctatcagtacaatgactaaaggatttatttgcaaagatttggtgtttaaacccttgttaacatctacattgggagaaaaataatgagcaaattcatctactgtgatgacgtttttactctttttccctgaaggtttggttgatcctaattaataaataaaataaaatgcatttgcactttcctaagactgagatagcaccttagagagtgaggctcggccaacacattctttacttaatgaggactgaaacaccagttagcatagggcatgatgctgctaaaggacaatgatatccttacataatgtcatctttctgtacatgccactcacagaggtattttcaccagagattctaaactagggcattaaaaacattgaagtagacttagtatggatttctctgatttagacactgttaagttgttttatttcccctctaaggactcctttgaaaatgctcacatgccttgtccctgttccatatctgcccagggaaaagctattttggacatgccccaagtggccactgggaagtctacactgtgccccaaggaggggagtcattctgggagaagccacggccccattcccatggctgtcagctaccagtctgcttcttgcttttttagaatggaactctccatgacctccaggaaacggctccagtcccccactgtatccggagccctgcttggaggaatgagtagggcattctgtacctgagtagttgttcctgaggcttcaaatacggcactgcactccccttcatggtacgcttctttacattcccggcagaaggcaaactgcaaaagaacacacatccattaattagggacattaggttgcatttggcaataacacatttttccttttccaaattcattatattcattcctctggcttgtgcaacagtttctgtataaaaatactttttttgcaaagagaaatcaagttatgttttgatgggattgttcactctttactcaagagtgttccaagcaccatagcagggctacagagatgatgggtcacatttccttccctcaagatgtttccagtctagtggaagacacagtgatatggtttggctgtgtccccacccaaatctcatcttgaattgtagttcccataatccccatgtgtcatgggaaagacctggtgggaggtaattgaatcatggggatgatttctcccatgctattcttgtgatagtgagtgagttctcacgagatctgacggttttacaatgggcttcccccttcgctcagctctcattcttctccttcctgccaccatgtgaagaaggatgtgtttgcttccccttccaccatgattgtgaatttcctgaggcctactcagccctgcacaaatgtgaatcaattgaacctctttcctttataaattatccagtctcgggtatgtccttatagcagtgtgagaacagactaatacacacagtaatgcaaataaatacccacagcaaagtttaattggtattagaatgtaaggaaaaaacttcattcaagacattccctttaatatttgtttacattcaatatttgtttgcattcacagaagatttatatgcccatgtcagtggacttactttcgtattaaaagcctattatggaaaaagaaatgggtggctatgggctgaaccgtgcccccacataatggataggtggaagcaggacctcagaaagtaactgtatttggagacagggcctttaaagtggtaaagggaagatgaggttgttaggggaggccttcttcaatctgactggtgtccttacaagatgaggagattaggacagagacacacggactgagagatgatgagcagcattcaccatgggactgaagacgcccaaggaaccaatgccctctacccgccatcgtacaaagaagaaagctggaagagtgaatgccagagaggctcgtttagggctgtctgtctgggatccatggacctctcctgaaagcacgtcccattctcatcgccaccagccatgctctgaagttactgtcacggttgagttgtggatcagcagtggaacacaccagactggagtcatcatcccatcccctgccacctgaaacaccttgggaaagccaccttggtttctgtgccttggtttccaccttggaaatgctaggataacagcgatagctttctcatatgacccctgggagaggtagtgagatagcacatgctgagtggctacaatcacagcatacaatgtgttctaaactttaaggagataagaacaacagggactattttgcccctactccatttcataggaaggagtttcctcaccagaaaactggtttctttcaatggaactttctttaataagttgtaggcaacatctcccacagcagaaactgtattcagagaaggcatttcagcagaggagagagtgccatccacaagtatggtgtgtggatgatggtggtggtcttagagcatagaggcaaactgacagtatcctctttcccttgagaggtgggctttatgtctcttctgctgacagccagatgtgttgagtacttgactcctagaatatggtagaaatgatggtgtaccactttctaggcccaggcctcaagaaaccagaagcttccatttcctgttgggacacttgctcttgaagcccagctgccatatggtaaggaagctcaacagcccatgggagccccacatggagaagagctgcggcctcagccgcaacaatagccctgtctgagcttttagtagacagccagcaccaacttgccagctatgtgactgggtcatattccaagtagactgttgttatttgaaatcattaaagtttagggtggtttttacacagcaataaataactgatacagtaataaataagaatataatatgctgaaagtagtgtctggaagattcaaaaatttacagagacttacaagttctcaaactaatattttatagtataagttaggaatttagcctaattttgcttaagacaggactgatttgaattgaaaaacaaaaataatagaaaccaggatataaaaccaactctatcccaaaatataccataattcctccttgcctcaaaaaagaatggcttttactcaacactatttttccttcatgttgtcttcaccatgtgaacagagttttctcctttcctacgtccaatttcttgttttaaaagttcatctgaaaagtattttaatctcaggacatcagaaacaaaaaggaaaagcattttataaggaaacaatctcttcagagatatgccacaattgatcttcaagccatcacttttagcatattatattcttatttcttctcacagcagagagactgaactcaaatttagtgaaatgtaaactttatttaaaggttggtgggacagcgtgtgtgcatcagaacgtccttacacaaatcaccaacattacctggtttcagcttctgacatcttattttctctgaactaaaagcgaattcactgaatagtgagttgagttctaggattttctcctatttttaaaaacatttatctgttaatacttgggtctgcctcacactcattcctctgctcttacatgctttgttggaaaaatgtggacgggaggcccaatcatggagaactggcaatggggtctcagcccactgctttctagagaagcaaatcttatctgttggtgtgaaagggaaaaccgttcacatcttattagctcgtggatgagatataaaatcagtttcatggtagaggaacaccctggaggctgatcagtttgtcagaataaataggcttttcctgacacaaagacattaaattccctttcacaccagtactacaaagaatggactattgagaaataagagaaagggaagagcatatcaaatgaaagcctccccactttagcatggcaaaaggcaagcaaatgctgcaggaatattccggtgatgacttcacagggaggcactggctaatttgcttctattcaaagtataatttaaatttagatctatcatgcagtggtccttcccaattaagtaacatgaatctgtctcatgtgcaatgtagaaggtctgatttgatcttgaaaatgtttgggttttcaattacattatccaggactcaagactctcaaccttcagttctcacactacgcaccagagtgccctgcggtactgtaacaaactcacaggggtgcctgggatattctagaattttaagtaaaacacagcatggctattgaacactatgtgatttattaactcaaggtagttcccagtgttaatgtagattgtgctattttccttttggtgacattgtatctttgcaaaggtgggcttttggaagttaccagaatagaaaacaaataccatgtaaacatccatttggaacaaagatgtgatttatttatttatttatttattgagacagagtcttgctctgttgcccaggctggagtgcagtggcaccatctcggctcactgcaacctccgcctcccgggttcaagcaattctcccgtctcagcctcctgagtagctgggactacaggcgcctgccaccacgcccggctaatttttgtatttttagtaaagacgggatttcaccatgttggtcaggctggtcttgaactcctgacctcaggtgatccacccgcctcggcctcccaaagtgctgggattacaggcatgagccaccgtgcctggccaagacgtgattatttttaagaataaaataaagctaatttttccttccatttgtgtgaattatcatttcagataactattaagtcgttatgacattaattcttactatgctacgtggtacaaaacctttcataaccacaactgttaggcatttcttttggcctagaaataccgtgaaaaatgtactgaaccgctaagggcatggggaacagaattctggggaactctgggttaggcagatacaaaactccttcttaagacagtgttcgggccagtttgcaaacacttcccatggcatagctgtttctagagaaaaagcttgccggggaagaaagcagacctagctccaacattttcacatccattctgctgagctgcatgtctcatatctggggcgcctggatccttctttaaccaaccatgtagaaggctgaaatttacccagggatttgctattacttaaaaatggtcttacatttgctgaggctcccttaagctgcataatacctctccaaaccttatgagtcaacattaaccgaatggaagttagtataccaggaaacatggagtcctgtttataccgtatacattttcaggattgtcttctcttgtggtggatctaacaaatgtgatccatttccgtagagttgtttttttttttcgagaaattttaaatgtctttaaacaatcataaaataatacatacttatttcattggctctctaaagtctattcccttatagatttggttagaaggcaatcaaacacatggactgtattatagtccctgtgacgagagtttatgtattaacttggctaggctatggtcctcagttactcaagcagacactaatcttggtgtttctgtgaagctttcttgtagatgtgactaggatctataatcagtttattttaagtaagagagattatcctagataacctgaagggggctgattcaatctgtggaaaggcctaagagcataactgagccttccctgaggaagaagagatttcacctgtggacagcagcgtcaggctgtgctcaagagttccagcctgcccttcctgatggccactctgtggatttaggaggtgcctacccagccctgaaaccgtgtaagccacttccttccagtaaatctctccatatatctgtgtatacacagatatatagatacaatgtgtgcctgcatgtatatatatgtagggatatacacatatatatgcatatatgtgtgtatgtgtatgtatatttgatataagcatcctgctggtctggtctctctggtgaagctctggctgataaagctcctatagaaacaaattatttttaatagagacggggtttcaccgtcttggccaagctggtctcgaaccctgacctcgtgatccgcctgcctcggcctcccaaagtgctgggattacaggtgtgaaccaccaatacaaaaattagctggcatggtggcaggcacctgtaatcccagctacttgggaggctgaggcaggagaaccgtttgaaccctggaggcggaggttgcagtgagccaagattgtgccattgcactccagcctgggtgacagggtgagactctgtctccaaaaaaaaagaaaaagaaaaaatttaacaaggtcactttattcccaatcttttgcaaaagaactgatgtaatgaaaactatttaaactttccctgttatttgcaaaattatagttcaaacctctctctctctctctctctctctctcgctatatatatatacatatataaattccaggtagccatatggcaaattcctctcagaattcaacaccaggagaaagttcaccacttccaacagtgtggtggtttcctttcatttgacaataaacatggtcacctaatacattctccttggtatgttttcaagcttgagagcttggtgccacacttttaacttaattctagtcatcagcttatcctaaatgcctaaaaggaggtatagaataaaaaaaaaaagatttaatagaggctaaattcaataagccaatttttttctattgcataatagctaaactattcttaacattgaagtcatatttttgtcttgcaactaatatgtgttgagtatttacttttaggatgagtaaaatcttggccctaggcaacatataaaagaatagcacattttaatctgtgaaatcgtgtactagatctttacatgtttaaataccagatgtagattagtgtttagaagtgaaccctttgaggtagagagacccggagtctgaggcctcttggatcatttattatctgtgtgatcccaacatctctttgcttgagcttttttgcatctacaaagaagaaataataagataaagaatatttaacacagtttctggtacacagtaaacacaacaacacaacaaatagttttctccatggggctatgatgtttaacaagtggtaagagtctgtagaaaaataagagggtagtaagcgccttgttaattaaagcagttcccagtatactgataataatgactgttatgtgaatctcgggtaaaactgacacctccccagaaatgccacacttgtaaactactcataagacataagactgctgtctagaaagggatgaggcctctctttgctggtatacatgctgaggtaagtcactgtcagcccccttagacgctctgtactaccagagagctatgtgaatggcccatcatgcctctcattcaatatcatgtcagtgcagtagtcatttgattgatgtttgagtttgctttcccatatttccataatgaacacattcaaaaggggctgtatgtgtactttctctgtggaagcatgaaaaggaagcaaatgaacagcttctaatgcaatcggaatattccagtggctgctgatcaatcaggttgagagccagtaggtacctacaagcaatgacccttaaaataaggcttgatgatgatctctctatggaagccaagatttctttgtgcctgttttctatcatggctgcatctattataaaagcattctattatgtgcatttatttttcttccacggctctgaaattctgtgttaaaagaataggagagaatcaaataccatcttaggaccccttactagagtcaaggcaaacatcaaaggcatgaagcacacatttgtacttctttgggaatagatgaaatatttttctttttggtgtgtagctttccagaagatggcagcagagatacgtaagtccagcctctgtaaagggaatctatcaagagaggaagtctccctatgagtcaccagccgctgatatatgcaaaactcgttctgacaagacagtgccacagaacggagatggtgttagattataatgcattaaaacacaattttgaaaagaagaaagtaaggttatttcctttcaagtacacaacatcttaaaatcacagactctcatggtgtgaggcaatcttaaactgtgctaagctccaaatgcaaacagacgaagacagtgttctatgtgtggtctccaaagggctaaaaagaaagaattttcaggaggctggatacagctctgtagagtacccacgttcctttgtctttcacaaattctgtactaatccccagggatattaaacaatgccaattagtttcccacaaaatattgtgacctccaacaccctgcagccctaggcttatttttgttttaggtttgctctttgaacaggtccttactttctttggtttaatttccattcttgcaagctctgaaaagatccccgaaaatccccttttcttacaccaacatctatcatcatgcgcgtgcacgtaaccatcccatctttcagttgtgcagtctgcactgacccactcactatgagtaccgtctagtaggaaactttagtaccacctgtctcagaactagggcccctcagagaagatgagttcatgcaatgaggagaaaagacccactgagcttactttcaacaggctgacctcagcacctcacattaaaagatccatgataaggtggtcctcctgacaatggttctgctgggaattaactatccagtctataattacggacaaagacatttacatttacttcctactccaaaatagttttgatttttaccataacttaaagggaaaataaacttaaaaatgtgtattggccatttatttttttcttttctttaagagcgttactgaaatatcatttgcagagtcatggatttttaaaaagtaggtattctttgaatgcaaaatatgtgcaggtagcacagattcaaaaggtacattgtgaaaaatgtctcctttcctccttggtcagctacatagcttcccagagacaatcactgtcacctgtttgtataggtattgttccagaaatatgttctgcactcaatcatcaatttatgctatttttaaacaaaaataccctataaaacattgtataatgtgctgtactctgcttgttggtttttcgtttaatgcatgctacagatggctgtctattagcacacggagagctgctccattcttcctgaacagccacacaatattccagtggatagatgtgccttcgttcatttcaccagcccctccgatcagcatttaggtccttccaatattttgccatgacaaacaaagctgcagggaatgtcccgctcttcaggtcatttcacacatgtgaaaggaaatctgtagcagaaatttctagacatgaaatagctgggtccaagggcatatggactttccattttgattgctttcgcgagccttgtcagtcacaggcttagcagcaaggtgggtggaagctgcttccccaacacgctgtggtctcaaccaccgcctttgtcaagctgctttaaaagaatatcaaatacatcccagcacttttgctaagaccttctttatacatgttttgtcaccacagagttgtgttcctagccaaagcaattactctgaccacgtttaagtcttgtctacacagccaaagctgggtcaggagtggcctgtggtcaggctcactctgactttcctcagctcaacacacatggagctggtcgtctcattctgatgggcctgaatctggcccgcctgccaggaaaggacttgtaatgaatttaagctcagcggctttaaacacagacagccaacaaattagaggtccaggttagagagaaagaaacagtgaatgggggaacggcagcttccctcacttgtggctgtgtcgtgagcctcagctttgcagacttggctctcagtgacgcttgccaggtgacctgactgcagcagtctgccagaggacaggggaagctggggtgggagtgctgtatgctctcggtccctaatcccccgcctcttttcttactttctctttactgtaaccatttctgaaaacaattcctatggggacagtccttatcttccaaggtccccagctctggcatttgtgtcatggcttaccttgttcccaaaggctaaggtaggacctggttgcaagctggaactcttgttcaatgatatgttcacaccatcctgttcatctaaacaaacttcttggcgggcaaatttcaatatctaactgagaattccctttaccatcctgcaaggcctgcccaattttgctttaaaatgagcatttctcagaccttatggagcagttggctccttctagaactggagcactggtcacagagtatcaaattcaatgccactttcaaacatcgccattcattagtgggcccattcaaatattgccattaattagtgaacatgtttgaatatggccattcattagtaaaacgcacagcatatgtcttctataatttttaactggtccctaatcctcgtgaccttatcatttacaatctgcagcaaggcactagactctgtagaaatgattacgctacgccagtaaaaatgtgaaatccaagccatatggcaatttgagcccaatttgtcccatgtgcctgtgggtatccttatgctctctagcacagcaggggaggcgaaatgctttccctgaatacctgggcccgccctgggcaacttggggcaaggccagctttggaaagaggcctgaacatgtttggggacaccctgccagcacatcttacagacttttgtctttggaggttttgcagctcctcaatgatcaatcaatcaatcagtcaaaatgatacattaaccctttattgtatgttgagcagtctcataggtgccctgcaggtatacctgttctggcccctttcccctgcagcctcagccaaaatgatcaaggtgttttcttcccaagccctgtttcttactcatacctctattaaactgtttcaccctctatatgaaactgtctccacctatctcctcttctaaagggataggatttgtatcttattcatctttgtcttcccaagatccaggtgctagaacatagtaggtgatcagtgtctctttgtggcaatccaggtgctggagtcaagtagcttacagctaaggtggatgtttataaagcataaaagagctgaaggacaattgtgtactccatgatacaatgcacaatcatgggttgaattgagtattcttgtgtaagtcttaagggtcccatagaagagatccaggcgggttgaggtcagtgggtaagagcacgtggagatagcatttgtttttctgcccttcacatttgccccttcagggagcattctaacatcaagcttaattgactgcctctcttctaacaacttctcaaaatctattccacccttcccaactcctcttttaagatgcactttgcctattgcatatttccatttggataggttgcagtcacctcaaattcaagtcacttctaattccacgtgattatcatgaagttgcaaggacctaacagaataatggcaatcatcaaacctttgcagaataaacaagcagtagtagctggaaaagcctcaacttctgagaagcagaagaggatagcacagtgctgaggaaacccagtactgagaatggagaggtcaatcctgagtacaagaggaataactaagactttctgccagggaaagtactttagtgacctcggaggccataattttggtccaatggttcaatggtcagctagattcagaggctaagatcacaggcatgatggggtggaaaaggcttcacaacagagagctctgaatcagtttgaaaacagcaaaagatgatgaaaagagagagaatgaagacgctagccagagagggggcaggatgggagtgaagtcccagagaaagtcgaggctagggagacacactcaaaggtttatggctttcaatggaggaggataaggttttgcagcaaaatcctaggagagtcacattgatgagagagttttctcaaggagatgacacccatgcccttggtcttcctaacagagcaccatagcagctctgaatcttctggagtctagggggagaggagagtcacagatagagaggaggctgaaacagttactgtcagttggagcatccatgagacatgaattgaagggacgcccatccatgttgataactaaattcacatcacagcactggctctagttagttccctagaatgtggttcccagactagcaccatcagcatcacccaggagcatgtcagaaaacccgaatttcaggccccacccaagaagtactagaccagaatctttcattttaccaggatccccgagtgacttgtatgcaccatttagagaccctgttctagctcattcattcaaccaaaagttcctactcaggaactccactcagaatgtatgctgtgcattgctggagcctgcaaagatgcagaacgtatgtaatttccagtttcagaggagtcacaattcacctctcccttgctctacccaatgctccctccattccacaagtactcatcaagcatgtactgtgtgtgaatggtaaggcactggccattcttcatggcctcacagagttcacagtcagctgtgtcctgatcatatgatggatgtgaggttccatgggagcacagtgttgaacctgggaggtgcaggttgtagtgaggagatgaggaggttacagacaggagacagggaaatattgggtagaagagggcagttccccagcaaaggcctgaccctcaagcctggaaacccatggccctaaatgggaacaggcattcctgttttcacacccaaatgttgccttttggcctgtcatgcccccctatcctgtccctatataaactccaaaccccaggctccatgagcagaagagcagcagaggagagaagagaaggaatatctgaatgtcgagaggagttctgctgcagacagttagagaggagattggctgctggacggcccaactccaggggaagatcatctttctactccatcccctttccagctccccatccatccatcccactgagagccacatccaccactcaataaaaccctgcagtcaccatccttcaagtccatgggtgacctgatttttctggatgccagacaagaacttggaatatggaaagctgtcacactggccctctgcccttgcaaaaaggcagagggtccactgagctgtttaacacttaagctgtctgcagacagcaaaattaaaagagcgcactgtaacacacagctaactgggctttgggagtcacaggcacccatccctagacactactgtggggccagagcccagaagtgctcgtcctggctcctgcacctgctcatctgcatgctccccctcccataaggagtttgagcagtggtggtggctgaactgatgagccatatgcctgttgcatgtcctgcaaccggggtgggtcagggaactctcccgtttcagcagtaagaagaggaaggtgaactgggaccaatggagtttgctggaaatgatagcccccagaaagtaccaatcccagtgctagggatgatgccagcattctagtgtaattcactctgctagtgtaattctgcaacacttttgtctttttgattttgaaaccaccgtgaaaggatacagcctagaacagtgctgtccaattgaaacagcaataatttttaatggtctagtagctatatgaaaagaggaaaaagaaacaagtaaaattaatttcaatattttacttaactaaatatattcaaaattgtatcatttcaacatgcaatcgatataaaaattggtaatgagttattttatattcatttttactaagcttttggaatcgggtctgcttttactctttcaatgcatctcagttgggactagccctattctatgggctcaggagcctcacgtgggcaccatgttggacaggagcctcacagggctagtggccaccatgctggccaccacgctggactgcgcaggtctacaaggaccctgctgtctgaggactccttgcacgatgcagagttcagttaagggtccacagaacaaaagcgacagaacacctccaatattttagaagaaagtaggatgaggtgagctggggacatggggaagattagaaaattaaacctaatcttttttttttttttgagatggaatttcactcttgtcacccaggctggagtgcaatggcacgatctccgctcactgcaacctgtacctcccaggttcaagcaattctcctgcctcagcctcccaagtagctggaattacaggtgtgtgccaccacgcccagctaatttttgtatttttagtagagacggggtttcgctttcgccatattggccaggctggtctcaaacccctgacctcaggtaatccgttcccctcagcctcccaaagtgctgggattacaggcatgagccaccacgctcggccgaaaattaaacgtattctaagacaaagaaattcagattttttttttttcgaataaaggatgctgtgtttattttcagcctttggacgacccatatgagtttcacttcacactgtgttgaagaaaagagctgcaggggacagaaaatcagtcaaattaaagaaaatatgaggcgtaactgccctgcagtgagagcatatgaatttttctgccacacactctgagtcatttgttaaagaaagccagagaataagaactgtcctgggttatcgctaactttcactgtgtctgatttacttgtttgcacactttgtcaaatcttggaccagggacagatagcgtccaggccattactcaaggggaagactgttgatcagagtacactgcaaacaaacatctgtttctgatggctgcagcaccatccttcattatagaatgagcttaataaacacgaagtcatagaaatccaccattcacgtaagttttggcctggtgttattgcagtctcttaatttagccaacaaagaaggttggctcaaagacacctgtttttgcatgtaaagtatcaggctggaaggcttggtcgggcatggttttagcaacaggactttcatttgtgatagttcagtcacgtcctggggaattgaggagaagatccaccctaccaaaggccagtcttgctttagcaccaaagaattaattttaaaagttagagttggccgggcatggtggctcacatctgtaatcccagcactttgggaagccaaggtgggcagatcacctgaggttaggagtttgagaccagcctggccaacatggtgaaaccgcatctctactaaaaatacaaaaacgttagctgggcgtggtggtggacgcctgtaatcccagctactcaggaggctgaggcaggagaattgcttgaacccaggaggcggaggctgcagtgagccgagattgtgccactgcactccatcttgggcgacaagagcaagattctgtccccactccccaccaaaaaaaaaaaattagagtactgatctggatttcacccttgaagttaagcacacactaatgacagaagctgaaataaatcccccaaatgtcttgaacactttctaggcttgtgtctctccatgagattctcagacagctgcatttggatttccgggggctggactggatctcagatgtttctggcccagaacctctgccctaaatgattattcatgaatgttctggctcaaaggaggagagagaagatgagagatccagaggtctgagatgtttgttcacacaccaatctctggagcggaagccgttaatgcttctacttatattcttaaggcctcttaaagaaggttcccagcttggggctgggtaataatggtgagagcatttcccacattatcctctcgatatgcatctctgccatgactatcagacaatggtgagagccagaaccacttagagagctgattgtcatcaccgccctgacagtctcagtggcaggccaggctctaaaggctcctctggatgcctgttggccaaagataactcatgcctcgggggtcgtgagcaggaggtgaagccaaatgccttcagtgacctgaaaaatgctatctcccagcaacatgcacaccttgcagtgtcttatgaaattataaaataaaacccagacttataagactcttcccctgcctaagttttctttttctctctcaattttattgctttgctaaggacatagaaagcaaactaattaaatgacagctaaagagcaagtgactgtgtcccagggcggctgagataatgcgcggatctcaggtgagtcgaggaaatgccacagacattgctgcctctctactaataaatagctttttggtcccataacatgagagacattctggaagctgtgggggagcaaaagatggcttccctctaccctcccaggttctttggctgggctattgattaaaatggcatataaacagattaacaggagaaagagcatattcaattctgtacacatgagagtcccacagaatatgagactccaagaagggttagatcatggaagcctacagaactatatcctagatacagaaaagaacaggggcttggggattcttgtgagggggaggaggttagaggagggcaaggagaggaattgtatggtgaataaaggttgtcttattatgtagataaacaatctctcaggtaataaaagttgtctccgagcagccctgagcagaacaggcagtagtctctccaggcatggtgtccacgtactcatcttccccggctgacacaattccctgggaggggattcacgacaactgagatccatcaattgtatttgcagagaagctagttcagagaaaggccctccccgaatttgctgttccccaagtgtcctctgttaaggagtcagcacaccaaagcatcatattttgaggtggcatttcctgaactcctgcaaagctgaataacaatggagagtgaagcatcaactgttctcagtgctgggcgcccttcctccctctcgatttagtggcacagactgttagaactgcagggccctcagagagctgatcatctgtagggtagaatactgcccctttttcttctggctctcttaataatattgggacctaatattctatatttttaaaaattgcctaacgacatagatcatggcaaacactaaaaaagcacaaaaaagccagattgttttgataataacaatgatctaactccttattctttgaaatcccatctctgtgatgagaaccaaattttcaaaaggctaatagctcataaagggccctttactgttgtcctgtggagaaacggaaaaacgctcatggggtcggttattgttccaaatcaaatcattcctttatctcacaagcatttgttgagaggatgcttctctctggcagtgcagggcctcagggcaggagcacgtaatgactctgccccatctctgtgagaatcactctctggagagccacgcttttatcctctgctcctcagcctatcttctccctagccctcctttgcctagatgacttggaatagggattgctatggtttgaatgcttggcctctctggaactcatgctgagattttattcacgtgaagtctttcagaggttattaggtcattagggctccaccctcatgaatgcattaatgctgtgaggtgggagtgggttactgtgggaggagctttgttaaaaacctttctctctctttcacacatgcctttgcccttctgcctatctgctgtgggatgatcctggccagatgccagcatcatgctcttggacttcccagcctccagaatcaagagccaaataaacttttctttataaattacccagtctgtggtattccatgtagcaacagagatcattctagggagtactctgattccccattaggaaatccctttgggcaaacctccctgaccccaggcctgggtttgctgtttctcctgtgtgttctcaccactctgtactgacctgatcctaaatccctccaccctgcactgggtatttccttatccatcatccctactagactcaagttcccagctctctcaccccatgtgttctgagagctgctatctaagtacttggccctgagtaggagcttaataaaggtttattctaggaagaaaagaaagaagaacacaggcacctagacagaaaattgtgtggcaacgcatagacgggatgacagaggttagagcagtcacagaggaggagatgattgctctccctggacagtctgtccaaattccacagccccagtgacactttgtgtcttgaagggtaaacaagattcatcaagacgcaaacaagacaactctataaattgagctaatatcatcagtgtccatgagccactgaacgcagtttcttgtctcagtgaccccaatggcatctgcaaaatttagttaagattcaaaattaagagaacaaaaatgtgtcagggtgtctctaagtttacattatctgtaagaattcatttctatggctctgtgttcagaaagacttttctgcaggaaaatttatcatggtgtatatcactccctgcacaatgacgcaagtcaaaatcaagcattttccatgggaaggctctgtttctaaggattgaaatgcttattcagataagtcactgaaatggcacagatggccacacctgcccctttattgctacagagaacctgacatcctctttcaagtcggtagcaacatacttctaaaaacagaatgcgaagccgtaaatactgcaatggaatggagttccagcagaaaagtatatgtttctgtaaagtcataaaaagggggactaattcttctcttactgggatggtctgatatacgtttaatgttttatattttcattgaaggcaggaagatagactaaatgataacattgcttcccaccttctcctccagctctgactctttaaactgaatgctgatttatctctccaaatatctcacaggcctttactttattatgggccaggaacaaatggcagtgggtgaaataggcttggtcacacagtgacaagatttacaatgggatttgggggaaaagtcattagtcgtcatttgccatcctgtgttcatgcccctctttttcaaaattgctgtttaaaagtgggtctgactgggcatggtggctcatgcctgtaatctcagcactttgggaggctgaggcaggtggatcaattgaggtcaggagttcgagaccagcctggccaacatggtgaaaccccgtctctaccgaaaatgcacaaattagccaggcatggtggcacacatctgtaatcccagctacttgggaggctggggcaggagaattgcttgaacccaagatgtgcaggttgtagtgacccaagatcgtgccattgcaccccactccagcctgggtgacaaagcaagaccctgtctaaaaaataaaataaaataaaaattaaaaataaataaataaataaataaataaataaataaataaataaatttgggtccaccataatcagcattttgggccagcttccaggagaaagggaagggaaactgagggtccatgagtgctcacagccaggcaggctcgtgttccaagtctcgtacccgttgggccatttgagaagtggcaacaggggatcagcagaagggttaactgccaagtctatgcctgttcctaccaatttggcagtccaaatagatttttcttttaaagtagacttttgctcccactaatttggaaaatgatgcttttctttgctgaagaggaatgtcaagttaatttcaaggatctaaaataaacatatatctgacactggctcagcatgggagtaaacccacctccttaagagcactgggaaagaacctgataagggaagctggggattggtctgtggatggaaatgaccctcacaatctcctggctttatgttttgttcctttatacatacgtatatatatacacatatatacacacacatatatatacatatatacacacatatatatacacatatatatacatacatatatacacacatatatacatatacacatatatacatatatatatatacacacacttgatttgaggtgttggtttacagtaaaatcttcccacttagcatctacttttctcaatttttttcaaagtcatgaagtttagtttgatgttatctaaaagggtgctgatccactatgggcacattttagctatttttctcaaatccaccaaaaacgtaaggtggttgctttcaagttcttcttttagggcgagatgtctgctcagtatatagaaactttttaaatgcttcaatcactgtaacttgataggaacttcctattttgtttctttgaatggtaccctaagttctgctttataatatcagtaaccacaggattttgagtgcaatgctctatatagcacaacaaagtggcttcttagtattagcccgaaggaaatatgttttgggttaatggcaatacagtgactttcaacaaaaactcctttggccccagtcatttccattctctgcaggcaaaatggatccttctctctttgtgttcagtgatgagcaagcatttcaaatgtacatacaacttgtttctgtcaatcagtgattcacgccgagtcatgttcaatcatgttaccacaatctggaatttgcaaatctgtaagcatttctcaggcaatgaattatgtcaacacaattgcaccatcattgatggacttggaaatgcagacagaactgaagaggagcgtctcggcactgctgctacgggtaaggacagagcttcttgctgacttggaaacatcatgagcttaggccagccaaggtttaggctcgttggatatttttaacaaaatgggacttcagagaaatttaattaagatttatttcaaattaagatcaccaaattatatttacataaaagcctctataatgagtatgctatatttgtcattaaaatgtctttatatttttataaatatggtttcacaattttttacagagtcataatctacatggaaaacaaaaagtcataccaaaattataactgctaagagagatgttaatggtaattaatcatgagtgagtcataaatatagaaacgcactgacttgataaataagaaacaatattgcttctcatttggcaaagctgaaaagggaggggctggggaagggggcagctgcactcggtgggaggctctgcacactggcacaattgtttgctgggaggtaatttaacaggactgaaatgcctccattctaagatgacattaatggtaaaaagcaccttcaatttaatagtggcttgaccaaagaaagaaaagctccatcatactaccattgtaaacatccacatcaatttacaatatcctgatttcagaaatgttaaaatacacaaaaaggtacttcttagagttgaggataagtgttggatgcaaagctgtcaggcctctgagtcgaagctcagccattataacccctgtgacctgcacatatacgtccagatggcctgcaggagccaagaagtctgaagcagccaaagaaaaaccacaaaagaagtgaaacagccagctcctgccataactgattgaccaaccttatgacattccaccattatgacttgttctggccctgccccaactgatcagttgaccttgtgacattcttctttcggacaatgagtcttatgatctccccaccatgcaccttgtaatcccctcctctgctaacaatagataacctcctttaactgtaactttccactgcctacccaagtcctataaagctgcccctctcctatctcccttcgctgactctctttttggactcagcccacttgcacccaagtgaataaacagctttattgctcacacagagcctgtttggtggtctcttcacatggacaggcttgacaaaagctttaaaaacatgcacatgctttgactctctaacttcctcttctaggaatttttctttttagagaaaagtcaggaacacaggaaaaattcggccgtgggaaaattatcatcattccgcaagatacacatttacataagtcatggcacaccctgacaaatggtcatcattaaacatggcgttagagaaatgcaaagatgtttgtgacacacaattaagggtgaaaaactggtaaaaaaaaaaaaaaaaaaagcccatcagcataaactcgtctctgttaaaattgcggacatgtgggtttgcgtatacatgtaaaacgtatctagaaagctctacagcaatgagtcaaaaatcccatgtccagccacgtgggattatgtttgttttctaggttttccttttttttttttttttggtacaatttactgacattgtctaatgagtatgtattacttttgtaataataaaaactctttcatttttccacttaacaatattgagggctgatgagcctgtgccatgggtcagggggtcggcgaggctgataccgggagtggacatgtgtggaatgcaagtaggatctgcaggaagaaaacagttgtgggaatgctgttggtggcaagatctgctgtgtatgttttgtccccatacaatgtcactagaaaccattcatgggcattaaaaaagaatccacaatgacatctcttttcattatttcattaaaataaaacattaggaaatagccaatgaaatcttatctaaaatgaggtggactttgcccatttatatgctatccccccaagtaattcacaagcatgcagcaagacttgcagatgctgtattaaggaggccacattttaattttaatttttattttttgagacagagtctcgctctgttgcccaggctggagtgcagtggtgcaatctcagctcactgcaacctctgcctcctgggttcaagcgattctcctgcctcagcctcccaagtaactaggactacaggctcccatcaccatgcccagctaatttttgtacttttagtagagatggggtttcaccatattggccaggctggtctcgaactcctgaccttgtgatccacccgcactggactcccaaactgctgggattacaggtgtgagccaccacccccggccaggagaacacatttttaaactctgtggtaatggttgagaatactcttcattactacaagcattttggacagaaaatctctgagacgatgacagcattgtgtgttctctaaagcgccaggttataacggccatatgtctccctgagtaggattttccagaagaaattaccaaatggcacacaaaaacgcagtgtgctgacactaatacataaaatgcggaaggacccagtctttccagagtgcccctttctcaggacatagacaagtagctttcctactgacagcacctctcagttcaaaggaaagtggtgtgcttgctggatatttttagattgccagaatgttcagtggaatcacataaggccgtcactataaaaatgaaagcaagcccaaccttggtgtgatgttttgcaataaacagcaatccatggaataagaatttaagacccaatttgaggtcacgtgctgcaaacccagtgttctttcagagtcaggtcgctgttagatgacaaccccttcagcaccggcctgaagaaagcgcaggcccagtggcagtctgccttctgttaattcccaaggttctcagcattcctcagatcaatagaactgtgatgtatctatataaatctgagtagcagatccattctcataaagtttaccctgtcttgcttttcaggtgagaagcagaattggaaaatatttcagggagtatttgaaacaggaagattaaattctgtctcatgtgtatcatgaataaaagtgctaagccaggcacagtgacctttcctgtacctgtgctaggatgcaaaagatcataggtgtaggctctgggcagcccgtgcatctgctgggtcagcggtctggcactttttttgagtgtctgctgcccttgaagaaggggatggggaaggattgcataagttgtggcagggggcctggggcaggtgggtggccaggaatctgaaggagagtgaacatgagtgagagtacgagcatgtctcagctggtagcccttgtcccagagctggtggcctgctgtgtcctcctccagtgtatctgggagtggtggttgatgtgagcgccatgctgagccccgctcatacccactgggcccagctctttttcagtcctttcctggcctgggggaagcacgtacaatccctgagctatgaacagtggcaccagcttttaagtaaggatgagggcttcccaaccaactgtaagggggctgctggtttgagcttttcaggtttcacagcaagctcttggtcccctaaggccctgctcctggcagatactctaaggagcccgggtctgagctggacacacacagcagcgagaggggaagggcgagctatttcctccattctggtgctcatcgtgggccatgcgttggttacaaggaagcagatggagttggggaaacatggaatggaggatggggaggatgcagggaagagaatcggggtcactgtgagggaggggcaacagtgccatgggaaatgcatcattggtgctcatgacaacggcacgccaaggggcttgatggcagcagcctcaggtatgggcagaacgttgaatcctcagaatgatatgggattccttaaaaccaagcaaagcaactcatcacctacccataagaataacagaaagggccactcgatggtttgatcatgtttacaaaatctggctaaacaggaagtttcatcctgaaaccggtttcctcaggtggaaggaaggcagttgactcatcctgcttccctgtagtagattttatttttcagataaaaaacctaatattatcagcggtgatataaaccagtgcagggcctctgggatgctggcaaactctagtttcactgtgaggcaggatttagggcctctgtttttactcatgagaccctggaggctctaggtcagtgacatggcttggctgtgtccccacccaaatctcacattgaattatagtaatccccacacgtcaagagtggggccaagtggagataatcgaatcatgggggtggctttccccatactgtccttgtggtagtgaataagtctcacaagatctgatggttttataaaggggaggtcccctgcatatgctctcttgcctgccgccatgtaagacatgcctttgctccctcattggccttccgccatgattgtgaggcctccccagccatgtggaattgtgagtcagttaaacctctctccttgataagttactcagtctcaggtatgtatttattagcagtgtgagaacagactaatacagtcagagagtctgggggccatggcgacagggatgcctaagagaccaacacagtgtctgtctgcgaactcactcattcccttctcactcactcctccactcattcattccttccttactcattcctccattcactcattgcttccttgctcattcccccacttatgcattcttccactcattccttcctcactcattccttcctcactcattcctccactcagtcattcctccattcactcattccttcactcactcattccttcactcactcattcctccctcactcattcctccactcattcattcctccactcactcattcctccctcattccttcctcacccattccttcttcattcattccttcctcattcattcctccactcactcattcctccactcactcactcctccctcactcattcctccactcattcattccttcctcacccattccttcctcattcattccttcctcactcattcctccactcattcattcactcattcattcctccactcactcattccttcctcattcattcctccattcactcattccttcctcactcattcctccactcactcattcctccactcactcattccttcactcactcattccttcctcactattcttccactcactcattccttcctcactcattcctccactcactctttccttcctcactcattccttccttcctcactcattcctccactcactcattcctcctctcacttattccttcactcactcattcctccactcattcctctgctcactcattcgtccactcactcattccttcactcactcattcctttgtcacttattcctccactcactcattcctccactcactcactcctttctcacgcattcctccactcactcattccttcctcactcattcctccactcactcactcctttctcacgcattcctccactcactcattccttcctcactcattcctccactcactcattccttcctcactcgttcctccactcactcattccttcctcactcattcctccgctcattcattcctccgctcactcagtcctttctaacttattcctccactcactcattcctcggctcactcattcctccactcactcattccttcctcactcattcctccgctcactcattcctttactaactcattccttcctcactcattcctccattctataattccttcactcactcattccttcctcactcattccttcactcactcattccttcctcactcattccttcactcactcattccttcactcactccttcctcactcattcctccactcactcattctttcctcactcattcctccactcactcattccttcactcactcattccttcctcactcattcagtcagcaagagcttattaagcagcagctatgcacgtgtccctgtggcctgtgctggagaaggaacagtaatcagagacaggctctgtctgctcttgcctgccttcctgactgctggactagaatctcgcagggattgagctttattctggcagcaaattcagctcctttggaaattatattaccttttctgaacacctaaataacaccaggaggtcaagtacgtggaagtctgaggggcggaggaatgtgcatttagggtcgtgggaccccttcccatttatttgtggaaacccactgtctcccggacactggcctccagggcacggtctggagggtctgtaagactccccgtgacattcctgttccttgttccactgccagggtcctgtcctccctccgctttcccttcacttcctgagtctctttccattagaagaagaattcatatacacatactgcagcaaagggaatgacagctgcagcaggtcgccagtgcatcaacacagagtaaccgaatacatcagagaggacatagggatctggccagctgggaatggaagccaagtgggcatgctgcagtgagaactgggggagaaggccggaacctggcgggctcatgtgggcacgctggccatggtgggatggcagcgtgggccaggaaagcctgggaactgggggtgttggcatgagatgaagctcacagaggcatgggctgcaccgggtcccagggacacctgagcacgtctcagggcgccttctgttcacagcttcccacaggagtccagctgagaaggaagccacatggccattcctgagaacaaggataatgccacacaaatgagatgttccagctccctagctctgaggaagctcattcaaaaatgcaatttttaattaaaagggaaacttcctgagaggacagggagcatttacagcatgaagtcaggcagggtgagcctcacccagctgctgttcctttctctttcctgccttctgaagaggagactgtggaaagggaagcgaggcagaggtggcagaaagagatgataactccaggaaggaaggggtgcctgagagaagcagccaggcagagcggtgggacgtgaaactcctcgacagcactgtgtcctgggccgaggtggggagggtcagtgagggcagggtactggtgtcattttaattcagacttctctctttctttgctgcaaatggctctctggagcacaaactctcaacaaggtggaaactcgacactatgctctcaatctccatgcacaattttgcagaagaggctctttccagcattttctccccagatgtcagagccgtgcacccttctccggaaggctggagggtgttcagcgttgtttgtcacaggcagcggccagtctctgtgttctcgggcgctctgtgtcaggtcctggtatttattcccagattctgtttagatgcacccgaggccccaggcaaaggtttctgcctgagacagtccttggcctccagccacggcttccgtgccatgtcccaaatgcaaagtgccactctcaaatgttctctgatctcctgttcgaagcaaataacagagtgctaaaatcttatttagaggagtcgtggtagaattatttattcacttctagccttttggctgagactgttttgaaaaatagaaaatggcaggtaattcaggtgtcacccttcaatggcatgtgttcttcttgatgtttcacagctactgcacatctgatgaagaggattttttttaactgagtaaggtcatcttttcctgatgaagccccaaagtgcaaaaggcatgaaaggcacattatgcttctccaccagaggagggtctccgcaggcagggcagccgctgaacagcaccgggagggtctgtagttgccagactctattattgtgggctataaattaagaggcttccgtttcaaatacaaactctctcatcagtcacaggaaattaaatgccttttgaaagggagctaggcataggaggaattcactttcttccacctacacactgttggcagctcctcagagggaaggacggagcctgccattctgcggagcgtcacctggttcttacccacgacttcaccgtgagtgtggagtccacaggactccagagctctgtggcctgactgcagggcagtctgctcccaaagagacttggggagaacatggctaactcaacagaatacagaataacaccggagaggggcaccaagagagtggtgatcacataattgagacctagtcagacccagtaacaacttaccgtgtccgcgaggaaccattcatgcagagaggcctccccattttctgccttaaactcattttatatacgtggggaattgagactccaagattacgaacattttcaagatcctctggctagtaggtgatttagcttagagtcaaatctagatttgaacaactccataatcatcataataaacaataacgacactacctacatgaactgagcaatggctaagtagtaagcatgtgccgaaccctttacgtgagtcaacttagttgatcctcagataatcctgcggcagagtgattgttccagccacagatgaggaaacgcagagccttccaggtgttataactcttttctcacgcctctcttacaatcctcaggaaatgtcgcccccccccccccccgaccccccgccagcccccgaccgcccggaactaagccacagccacctcctgccctggttgctgcaatagtctaatctctcctggagtctgcccggcccctcctgagcttcgtcccagacagcagtcagagcaggacttcagatgttgtcagttctgctctcactccccgccactgcccatttcactgggaatgagagccaggggtcctcaccaggcctccccactgcgtccctctctccccacagtgtctcctggagctgcattgctctctggatgtgccagaacatgccgtgggctttcatcctgcgtcactcgactgggaatgccctgggatcctgcaggtgcccacccagctggctccctccgggtcccgtctttactcaaatcgcaccttctcgatgaagtttactctgaagttcaacctgctcttcccatcctcccaccccaggcgcagcagatccgccttaactggactcccccgctttgcttccacggcgcctatggaaatgctctgacacagaggtcagcgaaccactttacaatcacattttactgggacacagccacaccttttggttcgtgtattgtctgtggccactttcacagaatgaccagtggccctcagagctaacagacgcactgcctggccctttactgaaaagtgcggccacctctgctctaacataactggagagcttgatgacggattgggcttgtttttctcggtctgttttcccccgaggagagcgcacacactggggggcaggaactttgtttcttttgagcactgacgcctcccagtgcctagaacaggacctggctcgtagatgatgccagttcatatttgttgaataaatgtgtgaatgaggcatatatttgctaaacaactcacccaaagtcactccagtgataggcccatcagctctcggcatccaaattcaaacccaggcagaccaacagagagtaatagcaacagagacccgttcttaccagtgacccccgaccagcctcatccgctgctgcctcgcaggagacagtgtcctatatttgctcataaaaaccaggcagggaaaaaggcaagctaccagcttttaatcttattaatatgggccagaaaggatggttcatggttctgaccataagacaaagtgcttcaaggcaaggcttgtatcaaccgtgctacggagttgatacacaccgaactgtcacccgtcctcctgcccaggggccttggcgttttgaagactcccccatctagacgtccagcagatgctgagcacccaggagagaggtcagaatgcaggatttgcattgaaagccacgtctattggggaagcagctaaagctctggaatgaggtaccagaaagaagaaaggaagatggaggaaagaactctggagggagatggggccgaggaaggagtaggaggtgtggctatgctagctcatgctcacccctcattcaagctccagacctgggccaagagcaagaagagagcttgcttgtgggtccagagtttctgatggcagcgggtttttgatggcctgtaaagtcatctaacgggcttggcgcagtggctcacgcctgtaatcccagcactttgggaggccgaggctgccaaatcacgaggtcaagagatcaagaccattctggtcaacatggtgaaaccctgtctctactaaaaatacaaaaattagccgggtgtggtggcgcctgcctgtagtcgcagctactcgggaggctaaggcagcagaatcacttgaacctgggaggcggaggttgcagtgagcagagatggcgtcactgcactccagcctggcaacagagccagacgccgtttcaaaaaaaaaaaaaaaaagtcatctaatgcctccaagaccacacgctattgatttaatctctgaattaaaggtctctgaattaaagtgtataaatgtaccttctcccataactctgagaatggggtttgtgtcttagaaaagaaaaaactcacggggctgggggttacatctattgtttcctgtaattgtcacagcagtactcaatacacacattttcacaggcaaggaaactcaggttaaataactttcacaacacattggaaatttaggctgccaattagtcatccctccggcccccctgggttttaacctctagacctagagaaccaaattagatgaaaataccagcttttgtaaatcaacagtgtctaataatcccccaaggacagggccctaggcaaagctgagctgggggaatgtagacagacctcctactttccactccaaacctagacgcagactcagtggcccacccaggggcatgagtaatgctgggagctgcaggctggcttcccacgctccctcctgggcctggcccccaggcctggctgactccatggggggcctggcagtatcacagcgcagggctctcaggctgccagcagagcagctgttgtgttttcagctgcttattctcactaaaacttctgataaggccatctggaaaagtattactgtatattaataaaaatatttaaataaagttacagaatggagagatttactttggaagtattaatatgtaatgagttagacagataacgtgtttgaagcagcctctgccaatctgtttactccacggagagaagaagaacaggtgtgtcaagccaaacatctttccttggcacttgaactgccttacttggagcagctctgacaagcttatttttgtggtggtggttgggggaacccagcatttttagagaagaaaagagcaatcttcactccagaaagtgaatctgtctatattcatgtatcggccttgacgtggtttgatttttctttttaactccagtgttggttctttgctctttgaaatcaaaacattctgtattatttctgggattatacccagcaaagtgagaacaggagcttcttttagtaaataaacgtgatcatcttccgccagtaggtgtcactgttcatttagcacaaaccatacccgaaaggcaaggcaattacctcggctaaaataacaagcatgttttctggaaataaaataaccagtaagtactgggaaaaagattattttctttcacaggtgtctccaaatcaaagctgaagtgtgaacaacaattcactctttctatggcctcccacatagtatttgcttctagagctttagcaccattgtaagaattccttctaaaccatgtttgtacctcagatctaactgcctgaccctataaacattttgcggttgactttgcttataaaatgcattggcattttcacatacaggcggtggagttttctagcgttccagcctaaatcagaaaacaatgtctggtgttgcctacacagaaacaatcgtatatcatagaaaattagaagtgaggcagtaaagcgagtctctgaaaatacgttggatgtaaacacatcgtttacatgaaggacatggaattataagttcacacagtgacacacaaatatgtaaggtcattagtgttcactaaatgcgtagctatgcaatgaaaatggtgagaatcctttacgagctaacgtgctacacagagtttgatgcttcttgtgcgtgatctcacctgttcccccacttatgtgaccattttacaatgaagaaatggatgtttaaagaggacagtgaggtccctgcgccacagtggtagaaagtgaccaactagcagtcaaccaggagatttttggccctagaacctgaggtcctaaccacaacacagagggcctttccttttttcttttttcttcttctttttttttttaaatggagtctcgctctgttgcccaggctggagtgcagtggtgccatcttggctcactgcaacctccacctcctgggttcaagcaattcccctgcctcagcctcctgagtagctgggattacaggtacacgccactgcgcctggctaatttttgtatttttttaaaaaacggggtttcaccatgttgaccaggctggtctcaaactcctgacctcaagtgatctgcccacctctgcctcccaaagtgctgggattacaggcatgaaccaccacgcccagcctcctctgacttttgtaagggaaataattagattctgcttgtgttgaataattctagccaggccggagttcagttctagtcctcctacttccgactgatagtggctctgagtagttcacttaccatctctgaatttccatttatttcactgtgaaagggggaaattggtacctacttgtgggattgctgtagagattcaaataccgtgtttaagaaagttcctagcactgcgcctggcacgtaaaaggcacttgtttaagaacttgataaggctgggcgtggtggctcacgcctgtaatcccagcactttgggaggctgaggagggcggatcacgaggtcaagagatcaagaccatcctggctaacacggtgaaaccccgtctctactaaaaatacaaaaaattagctgggtgtggtagcacgtgcctgtagtcccagctacttgagaggctgagacaggagaattgcttgaacccaggagacagaggttgcagtgagccgagatcatgcgccgctgcactccagccagagcgacagagcgagactatgtctcaaaaaaaaaaaaaaaaagaacttgataaagtaaaaaaccctgatttttgaaataaattaagagtaatgaatatgcaataaagcattcttttctgaaatgcgttatgagaggtcaggagttagtcttaagcagttttcaaaggtgcaagggctggagtggcctcagtttatctggataaaatgactatatatgaacagagatgccaactgttggtgccaggcatggctcatgggcttttggcatgatgaacagtttcctttattttcttttttttctttctttatttatttttgagacaggattctgctctgtcacccaggcgggagtgcaatggtacaataacatctcactgcagcctccactttctgggctcggtgatcctcccacctcagcgtcctgagctgggaccacaggcacgcgccaccatgcctggctaatttttgtattatttgtagagagagggtctccctatgttgcccagtctggtttcaaacttctgggctccagtgatttcccccccacatcagcctcagttttctttactttttaaaaattaagatcctgattttacaaatgaagaaagctcaaagatgaagttacatgtccaaggtcacatagctgaagagagaatttgccgggctgctggatcttgttttttccatttgccgtactaaatcatgtgctacaatatttgtggttttcctcaactccacagagcttgcttctctgaaattcctattccttgctaacccctaattttgtatgtgaaccattggagacagggagcacaaaaggacagcaagagagaaagcaataaactaagtagagaaaggaaggatcctcctggtccttatgcctttgagtgatgatgtaagaaaatcatgtgaagttcacctgggtgagcctttaccctccaggcactcgagggcccataccccacaccaggagagttgaggcattcctcatcttgattttgaattgatgcttgagtgggggtacttaagtattaattgaaacgtgctgaattcccaacataaatggaaattctcaggtgactttgaatggcaaaaatcagtcctttctagacaattaatgagtagatatagaatttccatccaaaagttgtagaaaagtggttagaagggagttgggtatttggcagttaggcctggagtttactttctgggtcagaaccaatgtcctgagttcatgcagaaatcacatttgatcttcactaaaaattaagcaggaccagcatgagggtggatagagagtatgttgtatcttctgtagttacagcataacttcctttccccatgtagcattaacgggggaatggaggggactccggagatcacaggaagagtttgttcagatagagacgtttaccccttgaactgtttccaaccctggctgttgtatattattctaaagagactacattagatatttagggaaaaattaaggatagtataaagttagcataagaagaacttttgtgcagggtctacacagaagaaatcacatgaagagtttaaaaagtattttttaaaaagttaaaattttgaaatacgttcttgaaattctggattcagtatagtcagagatttactatcagtggtgttgaagaaattcttggtatattcttcagcaacagagtggctatgataatggaaaaaggttagaatttagtgaatttcagaagtaaagaattttgatagaaaagaacaactgaagttctttggatttctatgtagcatttctgtttaacgagttatcattatagaaacataatctagtaaaggaaaatatttttcaagttttactccaagaaatcatttgagataactgtggcaggatccacataaaacttattagccaaggattctacttagttccagttgaaagtaaaacagtaataacccaaaataaccgactaaggaaacacaaataaaatctttttttttttttttttttgagatggagtctcactctgttgcccacgctggagtgcagtggcatgatctcggctcactgcaacctctgccttctgagttcaagtggttctcctgcttcagcctcccaagcagctgggactacaggcacccaccaccacacccagctacttttcgtatttttagcagagatggggtttcaccatgttagtcaggctggtcttgaactcctgacctcaagtgatccacctgcctcggcctcccaaagtgctgggattacaggcatgagccactgtgcctggccagacaacacaaataaaatcttgagaaaattaactttacacctatctcctctctttctttgactaacgcctatattctcatagatgctctgtttatgcttcattttcttgtttcttttttattccccctttctctgctgaaagaattatgaagaaggaagaaaatttgaaaggaatagaggaaaataggaaggaaaaatagaggaaaaaaggaagaaggaaggaagaaaggaaggcaggcaggcagggagcaaggaaggaagagagaaaaaggaaaaaatgccccagaggcaaatgacatattttcaaagctacttcttctaggctggtaatttcccagtgccctgaccttgcattccagacttcaataaataaacggggatgatgccaatgatcgagacgccaacagcagcccttttctagggctgacatcgactgccacatcactcacagcatgtggaccaaaatatgagacaagctgggcatgcattcagacattttatttgtgtcttttagaaagcatttatatttcctataaatccatttacatgtcagtatcgtagtgagaaatgcacgcactatgagaaggccttgaaacatcaggagctgcagcactcttagagcagacttgacagctgcactgggtgtgagatatcagcatctttaatgtatgccagccttgcatgggtttggttgggacgtcctcatctgagaagacgtggcccccaaatgaatagggaggcactcacgttaatttttctcaactagtatctgaagggttgtcatgctctctctgctttctaatgtacatagaggtgtctacatgcaaacggatagcagctgagacacgctgtgtaacttgcagcttacatgtaaataattcggaggtgagtactgcgatgcagttacacgtcgtaaccacctgaattttatgggggaaccttctgcacgtattcatgcatgaagaacacacatttgaacaggggcataggcagtgtttgtcaagctctggaatgtggatgacaaaggacatcttaaaattccttgatttggggccaatgacaagcaagacatttacagatttagatgacttgtcaatcccaagctggaattcataaaattggctggtctgtttaaagctgcctctttctggaagcttcctctgcacactctagctacagcagggccttaccatggctcattgtcccaccagtcccttccactgctcttgttcctggtctcataggctacacacaaccactatcatctttctccaccatttgtctagaagagggaggggactctgcctaggtctcatcattgtgtatgaattgacagaacagtgcccagtttacaggcagtgctgaacacagatcagttaaatgaatgaatatgatctttactattaggtttctggtgattttctaaagtctacagacaagaaaagcactggccaatgaaggtcaatgtcaaagcacaaggctggtattgagactggagtacggcatgtagtgttgaagataaattgaggcatattaatattaaagagttgatttgaggccagccatggtggctcatgtctgtaatcccagcactttcggaggccaaggtgggtggatcatttgagtccaggagttcaaggccagcctggccaacatggcaaaaccgtgtctctactaaaaatacaaaaattagctaggcatgatggtgggtgcctgtaatcccagctacttgggaggccatggcaggagaatcacttgaacccaggagacagtggttgcagtgagccgagatcataccactgcactctggtctgggagacagagggagattctgtctcaaaaaaaaaaaaaaaaaaaagaattgattttgatttgagcaaacagcaatcatgggtgggccagctctggatcacaagtggttcatggctccacagaaggggcaaagaggaaggcttttatggagtgaactcagaagcaaggcaaagaattcatcccagtggaaagtcccaagttagggcttagctggctgtttcagattgtcctagaacatgaccactgagttgggtttcagattgcagacacaggaactcagggcattggggccaccttggtctagcaggcttccatttaattactttaacagcaggaaccacaggacacctctaactgtccttaagagtgtaattatagctctttggccactccctgtactaaaaggaggagtggagaatttggagaggatgtaggcaaaaccactgtgagcaatcaaagtatcaaaggaattaactcatctaggaatgcatgttccttattctgcagtacctggaagggcttttggtgtgtgacagcaatgtgaagcgtctttacatcttaattctaagagacagcagccacgatgtgggaagaacttcctagttaaatgtgctctgaaaagttggactgtactgtcgagggagactatgggagtttctttgttcagaaacacttaagaaagtactcataggcccacattaagtaagtgatgcctacaggtgtcttctgtttctgtgaattggtgtggagaacccaatgtttattgagtgcctatgtgctgagttaggcatgactctctttctctgtctcctctctctcacacacacttactttaacataggaggaaactgcatcctgagaggctcatataactactttgaccccactagtcttggaagagctgaaactccctcctagattgaactgtacagcccaccagctttctactgactcgtgttagagagcagtgggcaaagagtacaaactgcattgaggttctctactcacagcgttgccttacaacacatcaaaaatgcacctcctgaaaggttatcgctgcacccattgcaatcctgatctgaaagttcacagtacttgtttgtcctgtctaccagcaacccttcagaaagagtctccattgacttatttcagaggcaacaaaatgagcttcagggagagatggtgtaggtccgtggtccgattggtgtccaacgctggtctcaaatgtctcagttgtccttgtcttttgagatcagaatccacagattttcatttctgatgcaccagatcaaggactagtcccccttggctactccccagtcagacatgataaaggtgcctcatcacccactggagaggtgtcttcagggggaagtcaagattacaactaagtatcttttgggtcaaaatgtttgtaaagtattatgaggagatgaatttgtccaaatactcaaattttgtgctttgtaaaacacagtaggttgtataatatagacgagacgccttgccacatcagtaattccccccatattcacacggtgcccctgttccttggaagacatggtatttttttaatagctcatgttgggcccacaggattcctgaaaagtgcagtggtctgtcctgtcctccttttagagactaatacccagcctcagttccaacaccgagcaggagtgacagtggagtgttcccacactggatgttcaggggaattaacaaagatgagtgatggcctcccaagtggttaagggggtgcctgtgtacagcgttgtaggagcaaaaaatgtgatggggtgacaaatttaaaggaaaacaaaaagaggaagagagaaaaacggagatttgtaaaaagcaagagagaaaatgagatgtcccactgcccctgaatacccaaaggggcgtgctgaagtacctcagggatatgattctatgctattgtgatggttaatactgagtgtcaacttgattggactgaaggatgcaaagtattgatcatgggtatgtctgtgagggtgttgtcaaaggagattaacatttgagtcagtgggctggggaaggcagacccacccttaatctgagtggacaccatctaatcagctgccagtgtagctaaaatataaagcaggcagaaaaacatgaaaagactagactggcctagcctcccagcctacatctttctcctgtgctggatgcttccggcccttgaacatcgaactccaagttcttcagtcttgggactcagactggctctcctagctcctcagcttgcagatggcctattgtgggaccttgtgatcatgtgagttaatactacttaataaactcccctttacacacacacacacacacacacacacacacacctcctattagttctgtccctctggagaaccctaatatagttatttatttatttatttgttgagacagagtctcgctctgtcacccaggctggagtgcagtggcgcaatctcggctcactgcaagctctgcctcccaggttcatgccattctcctgcctcagccttccgagtagctgggactacaggcacctgccaccacgcctggctaattttttcgtatttttagtagagatggggtttcatcatgttagccaggatggtctcgatctcctgaccttgtgatctgcccacctcagcctcccaaagtgctgggattacaggcgtgagccactactcctggcctacttacttatatttttgagacagggttttactctggtccaccatgtgggagtgcagtggcgtgatcatagctcactgcagcctccacctctccagttcaagcaatcctcccacctcagcctccctggtagctgggactactgatatgcaccacaacactcagctaattgtttgtatttttagacgagacaggattttgccatgttgctcaggctggtcttgaactcttggactcaagccttggcctcccaaaatgctgggatattacatgttactattgggccctaaactagtgctttatgcgaatcatcttttttaattctcacagccaccctaactggtaggtactattatcatccacatttttcagaggaggaaactgaggcacacaaaagttgaataacttactcaagcccaccagctcgtaaaagacacagctgggattagaactcaggtagaactgacccaaggattttctatttccttccagttgctgaaaaatcactaaactcatgaggcaatttcataagtctatatcttgtctgggttgctagtaattagcaatcattacatgaaatctgacatgtgaaagtgaaacacaattggaagacgttttgtgacatggatgtaaagtatatatttcttgagggtagagttgtttcactgccactgtgttctacatttaggcctttgctgaggttggaagtattcaaatagatagataaagtcacatcataatcccatgtatcaagtgtcatggaagagtacgcaatcaggcttttgatgaatcccacgtttcacttgcaatctgcagatttccatatgctgtggctcagcgatttgcactggcttctcaagcaaatcagtcatgactccaggcgtgactccagactgaaatcactcttgtcgatatacctgaaaacagaggtttccagcactggagagaagctttggtgcggggatgggctcagagggtcccgacagagggtgacacttgcatggttgcagaaggaagctcgctgcagtctgagtgtgtctccgtggagctcggcatttggacacagctcacacgcatgagtgatgctcttccacctgcatcttctggcacttgcactgtgggggccttcctcaaagccgtgcgcctccatctcagggcaacatagggcaacttctttcttctactcacattctgaatgaaatacattaataactggcttaaaagaatccaatcctttatcaaaagactccagcatttttccttccattgactgctacctgatattgaggaaggtataaggtgtcagattcctgctgggactggcagagaggggcagagggaggcaggacgggctgctggggtggagagtgcagacagaagcctgccatccgccggagtctgtgagcttcagggtccacacgagcctcatggagagacaggcggctgctccgtccatcttcgaacctggctggcatcgcagatgcccgtgcccagggcagcagccataaaggccgtggcaccttcttgcatctctaagtgtgtggcattgtggctgcctttgattgtttggcggtttgctgtgttctctgagtgtttttccacacatctgaagggcgattctttgtcaactgctactgtcttgctaaagaatcagcaattcacacatataataaagctcacaaccaaaaaaagcacattcacattttttttctttcatttttctgcctgagtacctctaccttggaaaacctccatcttgtcatatatgggcaagcattcatgtatttcaagtcatgtttttgcaggcagatgactgtgtaagtcctacatggccaccctgccagtgtttcaagcaggcctctatcatgtgctgacctatggctaggggtccctggtttctcccaccttcttcctgatggccaggcatacattcctgccctaagactggaaggctggcagaccagctcaggtcagctggttcaagaagggggaaagttttgctcatgtccaagagataacgtaagatgttcctgaagctaaacttctcttagacaggacacctgcagatggcacctttgctaaccttgattgtgccttgagatattcacctttccttcagagtgaatgctcctatcacctatatcacacttcatatgatgtaagatacaatttatatattcttgctcatttactcatttattcatttatagatttacccagcaaatactgatcaagtgctgagacatgctaggtgctgggctaggtgtggaatacaatggtaaacaagattgagaaagttcctgccctcagggagcttatagtcagtcatgggcaagtaaacaggtcattataacacagcagtgccctaagtgctattgctctatgtgtgggaaaacaggcaacctggggagccatggttaagagggacggagaaataacacgaatgtggtgaggcagggtggtatccccagagctgagaccttgcaatggctaggatgttgctagaagaaggaaatggaagcaagttccagagctcagaaaacattctgagatggaactagaagaacctggatgtgaagcgggagggccagggaggccacggagatggctgctggtttcaggtttgggccacaagtagatcaatgaagaaagaggaatccagaagttccagtccgagggtgtgtgggaggagggtgagtttcagagtcattaatgggccttttcttcagtaattcagaatactcctaagtgagtatggccacttggatacctggaaatattcatggctccaggtagctaccaagagaagacttcattttaattcttgtcaggaactgtgaaggatccaagattttgctttctttgcaagctaacaagttagtctgctcagttttacggaggccaggagaagaccagaggttcctgggtcagagacaaaggaccatgcattatttacagcaatatcttttttcctgtgctggtttctcaaatcccagttctcacagggtggtttgaaatggaccagatggcagctgcacatggcatgggttgcattacaggtgtgaggaccctgactttagggaatctgagtcttttataatgggccgtgagcaggactgccattgtcaacagagggagacattgtctttgttataagcaaacttcccctctgctgcggaaagagacagtatctctatcttccaaggctgttcactgtacgattattattgtaactatgttatgaaacacagggcattaatccatccatgagggtagagtccttaggacctaatcactgcctaaaggtcccacctcttaacactattacactgacaattgaagttcaacatgagttttggagagaacagtgaaaccacagcagaatgatagcaattttcaccaacttctgtttaattgcttaacctgttctctcttgggattgtcagtaaatgcactgctcttggggaaaaatgtggtgagagcaaacacagagagaatggataagaaatactgaatgggccgggcgtggtggctcacgcctgtaatccaagcactttggggggccgaggcgggtggatcacgaggtcaggagatcaagaccatcctggctaacacagtgaaaccctgtctctactaaaaatacaaaaaattagcccggcatagtggcgggcgcctgtagtcccagctactcgggaggctgaggcaggagaatggcgtgaacctgggaggcggagcttgcagtgagccaagattgcgccactgcactccagcctgggcaacacagccagactccgtctcaaaaaaaaaaaaaaaaaaaaaaaagaaatactgaatgctggccaggtgcggtggctcatgcctgtaatcccagcactttgggaggtcaaggcaggcggatcacctgaggtcagaagttcgagaccagcctggccaacgtggtgaaaccctgtctctactaaaactacaaaaaaaattagcacggcacagtggtgcatgcctgtaagcccagctactcaggaggttgagacaggagaattgcttgaacctggggggcggaggttgaaacgagtcgagatcactccactgcacttcagcctgggcaacagagcgagactctgtctcaaaaaaaaaaaaaagaaatattgactgctaaaatctacgttttcccatgtatttaatgtgagcaattatgattagctaatctcaatgcttatttgtagagtatatcattaactggaaagaaataaaccttgagccactgaagaaatggctttttctataaattaaatagtctttcaaacataacaaatgtttttaggaactacgaaatttttaaatttaatactagatcaaatcagcagataaacattttatgtggttccttttagatgtggtacacattatttaacaaggtagttaaaacctgttttattaaatcatatcataaaatgtttattcccagtgcaatcaatactcatattttatattataaagtgtttaatattttccacctcttattaacaacaaattaaaattgtttgctagctgctgagtcagaatattttcttttctttctttctttcttttcttttctttttctttttctttttttttgagatggagtcttgctccattgcccaggctggagtgcaatggcgcgatcttggctcactgcaacctccgcctcccgggttcaagagattctcctggctcagcctcccgagtagctgggattacaggcgcctgccaccacaccccgctaatttttgtatttttagtagagacagggtttcaccatattggccaggctggtctcaaactcctgacctcaggcaatccacacccgccttagcctcccaaagtgatgggattacaggcgtgagccactgcatccggcaataatattttctatctatagctatatctacgtttaagcttttcactttcttgacaatgtttgatcatgaataaagttatttctctttattacatgactcttacttaattattcacagatgccaaacactggggtgcattttaatgcatgcacacatgtgtacccaccaaaggactccaggctatccttgcttcataaataactgtaatttcagcaacacataatattcctttattacaaatcaagtacaagaacagatagatttattttagtttgttaaactttgtgaaatggttaaatgaatattctatgtcattctgatcctgactgtttttcataactcatcttgcaagatagatatctactttttagtgacccccaacaatattccttggaacacatgttagcatatttttacattaacaatattcacttcctctgattttttttttttttttttttttttgagacgaagtctcactcttgtcatccaggctggagtttaatggcgccatcttggctcactgcaacctctgcctcccgggttcaagcgattctcctgcctcagcctcccaagtagctgggattacaggcgcccgccatcaccatgcccagctaatttttttttttttttttttttgtatttttagtagagatggggtttcaccatgttggccaggctggtctctaactcctgacctccagcaatctgcccacctcggcctcccaaagtgctgggattacagacatgagccactgcacctagcctctgattttagctattggtgtgaagactgagtttgttaaatattttaccttttctataaattaaatgactcagcaacttccatttgggtaagaatatatttaaagcacatgacaaaaatattttatcaagagatgctttactggcaaaggcgtattgaaaataacaatatttaatattttttcaactctttctgaatgtattaaatgaagggtttctaaatgcacaaaataaaaggtacaattaatagttattcgtaagatcctcataaaacctttatggcatacttctaaaaaactgaaaaggtaaatcagcgtgccaataatttcatggcaaagggcaaaaaatacttttgcttctaattctttgttcctgaagattttgaaaaataaaaatatgttttgatgatagactatcatgtgattttggcatataactgcaaatgacttttaaaaaatagaatgatactgctaaaagacttcttccattgcaatgtacctatttatatgaacaaagttatttagtgcttacattaattaaaatgaaaaatggaagaaattcatattgagggctgtctgattccagctgtaagcagtatgcgtccgcggcatctcagtaagttggatgttcccattaccatttcactttttgtttaacaagtagtcaacaaaacttataatgtatttttgttgtttggattaactgtttactactaataattaattttaataactcaagtaggaaaaaatgttaacctcagaacctcgtttttaattctagaaattaaaaattaaaggctttgtacatattttcattacagaaatatatactggatgaccaataaaatattttcaaatataaacacatgttagagaataagagaagtgaaatggactactaggagtatgaggcccgatataaactccctttgataaagaagagcccattcatgtgtttacaaaatgaatgatgtggaccctctggtgtacagattctatttctgtcatttaaaagattgctgtctctcttcttttataaaatatttgtcagtattaggctgagcactgtggctgtcacctgtaatcccagcactttgggaggccgaggcaagcagatcacctgaggtcaggagttcaagacccgcctggccaacatgatgaaaccccatctctgctaaaaatacaaaaattagccaggcgtggtggcacacgtctgtaatcccagctactcgggaggctgagagaggagaattatctgaacccgggaggcagaggttgcagtgagttgagatcacgccattgcattccagcctgggtgacaagagcgaaactccattaaaaaaaaattgtcagtttttataacactccaggagtttcactttttgctactacttaagcctgggtaaaattttatgatggacttaaacacttgtgaggaggtacattgttttcaaaattttgtatgtggggaatatattattaggaaaacagtttgaagaccaccactccataccattccaatagtaagcattctattcacttgctattttactcaagagattttgccagtatgctcttggaagagttcaacattgccatagatcatagggaaaatgattacttatttctgtgtctgcttaaagttttctgtgtgcttttttcctctgccattatcccaggctaacgtctacggtgcagggtgagggagggtggcatctgcctgccggctgttggggaatttccctaagtttctgctttgcacccagactccgtcttcatgaagccagagccgcccaagcttcaggaactggactccgattcctcagaacaacatcctctccaaggctggggtgtgcgctgacttgtgtagacacaagactataatgcagaccgtttgagaatcaacacacaatggggtctttattttcctacttgtgtaatcgctgagcaagtcatatcatctcctggagccttaattttctcatttgtaaaatgaggatttacaaagcatctttcacctgtctcttcaggattatagctgaagcagggaaagaaagctctttgaaaagtttaacgcaatttgaaacatgaaaatcttcaaggtcctaaaattggggggcatgctgaaggaaattcagtatcatttctttctgtaatatattcatctttaaaaataaaacaaaaaaagaccacaagtttggcgcggaaaaacaccaagggtaacgtagcatgtgtgtttctgggaggaaggagaggggagggttaaagagttcctgggaagaagcccaacttcttggctgaaatttactgaaagcctttgcccggcatgatcttgctctcttgtgctcatgacaaagaaatgtaacctttggccaattgcatttttgttccactggtaactaggttaatgtgaacagacagatctggtgagacagcatgggaagaaataacacatgggcttttgtgcagctggatataatgaaggtaaattgggtggaattcaaagatttgccagaaaaaagagagatgatttcactctaaaatcattttgcaagataatattttacaaggaaccttttggacatgcattataagcggttacattcccattgtcctaaaaaactccctgcatagttgtactctatttttatcaagccatgctctgacgcctcctgcctggttggcgataatccctaatgcaaagggatcgtgtgaaggtaagtgaagtcgttttgttaatgttgtttataaagaagcactgagcttctactttgtgcagagagctttacaaatattcatatgagctttatgaatatttacaaatattggcgcattaaaaaaataaaatgtgttcattttaaatataataatgtaggtgtcattgctatccccgttttaccattgcagaaatggaatttcagaggtgtcaggggccagctcaaggtcactgatgaatcaggacccgcttatccagctctctctgccttcagagctctcttgacttttctgcatcacttcctttaccaggaatgatatttaaattattccaaaatgtaaaatatagttagttttccaggcagttgtatttatttctggatttttttttccctaaataaaacctgtatctacatgaaaactcctccaggatttcctttcctcatgaagtgtgtggtttcctcaaggactgcctgggaggccctgaggccgacccactcctcccagcaatgacttggggaggagggagtgggggaagacagagagcaggggggtgggatgggagggcagagaggagggggagggatgggagggcagagaggagggggagggatgggagggcagagaggagggggagggatgggaggacagagaggagggggtgggatgggagggcagagatgaagaggcagaatgggagagcagagagcaggggaggaggatgggagagacagagagcagaggctgggatgggagggcagagaggagggggcgagatgggagggcagagagcagggggcaggatgggagggcagagagcagagggtgggatgggagggcagagaagagggggcaagatgtgagggcagagagcaggggagtggaatgggagggacagagagcaggggccgggatgggagggcagagaggaggaggcgggatgggagggcctgctgtgtgccctcatcaggtggatttcattcgctgggatggaagaggaggcatggcatagagacatgaagttctagaatgtttttggccactctctgcaaactcaagacttttttgggggggggtgggcggagagtgcaaataatgcctttttggagttgtaattgctccctgggagggttaaatttttaatgatttgtaatgtcctggtaggttcctgcattcatgaactgcttgggtgaatggctgtgatttggaagtgaggatgggagagaaagagagaaaggcatgatgggaacgtgggtcaaattgaaactcctgctctgacctcatcccttccgggggatgactcttattatcctggttggctacttgcaggcatgtctatacacaggccacctggattaagagccattcctcagggtctcctggctattgaaatgtctgtatctgtaagagtagctttcagtgtctgaaattggcctttcctctctctctatgtgttaggttccacctggtattcacttagggagaccggtcaccctctgcagctctgtctcactactgggtacagtgaagaggtttacaagcttggtagcagtgcctatgaaaataacaactaggatgcttctgttaccatcacagtcacccccattatccaagggggatacgttcccagaccctcagtgtatgctgaaatcacgggtagtaccgaccctatatatgctgttttttcctacacatacatgcctattacgaagcttaacttataaattaagcaaagtaagacattcacaacagtgctacagcagagcaggtataatggtgcgaggaccacgacacaagctacgtgaatgtggactcccgctctctctaaatatctcattgtcctgcgctcatccttcttcttgtgatctatagctctgctatcccagatggctactaagtgacttctgggcgcgtggtgtctacagcgtggagatgccagacaaagggaggatccacatccaggtgggagggtgtgagatttcatcgcacaactcagaacagtgagcaatttaaaacttaggaagtgttgagctggtattttccatttaatatcttcgggcctcggttgactgtgagtaccagagactgcaggaatcgaaaccatggataagcggggactcctgtatgcgctttggcagtgactggtggcgtggatgccacaaggcaggggagcctgggctaggctggttgctgtctggaaaaggggccccctttggctttttacacaggtatggccaagggatgtgacctcacctgagctgggacaggctgtgtataaaaaccaagcatcataattctgacatcgtatattaatgtgttcctgaaaggaatattaaataatgcctttctcaaagtagtaacattagtgtatctactaagctcacctaagcagggctagtctgtgacatgcagaaaataagcataacgtagtcaaaggcatattttgaaagtgaccattatgcaactattaaaataaataatacctttccccaaataggaacactagtatatctaccaaaggcaggttgctggtgactacttgattggtaaacatttgtttattcttcccttgtaattgacacagtaattatatgagcccacatctatcctcatccgtttaaatacagagctggtgtgagtcgtactaagtcaggatgatggtatgtgggtccgtgatgctatattccatgggttaatataatctgcacatcatttaactaatccactgagggagctggtctgtcccagaagttttgttattaaatggaatagtcaatgttcttgttttcttacaaattcacttacagggagaattctgttaatttttttttttttttttttttgagacagagtcttgctctgtctccaggctggattgcaatggcgtgatctcgactcactgcaacctccgcctcctgggttcaagtgattctcctgcctcagcctcctgaggagctagaactacaggcacacaccaccacgcccagctattttttgtatttttagtagagatggggtttcaccatgttggccaagatggtctctgtctcttgacctcgtaatccgcccaccttagcctcccaaggtgctgggattacaggcatcagccactgcgcccggctgaattctgttaaattttacatacagcatgtagggcagaagacatactttaaactcataggttttcttactttcactcagaagggaagggaaaacagtacaattcggcgaaataggaaatctaaatctttcaatgcatgggtcatgtggaaaccgagagagagaagaaaatcgaaaaatagatgatggatgttgttaaggaattagtaaaccgttaagtgctctatcattattagatattcgggtgatcatcccgcatgtagctatttgaccaatgctgcttgtaaattggcttaggaaaattaacatacattttattaaactgacgagtatgccttttactgaaagcaaggaatagacatagccattttgtttaagaaatataagcacatgagaggcttaaaaaggtaggggttgtatgttctcagcactgcagctaaattcttaaatggaaactgttcttttagcagtttcagagtaggctatctcaagctgattgctacagactcaaattttaagtcgcatttctttcagaaacagaaggaaagtcaatctcactttcgaaaagagaaagtaaggtgacccttgtcatagtaacataatgcagcaggtcccaggtgtaacccggaggaaaaggcagacaaggtcctgcgatgccgcagctgaaaggaagctgacgccaacgggcttctcagaagaacaatgactcattagtcccgggctcacggcagatgcggtctcccaacaactggcctccctccaaaaacatggaggaaatcaagagggcagagccgggaaggaggctgcatccctcgcctgatggggagcactcctagcaggcacagggtaatcagaaaagtgctttggaatcacaaaatgaaaaaacaagtgtcagctgtgggagatgtagaaatgcaaataagtacgaatgcaaataggccggataaatggcagtgtgcaatcacccaaagctctgtttacaacccgaaggcagctccgtctgtaattatctgggcgccattaactgcgtgggagcagctctcaacgggtacaagagagataccaccagaagtgaaatgtcctctctcccgtgatgaagccagatctccgagcgattccatctacactgaactaaaccggtttgtgccaaagagctagaagtgtacctttggtgaaacaaggaagctagatttttttttattgcttactgcgcatctgaacgtaattcttgccattaattaagaaaacagatgataagagatttggcttcaataaacatgtactgaaagctaccacatcattgagtttaattatgcaagcaatctcgtggggcaggtactatgagctcagatagacttggtcaaggtcgtcccagtagagctgagattcgagcatcagtattttgggcctaggtttttttgttttttgttttgttttgttttttgttttttttttttgacggagtctcactctgccgcccaggctggagtgcagtggcgcgatctcggctcactgcaagctccacctcccgggttcatgctactctcctgcctcagcctcctgagtagctgggactacaggcgcccaccaccacgcccggctaattttttttggtatttttagtagagacggggtttcaccgtgttagccaggatgctctccatctcctgacctcgtgatccgcccgtctcggcctcccaaagtgctgggattacaggtgtgagacactgcgcctggcctggccctaagtttttacccttcccattatgtcagaagttctcagttgacaatgtctggagacatttttcactgtcacactacagagtgccactggtgtctagcagacagaggccagagactctgctaaacatcctacaatgcaaagaacagtccccctgacaaaggattatcccaccccaaatatcaagaatgctgacacggaggttgagaagcctggcatttccccattgctgcctctgggaggctgcctctcgggatagattgaattgttctgcaaagacatggtcggcagacacagagggttccctcaccaggggtctgggagttgctggaaatggataagaaaatcctagttctacctcgcagacagggaggaagtgaagaggtgaggcagtaaaaattcataacatatctatcacaaatgcattctgagattgcttggatctaaattgccctttccaaacccaagagatatttccaatgccacctgaaggtcctgagagctccctgacatcattcaggactgaaggtagaaagtagaatggccctgggttttctgagggttctttatttgtcttcgagaatattaaagaccagcatctctccagaatacaaataagagtctaatgtgataagaggctgaactgaaggtgtccctagaaaatttaagactaaaatgtcagctgaaagacaaagagaaagatgggattgttcttgcaaaatctcattggtaaagagagagaggattttcctaacaaaaatgttctgaactacaagcatctcagagggatttttgaattttggccagctaaacaccatcaggggttctggggggttagtcaaataaagtcagaaagggcctatctgcggcacaaaacacagcacagccaaagctgtggccaccgcaggaggagcaggagagaacctggtgaggagcaagaaagagcagctcagctctgcggagaagcatggtgctcagccatcactgctcgagcgtgaagagaagcgcagtccatggcagtttgggatgtggttggaagctctgcatcacagttcacatacttactaattttgttgatttgtgagctacagaaagagtctggggtcctgtccaggtgcggtggttcatgcctacaatcccagcactttgggaggccaaggcgggcggatcacttgaggtcaggagtttgaaaccagcctggccaacgtggtgaaaccccgtatctactaaaaatacaaaaatttgctgggcgtggtggcacgtgcctgtgatcccagctactcgggaggccaaggcaggagaatcacttgaacctgggaggtggaggttgcagtgagctgagatcatgccactgcactccagcctgggcaacagagcaagactctgtctcttaaaaaaaaaaaaaaaaaaaaaaaaaggatctgaggatctggggtcctgagagctccagttcttccccgcagttcccagagctgctcctgctgatacaggttctgctgccaaggcatcccaggggcctcagggtcccaggaagggccaaggctgcagctgccacctgcctgggggctcctcggccatccggcatcttccctccctccatccctggcctgctgttctgagtctctgagaagagcgtctggcggctggcaaaggggctaccatggaggaatggtcttcaggaagtggataaagctggccctgcctcatgccaatcagcccagcaagcagggaggacatcgccaatgagtttctggttttcacttcagaagttatagagacgatgtaagatgaaatactgttcagtgggctaatgcagccacacgagtgagttttattttcatccctactttaataaacatacatgtgccaagctggctctgaattatttaaaattacagcagtcagaagagagaccttctcaaagtctgtcagaaagatttttaatcatctttaagtaaacttcaatttctctgaaattgaaggagaattatttctccacttcaaaagtcagtacagagccattgaaggggctttccacctcctacgataagtaaaaacataaaatgattagcacaaaaaatacaccatgaaatgagtttaaagtccttaatcttgaaggctagatttaagacactattcttactgtccacaaacaggtttactttagtgatcataacaaatggcttttattcagaaccattactcagtatgattttaaaatctcgggcttcatcttttggataattcacatgaccttctccttagtgggcgagtacaagaaggcactgaatagcgtgccgttccgcaccaccaagcggaagggcagcactgcttgtatctaaggtggcgacctggaccaagggtggccttcgctgtcttggactggacgggctggactcccagctgaaggtggcttggaatttagctgttccttcggggccccgcttacacaccaacacccatgaatgcttttcaacgaagttgctagaatgcagccgtggagacgaacagcttaccgagagcctctgccaggaagcaaaagagaggttctcttccctttcattttggacatcgtaacaactaaacataacatttatatcactatctgtcagcagtttaacataaaccctctcacttactgccaatgtgtccacgctgctcctcaggcaagccattctccccagtgcacagatgaggaaatcggggctctgagaggttaactgacctgctcgaggtgaagaaaatgagtagggattagaatcagggagcgaggccgggcgcggtggctcatgcttgtaataccagcactttgggaggccaaggcgggtggatcacctgaggtcgggagttcgaggccagcctgaccaacatggaaaaaccccatctctactaaaaatacaaaattagctgggtgtggtggtggtgcatgcctgtaatcccagctacttgggaggctgaggcaggagaattgcttgaacctgggaggcagaggttgcagtgagccaagattataccactgcactccagcctgggtgacagagcaagactccgtctcaaaaaaaaaaaaaaaaaatcagggagtgaagttcctccaacacgcgtggtcttatactatgtcactgtgacttaccacatgccctgcatggggcgggggaactggcgtgcattgcctaaatcaagcgcaggagtttgatggtaccacgaagcgccacagggtgtgggagcctgagaggtactcacgcaatgcccgctggaagataagttcattgtcgcacagactttgtaacattgtaaggaaagaagcctgacagtagttttacaaatcacaccatataaattattaatggtaaatagataacccagagtggacagtacatactgcaatttataagaacaatcagtttttttaaatggtcataaccatttaaaaaaaaagaaaaaaagagaaagaaatcctccgcagtcattagttcagtcagttttacctttggtagaaacaagtgtgcttcagctgctaatattactcctgcctaaactgatgccccggtaggcagagccaaggggttaatggaaagagtggagcacgctgagcattttgccatcacagatgcctctctaaacgtctctagctcaagtaataacggagctgcctaattgcagtcattaaggagcctgtgactttaaatgacaaaggtagagatgctggcatcagcagcctgttagcatttaatttacatgaaattcgattcagtgtgcacgaactaactaggaggcgccaggcttaggccttaggcagacaaagagcaaaagtgtgggaggctgggtggggccggtgagctctggagcttctggctcctggactgggggactgggaatcggccaggccaggcccagcgggtgggagctgcagataccacttctccaggacccatcccagggcagcttcatgggatgggcctggctgagtgagcttcctaaggaaatcctcttgcctggaagaggctcccaatcatctgtcaacttgtctttcctatttagcaaacgattgagattctcttccttaaagacacattctctgatgaacagaatgtgctctgtaatgggtttagccaaagcatccccaccaccttcctccaggaatgtgtatgtctgtgtgaagtcctcaaggtcattagatctcatgaatttactccggcatttccatttccatgcatgctttttccatttagactaaactagcgcttggggtgcttgccatgctccaagaagtccctgcagcccctggttagtgggagacgcagagcaggcattcagtcagcaaatattaattgacgtggtgaggttgtgctctgaaaagctgagttcctcctgagaggctaattcactgtgctcagcctgtctgcgggtagcgagggctcctgagtaacagcgagctttgcacgagcgctaccgcgtggcggtggaaacatttgttccccttgatgaatgaaacggcactcttgacatgctgtacggacagaatctttacatgtcgtttattttgcatttcaaatgctttgaaaaaagccttcccgtggttttggccagaggtatttgttatcagtttaatagatttattcctgttttgctaaggtatgtaatagttatttatttttaaaaaaagccagtacctctccagtcttcattttcatttatccttagcatggtcttttctaaaaagggcatttggcacaatatctttttttgtttttttaatctctaggtaaccaacccctgcctacattttactctggattccaagagtagactgggcttcagggaccagatgccagggctggcacatctgcctaaaacccataattcttgaacttgacgtgctcagcctctccaaagccgcggcgctgacacagctccccctgcacgagtgtacagcagtcagacaggaacggggagagggggctcaactttctgacggccacttagaggctgcctgaccacaaagacaggactgtaaaacatagaccgcatgtgacctgctggtgctcggcactgacccaggggaggagggccacttgggctggaatgcagttgctgggggctcatgaggggctcagtggtgcccctggccaccgagtcaagcagcgtagattgatcagaggagctgagagctgaggcccaccctcccctttctcctacacatggacacctctgagtggaataagggaagactgtcctttctccaagcttgaaggaagatgactgtgactcttttcctggacttcaaggcatcgaagtgtcagctggctgccatcccagcgtctgacagggcagcaggagaaagaggccacctgtatcatccacccgtgctgcagctgaatgggatcggtgcagcatgatagaggccagctgccccgcaccaggtctgcgtgtcacagggcagagtgcatggtctcccttcacgtgcggggccaggtgactgcacagagtgatgagctgggcccactttcctgctattggccgccagcaaagaatacaaggggtttcccttcccttcccttcccttcccttcccttcccttccctatcgacagccttgcagggtggtggtttcctttgcccggagagttcagaggccttagttctggaaagcctcctgtggggagatggagtggcggggatagggaccagagcagagagggcagcagcataaacaaagaggagaggcaaactgtttgagcccaggagtttgagaccagcctgggcaacatggtgaaaccctgtctctataaaaaatataaaacttagctgggtgtggtggcacatgcctatggtcccaggtatctggagcatggggtggtggtggggtggtgggaggatcatctgagcctggggaggtcgaggccacagtaagctaggattgtatcactgcactccagccttggcaacagagagagatcttatctcagaacaaaacaaaaaaattggagaagggatttctctgatttctccctttgggaagggaggcttggaggctgcctggggctgagcagggagcaccatgcttgtaggcctttggggaggtttcgaggtccaagtgtgacttagaggaactgggagatgccagcagacactgagacccaaaggggcctggcttgggacctatgcagctgtgggaggggaaaggccctccccgctaccagatgcagactctggtgccctgaagcctggcgtctgagccagatctgactttgtgtagaagcataaaaggagtaggatgtttgtgatggctgagcgtcatggaggaattcatacctgttcctggagcaatctatttttaaccttgttaacctgaactgtactttaagattgaaactaaatgcagcctcttttctacccatgatttattagacctcccctttctatcaaattaaagctctgcacaaacgaaacaattcatcctcatctaatttataaccatcctcccacactaggaatatggagccaggaatgagggaggttcacgtgggaggtggcaactgcagaacagacagctctttggatttctttaaattgccatttaattccatccatcaacccatttttctgctgtatacatagaaaaggacaacagccactccctcaaccaaatatccctacattcagttaaaagctactctgtaccccaggacatgggagcagctcctatccttcccaggtgaaaaagtgggctttttttcccccttaaggctaaataggatttcttttctgttagctatgggtaggtgacttcttaatgatctttaaggaaagaagtcaatacaaggaaaatatccttttttaatcccattttccttctcaccccacactgagcgttactatagcaacatctttcctgctactaggacagttaagtccccctgtgaagttaaccgaaagctgctttttcactcagagaatgggctgctgttcattgaccagcttttcctgcgtgtctaaattcttcggttctctctgacatgctcaatctagggtttcccgcggctaaaccctaaaattcacttcgaaactcctaacagcagaattccccaaaccttttcagaactgaactcattagaaatgaatttacattttgatttagttataaataacttttcttctgtgtattggtttaagtttagaaaaggccccctgtaaagaagacaagttggagaataatctcccatattcctctgccatcctttctttccttcctttccttgagatggagtctctctctgtcgcccaggctggagtgcagtggagtgatctcagctcactgcaacctccgcctcccgggttcaagcgatgctcctgcctcagcctcccgagtagctgggactacaggcatgcaccaccatgcctggctaattttttgtatttttagtagacacagcgtttcaccgtgtaagctaggatggtctcgatctcctgacctcatgatcagcccgcctcggcctcccaatgtgctgggattacaggtatgagccaccgtggctggcctcctttttcttttaaacacatacatacatatatgtaaaaacaaaagaaaatttcaggaccttccaaatttcacaggcctagaggaaagttaagccctggaaatggagttgtgagagcaggctgttttttctctctggtgcgtgaccactgcttcctgatttttgtgttgagatcttagaccttaaccagacttatagccttcattcaaaccagactgaatgatgtgggaggtagggaccttggtcattgttatctctttataataaaatgctaagcaacccccttagagtgaagtcaacagtagccaatcaaatcttacatctgtgtgttagccgttgtatggaaaacaccgtgattctgttcagcgcctcccttttgcctccataaaagatcttcacttttccccacaccgtaatatttcactggattcttggaatatcagaaattcatcattctttggtgtctgcgtatctctgaatggccactcccatgcagcccttgaatgaattacttaactggatcctaagcattttgattattttagatggacatatacacatgcatatacacgtatgtgtacatacacatatgtaatgaaattgttccaaaacacagaaaatacaaagactaatgtaatcaggactcacatatccacatcttagatttaatgctgatttcggggggcatttttgcttcaaatttgtaaaaagcaaaggttacagacataaagatcttgcgattctcttatcccagtttcttccgtctttcttctcttctttctctttctctgtcccccgaggtagcatctatgctgacgttcccgtatatcttttccatccaaatatttgcatttttgctacacattacgtgcaaggcttttatctgcttcctcctaatttgtgggggcaagaggctagacatctctggctggaaaggcactccctgcagatctgggaagccatgagccacaggagcattagctgttcctctaccctttcgtttctttgctggacaatccttataagctggagtccaagttaaccttcccaaatgagtggcactattattttaaaataaaagcgttcaaggtagaggatgactttgggactctggcaacacaggaagcccagtgtgttctccccaaggtcacattaaaaaggtggtgcatctgagatggtgactgctcagaataaagtgataaggggacaaaaggtggatggcttacttacaggtgttatgaatgagaccatcagggctcgggtaagaacattgtctgggataaatggtttgtggttattgatctggaccaacctgatagaaaagaagctgtgtgtattattattacaatttcttggtttatgcttgcaatttataatttgtatgctcagtcaattctgccaatataaaatagtaatgccccggtttcaaaatctgatattggattttgtcccacgatttagcatgtcctctaagcaaaataactgtccaaccagatcacttgccttcaacaacttaaaacacaagtaactagggagaaaaacaaacaaagaaacataaactcaaagaaggtttcaagattgacatagagaaaaatcttttctcatctatccgtatgtactctcccactgctcatcgtgggccccagggaaaggcgattttattcaaagaaggtaactctgaacgtactcagggccgtaatatgtgaaatgtctcccagtgtttgacaaaaagactctcttttcatgttcatattccatggaaatcttaagtcaaagcaacaataaaataagctgacccataagtgcacgtgttgaagaggctcagccaagaaaaactgtttggtagttgctgaaaactggcatctagacctcaaagaggaaatcagaaccaaagtgcagacttgtcccaccagagatggtgggtgttggactgagtcagcgacagtgaggcactgactagacttccgtaaccagccatactttctagtttataatgacattcatggttattgttctacacagacaggtgtagggaagcaatgggaaagtgcaggaaaacagaagcattgggaatggaacatctttggtttctccatttcaatgcactgccatgacccccacacccacccacgagactttagctgttccagagccaacggtgcctgcctctttgctgatccattactcattctccctacagctgcctcatagctttggctcccaagaggtaaggtacaggtagtctggctgcctgcattatcctccagcctcaaaatacatggggaactgaaaataaacaaactgttgattccttgagcttaagaaggcctcttggtgttcctttataccttttcgagtctctcctaagatcagagagaggagtgaagagggggaaggtgtatggccaaaggaggacttgccctgattgccactggcaaagacgctgagccttagggaccatccagaggcatgcaggacccctgctgcagcattcttgaaaaatgatgtcttcctacgcctccctgactcaaccagaagctcacaggtaagaacacatcccatgttgcgaagctccatctattgtgagaacttctgccctgccggctgcctctgacatgccacatgcaagtgataccatttaccctactttgcaatacataacaatctgcactggtgtttccaatgcccaattgttttcttgacttctccataagtttcagcatatctataaaccactcataccatgatttacttaatgttttctttttcttccttttttttttgagacggagtctcgctctgtcacccaggctggagtgcagtggtgtgatctcagctcactgcaacctctgcctcccaggttcaagtgattctcctgcctcagcctcccgagcagctgggactacaggtgcccgccaccacacccagctaatttttgtatttttagtagagacagggtttcactgtgttagccaggatggtctcgacctcctgacctcgtgatctgcccaccctggcctcccaaagtgctgggattacaggcgtgagccaccatgcccggcttgttttcttaatttaattaaaattattccaaaataaatatcataccattaatgtaaatagaaaacactgaattgtgttacttgccacacatagaagacaactgcaaaaaatcaacaatatgaatgatatgaaagtcaaacacttttgcctgtggaagagcccagggcctgcattcttgtttttaaagaggcaggtaagcaggtaatagagaagccttgaggactagaacagaaccgatggaaagagaactggcaaggggctaacttctgcatgacgtgtttccatgttatttctcttaggtcccagcaccgcagaaaatcatcttgaacacctcccaaggccaatctcccattgcaacaaatgaactattaaaaacaggggtctcttttatcctaccgtcatctcatttccagataaaacacctccagtttcttcaatgacttccacgagaagacctctctggagaggtctgaacattgtcttctgtcagctccctcttgattttgggaccaagcattgaatataaagttaggatgtggcctgattagcataggcagagtactgagaagccttccttgtgcctgtcactacacttccatcaacagactccatcaacaggaggcaacgcagcctcaggataccacctgcccacggcccacctgagggaacctgctgcccacagcctctgctcccagagggacctacccagtcccaaagctgaggcaccacccatccttgaatggccagagtaacctgtctcaagaatatgagcaagatgattccaagagaaagtggcagtcaacagtggttttgtacaatgcggataaatattagaaaggccatccaggatgcgtcatttgcaagcttgggtggacaggcagctgccaacagtgacagcaggtggcccatgagtgaaacttagagaattaggggactgctttggtcttggcagatttcctggccagtccatggaaccctcaaaataggtcccttaattttgtagaaaaatggtgtcacctttaaacgttgtaaactacatttataaatttaagacattcttttttttcttttttcttttcttttcttttacttttttcttttcttttcttttctttttttgggatggagtctcactctgttgcccagactggagtgcagtggcatgatcttggctcactgcaccctccccctcccgggttcaagcgattctccttcctcagcctcctgagtagctgggattacaggcgcaccaccacacccagctaatttttgtatttttagtagagatggtctttcaccgtattggctaggctggtgtcgaagtcctgatctcaagtgatcccacctcggcctcccaaaatgctgagattacaggcatgagccactgcgcccggccttaacacactcttaagtacttccaaagtctgatttaaaaaatagttttgtttttcctgaggacttaaataacttataaataaatcaaagcaatagatatagtgcgccttaagttctctgaaaggctttgatactgtttacaaactttgtcagagttcaatttaatatccctagcctcagtcaattactcaattgtgtttcaagctaagtcacaaggctgagctgtttcactaattaaccacattcctttagaagttcaagtatgtataaattccttaatacaaaatattggttctgtgttttttaattctttaaaacatttctctacttaattctaaatcttttagggtgaaagatgattagctactaaggaaactattgcaccatcccacacaactattttaggtgatgttcctgtattatttttgggattgtcctctcaatttgcttgtagttgcgttataatcaaaacgtttagctggggtgctgactagattcttcatggtgaccaagtgggttccatggagccctatttatagttgccatagtgatgattccataacccacaggcgaggggcagggagcccttgactttaaatccaaattctctctctctctctctctaatatcatatatattttatatatatataaaatacctccattcaagtcacttggcagaattttgcactattgtgctcttaagatataaatatatttccatctcaaggtcacgtcaggcttaataaaattctgtattgtcaaagtctatacaggaccacacacattcttcgtgtattcaatcgcatttttgatatctctcatagccatttttgatagttgcaaattctaaggccattcattcccacaatctatttgatgaaagtttttaaaaaatggaatattcaatcctttatagccaatgagggcctgagccttgaaccagtgaacagtactgagtagcagttaggagggcggggagtcagactgcctgggcttaacgtcgtggctctgtcactcatttcgtactcttaatcatcatgctatagaaactcccacaatgtgtgtgtgtgcatgtgttattaaatccttcagatacttctcagactcttgcctgtgtagataaacaacgtgtgttttctatcaccttggcttgtctctagtacctggttttttaaccaaacattactctgggtgttgtggtgaaggtatgttgtagatggggttaaaatctacaatcagtgggattgcccttgataatcttaacgggcctcatccatttagttgaaaggccttaacaggtttctcagaggaagaaattctgtttcaagattacaacatcagctcctgctccgttcccaaccttctggcccgccctgtaggattcagacttgggggcctccatggctatgtaagtcaattctttgaaataaagagaactccaactaatgcacaacggtcggtccatccctccctccctccctccctcccttccttcctcccttccttcctttcctcctcccctcccctcccctccccttcccctctccccaaattcaaaaaaagttaactttatgattaccctttctgggaatactagttgttactatacacattattcacatagaaaaatcagtaatgtaccagttggtagttgaattcttcagagggaaagattagtatcttattttttatttaatgagatgaggaactaaaagagcattactattctttactacaatatataacagaagtgttttcttggtgtctgcaatgcaaattctgatgtcagtaaatacattgagagactaatttgtcaagcaagcacagaccacacatggtttctttttatttctttctttctgagatggaaggaaacctaaaagtaacaatgtacacaactcgctagggttgccagcagcattttggcgatgtccccttgggtcacagaacggcagcatgggttctataggtcggggtggcattagcactgacggcacatagcctgtgtcttttgagctcactttccatgttatcctaggtcctgtgaaagaaagacctcaggctcacgttattagatccttgggtaattctccatactctgaagttcttgaagaaggcactggctggggttagggtggctttgggaaacccttgactgcttgaggaatcctttccaattccttccttaaccaggcaggaggaacagcagttcattcgtggtcttgagtccaggttccaggttctaagcttggtctatgcttttggtgtgctctctaactcaatgataatgatagtcatggaagtttcttaatatctggggttttgaaactgttagttcttggagcaagcccaagtttattttgggggaactttgcgccagcattgtagttatactgaaatttagaatatgtgggttgaaaagcaccaaagccagtgtgagaaatccagcccaccattagggctactgaagtcccattaggttgactactttctggaggccaattgcacttaacttggattcctgagtgactttctctggtccataacttcatctaggtcactgctgagacatcacctctccagtaaaaccatctagcctgtctaaagtcatccttccactcccccagttgtctcagtttctctgtcttttcttccccagctatatttttcttcataacactggtttctctagacattatattacatctagatttgtcatatcctgtctctcctattagaacatagacttcttgagacgatggactgtcagtttggtttaatttgacacgtgttttttttttttttgagatggagtctcactctgtcgcccaggctggagtgcagtggtatgatctcggctcactgcaacctctgccccccgggttcaagcaatgctcctgcctcagcctcctgagtagctggaattacaggcgcctgccaccatgcccgactaatttttgtatttttagtagagacggagtttcacaatcttggccaggctggtcttgaactcctgaccttgtgatccacctgcctcggcctcctaaagtgctgggattacagatgtgagccaccacgcccggcctgacacgctgtgttctaaacacccagcacaatggccagcatgcagaaaacactgcagaaatatttgctgcatgaatgacttgctatttacatcagcctactaaatgctacccagtgagtagaaaaatttcaaatgaaagcatcctaatcattcctttttttatagaggcctatcagtgtaggctattctagtggaggaaatcacatccggtccctggtgccatgaagttacagaaatattaggtgcaggccaggtgcaggggctcacgcctgtaatcccagcactttgggaggctgacgcgggcagatcacaaggtcaggagaccgagaccatcttggccaacatggtgaaaccccatctctactaaatacaaaaaattagccaggtatggtggcacatgtctgtaatcccagctacttgggaggctgaggcaagggaatctctcgaacccgggaggcggaggttgtggtgagctgagatcgcgccactgcactccagcctggcgacacagcaagactccgtctcaaaaaaaaaaaaaaaaaaattaggtgcatacaaataaatacatatacacatactttaactcatatcaacatattatagagaaacaaatattgaaaagaatttcaaggctggccatgtgtgtttatagtttcttccagttcaaaatcactatgaaaaaatgttttcctaaggagaacgttggcctctaggggaagcaaagggctcctgtgttgtgatggttaatattgagtgtcaacttgattggattgaaggacgcaaagtattgttcctgggtgtgtctgtgagggtgttgccaaaggagattaacatttgagtcagtgggactgggagaggcagacccaccctcagtcaggatgggcgaaattgaatcggctgccagtgcagctaagataaaagcaggcagaagggtgtggaaggcctagactggctgagtcttccggctttcaaatttctctcgcattgaaagcttcctgccctggaacatcagactccaagttcttcagcttttggactcttggacctacaccagtggtttgccaggggctctcaggcctttggccacagactgaaggctgcactgtcggcttccctacttttgaggttttgggagtcagaccggcttccttgctcctcagcttgcagacagtctattgtgggacttctccttgtgatcgtgtgagtcaattctccttaataaatgccccttcatatattcatctatccaattagttctgtccctctagagaaccctgactaataatctcccacatcaccagcttgaatcctgcccaagaataaagaggatcaaggacagggcactgaactgtaccaaaagaaagctgctctttgggtttgcgaatgctgacctgggtctgctttgtatgggtggtcagagggtgaaagggtctggggtacatgcacatgacccttcctcttcctcttccacccacatgcccagagagctcagggcttcctcaggagaagagatggtctcattgctcagggaaccttttctcctaggcaaacagaggtagtgtggcagctggaagaggcctggagtggtacttggactttgaagccaaacacttgccctctcagagcctttgcctccactgtggtcctaccagagagctgagttcaggacctgggtttgggcgtggaagggcggtgtgagagcaaggctgaatagtccaacttcctcctttaacaaatatccactgagcgtcttcgctacgcaaggctctcttccagaccgcttggttctttggagtccaggagttctccactcggtacacccagttttaccaaagttaaacccatgagattttgtaataaagccaaggctaataataatgcattccattacttttcctacacatgtgtctctgttaagcactttgcaaggaggatgggcagctgggccaatgcaggatccaactattcaagattcctccacttacacaatatattgacactaactctgaatgcatccctactgaatagagaactctagtaatttctactgaaaacatcaaataaaaaagctactactttaatagaaattacctcttctaattgccctacaatgatacaactgtattctgaaaggatacatggatgtcatataaataactcaaaattcatgtttatatttatgtacagtgcctagaacaatgataagacatgactgctgaatgtgtggatagatggatgggaggatgaatggatgcatgaatgaattaatgaatgctctgtgatctgagggctgaagatacattactgaaaactccaagaaggtcagaaagcaaaatcaaggaatatgaaaatctactgttaggtacaaacgtgtctctagagaagagactggttctgaaaatagggagaatgggaaccaccaacttcctgtgtgtgtgttaccacactcttaatatgaaaacatgtgtgataagaagtccaacattttgtagatgaccgcacatgtaagttaaagaaatagtggccttcttttgtctttcctttgtagttttttgggaaaaggacgccaataatcaaaagacctgcagaaaaggtgatttggtgtttcaagggttgtgggcttttatgggacacaagctgaactgtcatgcagacaatgaccgccttctgatttacttgggctgctcaaaactctggaaagaaaaatagaatatcctagctgttatgggaatacttataagaagaaaaagagaaatacagctctttgtacattcagattcctttagcttgaaagaaaaagggtagcctcctttaagaaaacctttgggtttgacagaacataaataaatcttagtgcagctgcttatcgagctaaagaaggcctggtgtctctgctgccacttacagatttcagaaacgtgttgtcattctttaatcatgatcattattggagaatatgattgaaattttaattattaagtagggggaattgtgaagcactttcatccagcatctcgggtgcctggtgtgatcgaccataagtgcagctgatgcaaacctggaagccgttatcacagctccctggccctcgccgcggtggaggcagccgtctgtctacctcctgccggctgcctgtctcctaaaatgtctgcatgctgtttactgcagagccagtgtttgaaccaaatgctcagtaatgtgaaaacatcaattatttccttcctacatttaaatgaactatgattacccttgatttaatagcaaaggagcatttccaaggtacaaaaacatttcagccattaagctcaaagtttgtgtttaaaatatatgtttgttttcttctacagagcaatgggcactaaatttattagcttcgtgctcaccatgacagtaactccatgtctgtggaattctgtagtctgcatgtgttaggctgtgggtaggcaagcttgtcaatggagaaatactgactttgccagaaattcgtaaatttttaggaaagtgaagagcatatggtcactatgacttgctagtatccttggtctaaaccttataattaccagaagccattttcatgtttttttttttctttttaaagtgcatatctttatttggacagcctcaaatcccttcatcttatctggagggaagacaggaatgaaaaccatgatagtatccaggagggattttaaggcaaggctgagctttctaaagctacaagcacttccttcctcagagagtgtctgctgacagccagggccttgttagtggcccagtagccaaaagaagctactttcagaagtggtacttagcacctgccctcagtgatcaccatttttcaggtaagacttgttctccaggttaattacagtggaaacctgatcgaacttgacagtcagtgtgtttgtgggcttctcttcctgccagtctgcaacctaaaggaaatgctgtggtctctctcttaagaatgagaacattctcagaaatgcccttgaagtgactattaattccagaatatggtgtgaattaagtaattcatttggttttagtttacttttgagaaagtccaagctgtgcacatgttgaaataaatcagaggcctgtttacaaatggagccaccatttcttagtgtggagtgcagggacctggttctgagcaaagtagtgggaaggatggaattccctgaatccctggatctgttcacaggaatgcctagagcttctggcacacagggtagcaggccttcctgatgccccagcttctctgagatccatcctgctgtcagccctagaactccctcacaagcaagctattttcccgtttttctcatcgctgtttagaggtttccacttatatgtagatttgtccagggtcctaggaaactagctaactggtgccaccataacatttgctataattataacagttcagttatttggttttctctttgtctccttcttcataatttagaggctttcaatgacttacccctaatgggagatttctggcccagaaatgggtcagcagaaactattatattgaaagttggtttcttggtgctgcttacattattttatttagataagaaaatggctgttgatattttgtaaaaaaaaaaatctatttatccatcaaatcacatatgcttctttcctttaattcaactatccatccatcagtccatccatccatccattcatccaaccattcaacttttaatgtgtccccacagggtgaagcaggcatggtgcaggaatagtacgaacaaatataaacagcaattgatcctaccctcaataagtcatctgcttagaggacagattttggtggtaatacaaccaaagtttataataggaatataatccgtgttattttaggatgtcacagaggttgcaacaaaagattattttatttaattcttgttgatgggcaccgtgtgtttacagaggagagtgcctttgaccaagatcttgaaaagtgggttagatattgcttgggaataatgggcaaaggaggtgccatactccctctggatagtctcaggcccaaatatccatttaggatctctggaatataatgggctatacttggcattggagtcatttagaaggacacaggacaagaagcagcatatcagcaggaagggccaggggacacttctctgaacccccgtgatcacttgggtttggggaaggagacatgctggtaggtaaggagcaatgctggggtagaagccccaggtgccacatgtgctggcaggagttccgggggcacaaggccaagctgaagaagacacaacttcatcgccgtgagcatgacttccagggatgtccacagctgtggcttctcccaggtatttatagttcatttacagtcctgcctgtcaagatcccacacaccaaccaagagttatcttttttttttttttcttcagatggagtctcgttctgtcgccaggctggagtgcagtgtcacaatctcggcccactgcaatctcagactccctggttcaagcaattctcctgcctcggcctcccaagtagctgggactacaggtacgcaccaccacgcccagctaatttttctttcttttttttttttagcagagacggggtttcaccatgttggccaggatggtcttgatcacctgacctcatgatctgcctgccttggcttcccaaagtactgggactacaggtgtgagccaccatgcccggtccaagagtcatctttatcataagtacttactgtctattaaccccataaacattccacctgcatcagtttttcagaaaacagaactgaacgtcaagtttgtcctcagggacagagaaagagttttgctagccagtggctcagaggaagcagcggcctgtgcaaaggtctggaggtctgaaaagtactcagtgagttccggacccggaaatggttcaacatgagttaagtataaggtgtcgctggagatgagggggatggtggagagggagggtaggtggaagatgaggccagagggtccagaaaacaaagtagatggtcttaaggagctgaggtttttaagctctagggaatcactttatggggggtgttatgagcatattttatggtatggggataaaggatggattactagggggaatacactcaaggcaggaagagtgtaggttgttccagtagttgaggtaaagagtggggaccctgagttaataggaaagaggaggtggatgcaggaatcactggccttctggaatcaatcagttatcagtcagccactggagataaaagggtctggaatacatgcacggaggattctaagtgccactcattgcaaggaccgaggtaagaagagacaggacagggttgcatgtgggtgagggaagaggtggaaaaatgagctcaaatattgacattttacatttgaaatgcttatgaaaattccaaatggaggtatccagtaggcaatgtgaagtataatccaggagctctagagaatggtctagttagagacacagacttggggcctatcaactataggcagtcagaactgcagaaatacacgagaaggtctgagggagggcttggcttgaagagaggaccaaggatggtcaccttgaaaataacagcggttaaagggcaggtggaagactagcttgcaatgtgggctgtgaaggatggcaatggtgggggaagatggctggaaaggtgggtgagaagggcacccacaagctagcaggggagggaacagtcaacagtgccaaatgccgccacctgcaatgagcggggactcactacggtagggacctacacatgctttgtctcatccttttcatctttgcacaatattagcctctactgtcttccaatatgaccaaagtctagtccatctagagagatcagatcaaaagtgagcctgaatcatttacatctaacaatgttatctagacagcatgcttttattctgaatcacctgaacttccagctatctgtggtttataagctggcataagctggcatttttcagtcgaaataccacagggagaggtattttaggagctgatttggtattcagttaatactgtagaacgtgctcttccattaccttgaagctaatgactagctaaattagttatatggcccaaagcaaagataagatggttagtatgtttgaccagtcattaaaatgtgtgtctttctggaaaaatattctctgaagtgaaatgacaccatgatgtctgatcagcaatatagctcacccttattttaaaaggtctactttgaatgtctccccagggtgatcatattaaaaaaatcaaaatttaatatgtcattaacagaggttaacttgctgaaaaataagctgaattcgttgggaattgctgctaaaacattctgtagctggaaaatatcaccctgtttctctggagaacggtagcaataaaaacacacagaatacactttcatcccaaaattggcatactttaaataatccatgatttttttgttctaaactggcttaataggtctgaggccaataatattttctatttcctcaggatttcttcactcagtttttttgtttggtagagcacttagtattaacaaggcactacagtaggctataggggcatgaagatgtcagaagttctatgtatagtagactgcaatgtactggaagcaacaggaaagtcagagagataaatacttacataaatactaaatagagaaaaaactacctaatgagaattatgggtgactgagcaccaaggggttccaaggtcagtgtgagcccttctggctggagtggtcagtgatatattattgaagaaggtggcatggggcaccagtagaattcctgaggcatccagattcagcacggcctctggaaggtgactgccaggtcagcttcactgtcagctggtgcctctcctgacccctcctcccttgttaccaaggatgccaaaactttcccagctttcagaatgacgactgtttggttctacctggcttatccttactgatcctgcctaactggctcttgaatcatgttttccagaggtcaactgagtctaagaagacattaaaaatcctgaaattggccatatcatcctgcccctccttgattttggacaggatgcatttgggatctggcagcacttttctgagggcatcaactaccaaggttggagggatctttacatcaacctacactatacctaccagatgctttctttgaccatcttgatatccagatatggagtattcccatttcttggttcccatggactgaaactttacaggtaaaggccaaagttttgattcagcatgaatgagaaattcaatgtactataagctggaaagacttggctgaaactcagccccagctaaagcaacatcagaactgcatacacagtggtaaagatcaagtgtccactttggaagtataatctttatctagtgatcacttttccaacatttccatccaaattttggaagcacctaaatccaagccctgcaactatcccacaatattatagtattattcacttatatttaagatactgtactccatagagctaggatggtagacatcaacatacagagacctttagggttttttttgtttttgtttttgtttttgtttttttgagaaggagtttcgctcttgttgcccaggctgaagtgcaatggtgtgatcttggctcagagttttgctcttgttgcccaggctggagtgcaatggtgcaatcttggcttaccacaacatccgcctcctgggttcaagagattctcctgtctcagcctccttagtagctgggattacaggcatgtaccaccacgtccagctaattttgtatttttagtagagacagggtttctccatgttggtcaggctggtcttatactcccgacctcaggtaatctgcctacctcagcctcccaaagtgctggaattacaggcgtgggccaccatgcccagctggtactttctcaagccagggattggattgggaaaactgatggagttggccaattcctatggaagtcacatttcattcctggaaactttgaatctcagattttcttttttaaagaaacttcatctatatatcatttatataatatgaaatatgtcagttttaattgtatactttgatgagttttggcaatatatgcaccactacaatcaggatgtattttataacctttccatgttctgaaaaaggttttctcacgcccatctgcagtcaacaccatcctatgcccacctagcctaaggaaatcattgaacttctttgtgtaactacagtcttggtattggtaatttctcagaaagtgtaaactcatgttcattagcagacaaatagaaaaatgaattaccaaataattaaataatgccttgaagggctccaaagtaagtcacacctcaaattctgacatacaggcccctaaggtctcttatgaatccccagtgaaacgaattagtcaaatgtcaggtaaaaccatcaggcaatacacaagttcctccaccttggcttccccacctgttgcttgctgggtcacttgctcccctttgcttagccagttcgacccacaaaatatctccttggaagccttagctcttcaaggaggtgacaactgcttctgcagagctcaggtccttgtggtcaacaaaagcgataggctgcgatcctctccaggtgagctgcagaggttagaaagcccttcaatcactgactcttgcagcttggagtatgcaaaaagtcgcagcgacagagacagcagtctagacggtgagtcttctttcataccgtcgagactggcccatgcaggacctgctttaggcctttctgcctcagtgtttgcttactgctctagttctttttgaaaggcgacatgctttctggcttgcttcttttggtaataatgatgacttcttaacattgggattttaaaaaatcatcttggagctgacctacatttttatacgttctgatgttcctcattccttcgtacagatctgggcttcacttcatatcctttcaacctgcagacgtgattttagtatttcatgcagtacaagtctgatggattctgtcagcttttgtcatctgaaaatgttatttttgggggcctttcttttggggatttttttttttttactagacatggaattttagtatacttttttctttccatatcattccattgttttctggcttccattgtttttgatggagaagtcagccctcactcttatcaccgtgctctccatacaatgaggttccctctggcagctcttaacattatctccttatcttgtgttttcagcattttgactgcaatttgttttaacacattgttttctttgtaccgctactgcttaagattcactgtgctttttgggtatttaatttgatgttttccatcagttttggaaaagttttcaccattatcttttcaaatatttcttctggcccattctctttctttttcttcttggattccaattacacagtgtttgatattcaccagatcttggatactctggtctatgtttattactttttttcactttgtgtttcctttctctccagctttattaggtataattgataaataataatcatatattcaacacatacaaaataatgacttgatatctgtatacactatgtaataattacaatcaaattaatcaacacttctatcaccacacatagttatctttgtgtgtgtgtgtgtgtgtgtctgtgtggggaggacacttaagacctagtcttagcacatttcaagtacacaatacaacattattaactctagtcaccatgctgtacattagatccccctgtgtttctatttgaacagtttatattgaccgctcttcaagatcattgatacttacctcttctgctcagtcttctgttaacctgttgaatgatttagtcaattctgataacattctcttccaggaaagtcttattacttttagtaattttcttcacttaggttttttttgatctcagctctctgatgggttaaaaaatctctgaaactatgtaagctgtttggcttgttctttttgttacggtagaaatctagaaaatagttttatcatttctcctccagtcaactagtttctatttttgcactcatctgctctgatctgtttaggcagaagcttaaacaattctgcttgctcaactaactcagacactgtggatgttaggatgaaggtacagtttgcatattaaaagataagccagtacatctctgagatttgccatcctctctggtaaggactgcactcaaagtaacaggagggcctaaccttaaataaatatgcagccatactgctagggcaaacatccacacacagacacacagacatacaaacaacccaaggacaggctttctgacaagtgattgatagatttatttcaaagctgtcaagtagagcccaaaaagagtggaatctcagggttctcttggcaagactatggttctcagatgggcatacaagctttttcctttctgggacagtcacacgaagttagttaatgagggatttttattcttttgtttctggtggcagaaataaaatattcttttcagggcaaaggaatgaaatctcatcaagaggttcctgtctagattcgcgtccttatatacaagccaacttctctctgcagaatgttctacatcccagaaaccaggattgtttgccactgatttcattttcttctcactgttgcctctggattaaaaagcctctctcattactgctcatcagtgtcctgctgctgggggagccatttgtgctgacgaatagttgtttttttcaatgtactgggaaagtggcattttgagagagacttcttccatctacacccttctgtcttaagtataattcactcattcattcattcattcacccattcatcagtaaatattattgagagtggactgtgtgcctggcactgtgcggtgaatttgatatagacacatataatacgaacacgattctagccctatggagtatatacgttattaactgataagttcagtccagcacacacttaccaagttcttgtatgtgctgggcatttaagagtgtaatgacgagtaagatgggcatttctctgtaagcatatggtccaatggggaagacctagatacaattttaatacaatgctttactgttgtataacagagaaacatgcagattgctatgggaatgcaggttgagaggtgctgagcctaaaaggaggatacagggaaggcttcctggagatgatgacgcttgagaggagtctcaaaggatgtgcaggagcgacagaggctgcaaatgcctgcccaatattcatgttcctcttcttcctcagtaacagaacaccaactatgtgcccagcaaaattctacttttccagccttgcttgcattagggctgatcagtgagctgtgagtagagggtttcctggggattccagggagctacattctcaggaggaatggccatggctcccttgtgaccatggaggtcccacactgtccgtcagttgcatacttccagcttttttttttcatgtgagaaagagtaaaattctattccttctcactcccttagcctacactttatttttatttttagttttattgagacagagtttcactctttcaaccaggctggagtgaagtggtgtgatctcagctcactgcaacctctgccttccgggttcaagcaattttcctgcctcagcctcctgagtagctgggattataggcacgcaccaccacacctagctaatttttgtatttttagtagagacggggtttcgccatgttggccaggctggtcttgaactcctgacctcaggtgatccgcccgcctcaacctcccaacgtgctaggattacaggcatgagccgccatgcccagcctcttaccctatactttaaaacaaaaacaaaaaaaaaacagccaaacctaatcttcaatctgaaatagtgtactacgccaggtgtagacaggaagagagaagaggcagtgggtctgggaaaatactcagccttgaaaagtcaaccataataaatgtcaaatcctacagagtatcctttaaatggcaagggggtacttcagcctgactccatttttgcctcactccccatttattgacatgtgcttattaacatgtttagaaacttaaaaatgcattcatcctttactgaaatctgcccaatgtcgtctgctattatttcaaatactcatatttcaggaaggctcagatttaagtgaaggtgtcaccacagtctaagttaccatctcctgtccttgcatccatggccggggaattactctgctatttaccactaatgcagctgccgggaggatccagcctcagaggacttgggtatgttcttctcaaggacaggaaagtcatgcacagtgtatgttcattcatttgtgaagttgtccttgtggccacagttgaaggccctcatgctcactgtcagcctatacacctgtcagtccttcccataagacatactcaacaccaacctggttaactgataatgctgactacaaccaaggcaacttcctcctactttaaaacccagcagtacacaaatgggcgctccctacaggccaagtaaaattccttcatgcatctcctaatgactccccaccaaaatgctgccaaagagtcaatactgccacctcccccatgtctgtgtactcatccctggaacttatgaatatggtagcattcatggtttggttctgtgtccccatccaaatgtcaccttgaattgtaataatccaccatgtcaaggatgggaccaggtggagataaatgaatcatgggggtggtatcccccaggctgttcttgtgatagtgagtgagttctcagaagatctgactttttttataagaggcttcccccttcactgggcacccattctctctcctgccaccctgtgaagaggtgccttccgccatgatgtaagtttcctgaggcctccctagccatacagaactgtgagtcaattaaacctcttttctttataaattactcagtttcaggtatttcttcatagcagtgtgagaacagactaatacatcgcaacgggagtttgcagaaatgagtaggttaagggtcttgaggtggggagataattctggactatccaggtgggtccagtgaacaagagaaagagagagagagagagagagagagaaagagagagagaaagagaaagagagagagattgaaacctgaaggttactttgctggttttgaagatggaggaagggacctcaagccaaggaatccaggcagcctcaagaagccagaaaagggagaaaagaggattctcccccacagcctccagaaggaatgcagccctgcgacaccttaactttaggacttccgacctacagagctgtaagaaaataaatctgtgttgttttcagccatgacatttgtgataattttttacagcaaccactggaaactaatacacatattactgaactgtgagaggtagaggaccactagcctgcattttctcatagaagctatagcatagcattaataatagtggtaataataattgttccgcttaaaaattagctaatgcttgcaaagtgcttactatgaaccgggcattgctaggctgaacatccaacatacatagtttccttcaattcaccaaggtaggcactcttaaaaaacacccatttaatagaagaggaaagtgagccacagagaagttaatttgctcaaaattgcatagctaggaagtgaactctggctagggtctaaacctagacagtctgagccttgtaacctacactaaaataatggtgtacagtctatgccacataatttttgtgtttgattatatgctttagttatattactacctttgctgtcataggcccattagggtattatttaatgtagtcactcatctaaatcttcattcccctcttcaacggctctacccagtgctcatcactcttctgctggagctgggagtggtggaagacctgaggttttcctctaggtagaaggaactcccattatgaacactcaagagtaattctcaacggatcagaacttcctgagagcaggacactctggattacctgagaagcactcccagtctaaccctttgacccactcaagagatgtcctatgtcttagagggttctgccctggccctcctctggccacacccctcttcctggagcaaagagtctgtggagctaaaaagctgcacccacaacagcacatgcttgcccttcagactatgccccaggcacctgagccccagaattccctgcccaaatggcctgggcttgattcagggcttgtgtaggcagcttcctcccatctgtccttctgagagtggactgttccagtgatgtgcctaccctgagcccgaaggctgcctgaagggctgccacatgtaggggatgtggatgaatctgagatttgtgggctgggtgtctgcctatgtgtgtgcagagaaccttctaggcagggcagagctagacaagagaaggggtctgggctgactctcccagttccactaagttctggtaaagaattctgaggggtcagagaattctaagttagaatctggcctctaaggtccttatgaaggtgtactccttaaggtaagaggatagcatgtattttatttaacagcttgctagtgtgatttagaatttttaaacattgagatgagggccatgtgaacccacacttgtcttcttatcccaggtcctgcaaatgttaggactggactaaccactccctctcaatagagggagagacagagaaaggccaggtaatgaatagagtgaaaaatgtacattagaaaaatgctctttcaaaaagcctagaaagaaatatagccaaacattagcagagtctgcaatgtctgagttttggggttatggggatgttgttttatttcacttacagatatacacctacgtaagcagctttataataagaaaatatttgtttatgaattcaaacttatgaatattcaataagttcccagtataatgtcagcattagactaggatgaaaaaccaaactaaaccaaaccaaatcaaaacaacaaatcttcaagacatgaaaaagaaagaaatggagaaatatggattgggtaatgaagaatgtatcctcttaggcactttcattaacaacttgaaaatagaccttgacagaatgatgacctaatttctatatgctcttgaattggatggtctatcggaaacagaatcaggattcaaaaacatccccccaccgtctgacatcactgggtaatctaacaagattacagaaccgacttttagagaagagtttaaatcccagtactagaatatatgtaacagctatattggctgtgggagttatagcttaacagaacatgtgtcataaagataattaacatacaataaatgcatctatgaaagattaaattaatctaaggtaacactaatagaaaaatacagcataaactgaaggtgtggatagttttcttttgctatgtggtggcaagacctcacctggaatctgtttaatttcaataccaactttgggagacattaaaaaaaaatactgaagcctatgaagaagaagttctctctcatttgaaaaatttttgaaaaacctaatctagtattttgaccatgttaagaaggaaggacacatgcatgtttggaccagggtgttttgtagagttggtaatcttcttcatggcctgctttaatgactgaaggataagcccttcacagaaggactaaggcttccaagtaccccaggacaacagagggaggttgattttagctagatataaagaaaaacgttgtaaaaatcagaactgtttgaaaatagaatggatgcctttagaagagagcaagtcttacttgcagaacgtgttgggagtttaaggaaacccaatccatgacacctactatccctgtctcagcttgaaaagaaaaatgggtcaactaatttttgacaaaggcaccaagaagacacaatggtatctggataggataatatcttcaataaatggtattgggaaaactggatatccacatgtaaaataatgaattgaacccttagcttgtatcatacacaaaaatcaactcaacatagatgaaagaacttaacataggacctgaaatcataacattcctagtagaaaacacagggaaaccccatcgccttggcaataactttttggataccacaccaaagctcaggcaacaaaagtgaaaataaacaactggactacaccaaactaaaaagcttctgcacagcaaaggaagcaacgaacagaatcaaaaggcagcttacagattggaagaaaatatttgaaaaccatgtatttgataagtggttaatatccaaaatgtaaaataaatgcctacaactcaatagcaaaaaaccccaaataacctgattaaaaaacggacaaagagcctgaatagacatttctccaaaaaagatataaaaatggccaacaggcatacgaaaaggtaatcaacatctctgaccatcagggacaggcaaatgaaaaccatgagatagcaacttatacctgttaggatggccattatcaaaaagacataacaagcggtagcacgggttggagaaaagggaaccctgacatgctgttggtgggaatgtaaattgttgcagcctttatggaaaacagtacgaaggttccttaaaaaataaaaaaatagaactatagcaccatatgatccagcaatctctctgctgagtatatactcaaaagaagtaaaattagcacctcacagagctgccttcttatgttcactgtggcattatttacaatagcaagatatgcaaacaacctaagtaagcatcaaaggatgaatggataaagaaattgtggaatatattatatacatatatattagggagaggggagcattatatatatagatacctatatatccataaatttatttatatacatatatatatataaaatggaatattatcaagccttaaaaaggagattctactatttttggcaacatgtattaacctggaggacattatgctaagtgaactgagccagacacaggaaaaagtactgcatgatcttacttacatgtggaatcttaaaaaaaaaatgtcaaatatatagagacagaataaaatggtggttaccggaagtggtggggggaattgtggcagaaaatggggagatatgggtcaaagcatacaaagttacaggtaggacaaatattctagaaatgtactagaggactataattataatattgtataatgaaaatttgcaaaaaagtagattttaggtgctattactgtatacgtatgaaaaaagtaaccatgaagatgataagtatgttaatttgcttgagtatagtaaccacttcactatgtataaatatatcaaaatatgttgtacaccttaactatatataatagaaaaataagtaaataagaaaggagagcaggtggagtggcatttttatatacaagatcgctaggatggagggcatgacttgtgtatgtagactagcgggttttctaatatcaaattttatgcttgtggaaatctatccacccaagcttaggcagagccagacttcctcgaaaaacagagcagaatataagttctctgcagagcatctgctaccaagaaaaaaatgggcgtggagcatgatcagtttactctttccaaacttaccagtaagtcactccacctctcctgtggtggcatggatttgtattatggcgccactgtttactagtaccatgtacaagtaaatggtgcagtcatgtgaggaatgaattggctactccacggaagtgcccagcacagggcctggtgtgtaatggctcttcataactcttaccttgttggctaccccatagttattctccttcatcttgtctttcctgctccaaccatagaccaagcctcttgtttcctataagattgagactggtaacaggagtccgtggagcttgtgaacttggatgggaattaattatatatttaatatcactaatccctacctgaagtttggtgtttccttcagttataaacataggtatgaatatcagtagtgttagtggtatctgtgacttagtcatagatgagaatcacagatatcttcgtatgattttagagcagctgtagacaccttgaaataccaactatgttcaccattactttttttttttttcggcaatggagtctcgctctgttgcccaggctggagtgcagtggtgtgatctcggctcactgcaagctccgcctcgtgggttcacgccattctcctgcctcagcctcccgagtagctgggactacaggcactcgccatcatgcctggctaacttttttttggttttaatttttagtagatactgggtttcaccatgttggccaggatggtctcgatctcctgacctcgtaatccacctgcctcagactcccaaagtgctgagattacaggtgtgagccaccacgcccggcccactattacttatttttattttttgagatgaagtctctctgtcaccagactggagtgcagtggcgcaatctcggctcactgcaacctccgcctcctgggttcaagtgattctcctgcctcagcctcccaagtagctgggactacaggcatgcaccaccatgcccagctaatttttagtagagacagggtttcaccatgttggccaggatggtctcgatctcttgacctcatgatctgcctgcctctcaaagcgctgggattgcaggcataagccaccatgcctgacccactattacctatacttatagtagattgcatgtgatcgctgctgtcctatcaactggtgtgatggagctgccaacttgggggaatgcagtcacctcttcccacactggtgacccagacattcacgttgctttccagtattcccatttgcgatttgtttttggtcatcacgaggaaggagggtactcattctcatgcatggtttattgttcccaggtaaactcagcaaaaatgttctttgcactggtatttctttaaacaataaagttttactttaacttgctatattttaaatgcacggtattgacttgttatttttatttacatatatttttgagacgaggtctcgctctgtggcccaggctggagtgccgcggtgcaatacaacttgccgcagtcttgacctcctgggctcaagtgatcctcccacctcagccttttgggtagctgaggcatttttgtattttttgtagagacagggttttgccatgttgccgaggctggtcttgaactcctgagctcaaggaatctgctcgcctcggtctcccaaagtgctgggattacaggcaagggccactgttcctggcctgacttgttatttaattcattcataaagaaacacatattaaaaaccatgaatttctttttattactctgataactgcattttcctttcaatcttatatattttatatatttaaaaatattattcaagataggctggtcgcggtggctcacgcctgtaatcccagcattttgggaggccaaggtgggcggatcacgaggtcaggagatggagaccatcctggttaacacggtgaaagcctgtctctactaaaaatacaaaaaaattagccgggcgtggtggcgggcgcctgtagtcccagctactcaggaggctgaggccggagaatggtgtggacccgggaggcggagcttgcagtgagccgagatcgcgccactgtactccaacctgggcgacagagtgagactctgtctcaggaaaaaaaaaaaaattattcaagatagtgtccaaactgttcatcaaactgccaaatggatctctagtacaaaatggctaaaactctttcccaggagtgtgagaatgtatatcaggaaaataattacatcctaaaaaaagctgctgcttctgatgtgtggggaaatcaacatttagggaattcaactgtttttagtaacttccccccgaagcttttgtttgtgggattactatttacaactgtaattgggatacattttcaaagaaaacttggctcaaatttagaactcagacacttaagacacttttccttgagaaaatctaaatatttatgcgtctccaactcactttcaaaaacattttaaagcttaagatgttattgagagttccccactgttgatgatggtgattaaaaaggccattaaaaatggctcccaggaaaagaacagttgtcaggaagtcagggcagccgggaggcagaagacccaccgatttgtttctttgacactggcggtttagtcacacagtgatcgatttctgagaacactggagatgtgctggaattagtgtggaatttctacactctttggctctgactgggacattccgtcattacaacgaaatgagactgtgctttgctgtctcgcatcctctgtgaagacgttatccagcatgaaaaggaaggcaatggaaaccgagagccagcatacaggagctgctaacagaaaaactggtgggcgagctgaggtgaaatggcttggacacaaaccagtgcatgcagttctaatgaggcagtaaggcaggcacggaagtgcgcatgatgtcagctaattaacttggatgatgttggagagtgaggtatcctgaggaaaagccaacagcacttaactcaccagtgtggttaattatcagagaatgctgttcctgtgtagtttcctacccagcattttgaaaagatatttggctttaaaagtattaaaaacatgaagtgactcttcttgcaggcgatcagcagcttgtattggtgatggaaaaaaataatgggacttggccaggcgcggtggctcacgcctgtaatcccagcactttgggaggcccaggcgggcggatcacctgaggtcgggagttcgagaccagcctgaccaacacggagaaaccccgtctctactaaaaatacaaaattatccaggcgtggtggcacatgcctataatcccagctactcggaggctgaggcaggagaatcgcttgaactcaggaggcagaggttgtggtgagccgagatcacaccattgcactccagcaacaagaatgaaactccatctcaaaaaaaaaaaaaaaaaatactggtacttttccttaggataaggttaatgaatcaaggtgatgaagatggcctttcttaattcagttgcagcatagaagaaaattaactttgtttggtggataatcattggaagtgtgaaaggataagttgttttcagaatactttttagaaataatttttagttttctgtatcacaaatgggaaattaggaaaattaaatagatacatcatgttattagaatgcataagcattacaaatgtaactatcctgataatggtagcaaatatattgaagacggctcatgcaggccttccttgcttcccagtattatctggaggggaagataatcagcctggcaggatggaatagagagggacaagatggcgaccagtctccgaagcaggaaagagcggcatgaaaagtggctttaaatcaacagatttgtgtaaagtgcaaatgaacggttgtacctgagctgtatcacagtgaactaatttaacaaggagcagttgcaatgtgttccattttagctattctgaggacaataaaatgacaatatacacaggcagattaaggatgtctctttcaagatttggggcctggttgatttactcataaatcaaatgacaatatgatttattgttcatctgaacaaatttgagagtgaaagggaacatagtagcagctactcctgaacaacgggcataaagcagcttgcctcgggcaaactgagtagtgtggctcccaccacttctcatgctatagttccacaattatgtgtctctttttcacatgtattatgcctctctttacagtatgatttccacgggaatgtgagatttacacattgtagatgcagaattatattattgcacttattaataaaataacacaagtagataggacatacagtaaaataattactgtttaccatcagtatagttacacatgtgataattgatctacaaaatactttccaaaggattatttcatttaactctcaaaatagctgttatgtggcttcttcaaaaaattctgaatgatgtggccagccaggtgcagtggctcacacctgtaatcccaccactttgggaggctgaggtgggtggatcatgtgagtccaggggtttgaggccagcctgggcaacatggcaaagccttgtctttagaaaaaaatacaataaattagcctagcctgctggcgggtgctgtagtcccagctactcaggaggctgaggtgggacgatcacgtgagcctcggaggttgaggcttcagtgagctctgattgtgccactgtactcccagcctgagtgacagagtgagactttgtggcaaaaacaaaacaaaaatgatgtatcaaataaacaagtaaataagttttatgtggatatactaatgcaatgatgcagctatagtcatcatataaatatgtaattcattaaacaaataatgatatttcataaaatgaaatactatagaacaatgaaaacaatttatacatagagtgtaacaatttggatgaaagaaaaaagatatatttgcttatagatgtgcagaaaatttctggaataacaacgctaagtggctgcctctagaacctgtaactgaggcctgaggacagggaactaaatcgttctgtatgccgtatgattgttgtgtggtaggtgattacttcgcacaatgatgacatttgaaaaatagcatcattatcactatatttagtacgtacatgcccataatagagcagttcataaaacactatctacgcattcacatgtataataatactaatagtttaaaaagtttcaagtgtgggtatgtatcctaaaatgcctagaaagataagtaataataagtagtgagattcctgatcttactggtttttgctttttatgttaactttctactttttcattttgcttgaatgtgttataataatacatttatattttataatcagaacgcaagcagcaatgccacttccatcttgaggaagtgtaatgagggaaccagcaatgctggtttcagtgtctcagtttggctggaaaggatttaatcctgacgctgcaacattaactttctgagcatatgctctgtccccggggaagacgacagtcaagggaatcttgaacttcttggaaaataagaaaattaagggcttcttttaaaaggtaagtgattttacttttgagcaatttggcttggctttgttttaggagaaaactggaatcttacaatgtagccctctgaagggtggcttgcacaaagccggggtcactggggcaccccctccctgtattgtgacagtgtggggctggtctccaacttccctagcctctgctttccaggtgcaaggtggaaatgcacttcccatctcctttgaagttagaccaggccacacgatttgctctagacaaagagttgtgagcaccagtgacaagtgtcatccaggtgagagctttaagggccagcacacaattccttgctcccttccctctggtgcgggatcatggaagcccaggtgaaggtgagcctctgtcagcctcggccttgatgaggagggcagccttcagccgtgtgcaggccatagcatgagcgagaaatgaacttttgttgggtgaagccactgagattttggagtatttattatcactgcagcgtttcctatctgatcatgactatataatttgtgaagcccagtgcaaaacaaagacacagagccccttcttcaaaaatgatttagcatttcaagatattagcagtagagcctcaaactctggggggccctgtgagtatggggccctgtgagtatggggccctgtgagtatggggccctgtgtgactgtacaggtcgcacactccaagctggccctattttcctattccaccatcacaacaatcctggaaaagaatcttaattctcttatttcacatatgagaaaattgagagcttaaacagcttgcttaaaatagcagactcacaaaatgccagaagcgagagtttgattccattggtattaataacactgcgatgatgggtcttttgtgcattcctggttctgggctttggggcacaaggagccaagtacactattacaggaagcagacaagactcaggaaatatcgtctcctttgtaggaaatcacctaactggaaccttcaatggaaggtaagaaagagttaacgtctaacccattacatgctaagtgaatgttttctcttgccagaaagtataattagtaatttcaggccttatctgaaatacctgcctcagcacatgctgaaagtatcaataaagaaaagcaggcaccgcttttaatttcattgctataactaattagcattagagaaaccattttcataagcagtgtgctaacaacccattggtaactggaaaggaaagctgatggtgcagctttctccatggtaaccgggcaaggagaaaagcgcttcacagccacgaagagggggttcctgagggaagcacgagacgcgggctccaggcagcagcacgtggaagtgggcaggcactgcccctgacttcagatgccacaaagaacattggcatattccagtcaagggcagtgttttgaactgaaaatattacatgccaccatagaactgttttctacatattccttaaaagctattcaaaccgtatcaagatttttttagaaagggctctaccaattaaaatcacattggtttttcctaaagaattcctatcaactctcccacccaacatatcctacctctgtacccagtacagggggcagaaggcatcaggaaaagtaataaaaagaacctttggctgggcgcgttggctcactcctgtaatcccagaactttgggaggcagaggcaggcggatgatgaggtcaagagattgagaccatcctggccaacatggtgaaaccccatctctactaaaaatacaaaaaattagctgggcatggtggcgtgtgcctgtagtcccagctactccggaggctgaggcaggaggattgtttgaacctgggaggtggaggttgcagtgagctgaggtcgcaccactgcactagaacctggcgacagagcaagactccatctcaaaaaacaaaaaaacaaaacaaacaaacaaaaaaacaaaaacaaacaaggaaaaaaagaacctttgccgcacaaagagggtaggtagtgaatctggtaattttaaaaggcagctgtcattaaatcctgagtttcaagatgaaatcctatcactctgtttgagcactttattattgttcttactgattgtgccctagaacacattagtgaattggcacaattcctctgtcattttcttctcttcatataaacttagtttgggcaatttttcaaagaaggaaggaagaaaggaagtaaagaaggaaggaagggagggaggggggaagccaaaagaaacaaggattgagtttgttggagtcactttagaacattagtgccacactggtccataaatatgttcattttgcggggggtgggggagactgcaacaacatcatactgtatcaatgatgaattcagcagtcacttaaaatgaaaaatgtaggtggctttcaaagaaacaatctcaagtaaaattgttaacaaaatttatcaatttttgaaaactgtatattcaaatagataacataaaaacaagaataatttaaagcatgttactcaagtagatttcacaacaaatgatacatttaaagttttatggctccaatattaatgctttaggaactgtgtggcaaacatttactaaccaggttctcatgacctattgactgtgtgaagaatatttgtcagcatgccagcgtgcagtgttaggttctgttaggatcaaaacaatctccctcaggaagcttatataaaaagttgtccttgtccctactcttaggtcaagaaaacattgtcatcaatatgaatatgaagagatgcatgaaataatatgactaagttctttaagggagaaagccgccatagattagctagttagtttgagaactggcttttaaatacatactttctctacataatttggaatgttttagaaaacaaaatgggaacaaagtacaatgcacattagctgggcagggaagcatgaagaatgctttctatgttacggctaattccctgcaagctagcctgactttcagagcattcaactgagtacgtggctgttctccaccatgaggccagcacgtggttaatgaccccaattctggcattgtttctgggtcttgtttttttctgcacaaaggttaattgaatttttacaagggtttcctagaggacttgcacaactttttggtattaaaacaaaaggccatcttataatagacttacaatatgactttcataagcactttaagtattttagcttagactttagtaactgtggcatatttaatgtttcatagctttttgagaatttccacagacattctcagcatcttcactaaatttaatcacgaagtctggcagtacagaattcttccttctccctcggcttctttttaagtttgagagtgaatttggttttgtaaaagtatgctagggagaagatgcaagggacttctcagcaatttctctctatgtgttctgcagataaatgttctttccggctcgtgacaactaacaattgtgtttcaaaaaaaaaaaaaaaaacatgcattgttaatgagacttcgccagagatgcttagagttaggtgaaatagagataactattttcatagctatgcattaattgactgaattggctttgtatttcaggccaactccaaagcactggttaatagttataaaaatgtttcacagtgctccatgtcggcttccccctgaaaatccatgataaagattgagcgtggttgaaaggcttgtcatgcgtaagtgctaattagccccaggatgcttgccttcatgaactttcaggcctcatctataaggtcaggaaaggggtcatagctcatagaatatggacttgcattaattcccagcgtataaactcatggatcctccacagaattcactaaacttcaataagctacaattctatccttacctcacatgtcacatccctaaaggtgacatctacattaatgcccctcatccccaatagagagcacattggtagctcaaataggctattactcactgtgacctcttctacttatttcttaaggcatgggagtggcatagtgagatcctggcaggagcactgttcacaatagcaaagacttggaatcaacccagatgcccatcattgatagactggataaagaaaatgtggtccatatatatcatggaatactatgcaaccataaaaaggaacaagaccatatcctttgcagggacatggatgaagctggaaaccgttatcctcagcaaactaatgcaggaacagaaaaccaaacactgcctgttctcacttataagtgggagctgaatgatgagcacacatggacacatgggggaacaacacacactggggcctgctggggggttgtggggagggagagcatcaggaagaatacctaatggatgctgggcttaatacctaggtgatgggttgatctgtgcagcaaaacaccatggcacacgtttacctatataacaaacctgcacatcctgcacatgtacccctgaacttaaaatgaaaagttgaagaaaattttaaaaaaagaccctgcctggcagggtttcagcttaaagaaaatttctgggttttgcacatggccattttctgaactcctataactggcttttgaaccaaagtcctcttggaatgctgagacgcactggaaacctctagatgggccatccagcctgaagaaagcctttcttgttgctgctatttgtatcattatttcctttactaacaataactaagatgcactgggtacgttacgtgttagggagcgtcccaagtgcttagtaagcatcgattagtttcatttttacaaccatctttgccctgtgaaataggacatgggattcactctttttaaagatgagacagttgacacttgggaagcttaggaaggtttcccaaagcaagctgtgggtacggacggcatcagaactaaacgcagggagtctgactcagggtgttcaatctcagcactactgaagtttgagaccaggccattctcacgggcccgttgtgggcactgcatggtgtttggcaccatccctgcctctacccgctagatgctagaagcatccccctgttgtgatgaccaaaactatctccagacatgaccaaatatcccctggggacaaaatcgctggcaactgagcaccactgctctgactcaaaggtgtctgctcctaaccacctgcctctcaaaggtgtctgctcctaaccacctgcccctcaaaggtgtctgctcctaaccacctgcctttgctgccgccggcttccccctgcttctttgaggcaaaaatcaggtcggactagcatcagtggcaaaggaaccagtcagatcagctcatgtgacagctttgacagaccaagcattttggtcacatattagcttttgagaatcaatatgcataggctggaatgacactttcagtaaatcaacattcaggctataacaaacctattaatattctggggaattcattgtgtaccgagccagtcattcagatgactatatgccttaggtctttttatgaaataaattagatttaatttggtaggctaggcagagtaggcagagagtgccttgcatttcctggttatactagtgtgtggtgtgataaaaaactgaataggcatctccatcaaatgattcctgtaatgtccccattggctcttttgaaataaaacctgtgtcctgtttccctcttcctaattcaccttgctcttgcctgtgttctataatggacaatgtgaacactcagacagggctgattttctaatcaatggtaacaactggagttagaaatgaaaatattatcatagtaaactatatttattttaaagtccataggctagttttcatcccctcccaaaccactctaatttatataggagggggtcaaagtttagaggaatacgaagatgtttctaaaatttagatgcaatatgtataagagagaagcttctacttgtgatgaattagttagaaatcaaaatttttttggacagattcacttgagagaatgaagaaaattcaagtagagagaggtatcctgagaaaaacagaatattttagactgaactgggataatctggagacttagaacaataatatataaggctttatatattatatatatattgctttatattgaaatttcatggaattattttagctcttaaagtataggaaaatcagttaaagatggaaacactgatgaatctaatgagaattttaaacatataagtttatttatcttaaactgtaagattctattaggctttaagactataattttatggactgtgaaagttctaaggtcccttaagattatgtagaagagatgtttactttttagcaaagaaaatattgtccagaaacccattttttagaaacagataaactatttatttttaataaattaagcttatttttggtgaacacaaacttttgaaatttagttttgtgaaagacacatgtaatcatgtattatttcgttctttctatatttcattacgttgcctagatcaagcaaacactgatatacccagataagtgtggcaaacagttatgtgttttttttaaacacctcattttacaattttgtaatgcactttattaaacagaaactttagctcaaggctgcacaaaataatgaattttcagtttctgctaagagtatgtatatgttgtttttgtttctaaatagtctatgatatatttaaaaatgaaatttgaagtcagatttcatgcatagaaccataaggattttaggaacgtgttctgacaagcagtggtgtgaatacagcttctcacataagaggtgagttaacagaggctcggagcagataagtcactggtgctgagtcacaggctggcagagcaaggatcagaatgcaggtcctctgccttttaagcctgcgttctttttggttcacactgcctctattattaaattacttaatttatcagagcaaaaagcaaaaccttagggatgctattagcaatttactatttccagttcttttgggaatctgttaattgccctttcataaatgctgctcattatgattaagactttgattaaatgtgaaagtctaggatttatatgttacagacatatttaatattaatttaaagcaccagagcagaatgaattgtgcattccaattttttagctctatcatacactctttaatcaaggatttttcaagaacttgctttgtgctagcaggacctgatttttcccctcaggaagctcacagtttaattaaggagagctcatattagtaacaatgcacatcagtgtctgagtaagagtttaggggaggtgtagctcgtcttcatggaggttaggggcaagtgagtttagtgaataggtgccacggagtgagacggggaaagatgggtgtcctggttgaggggcgatgaggtaagaatgactaatgcttatgaaccattgcctgataaacactgtgcccaggactgtatatggatcatgtttaatccaaaagcaattctgagtgaagtcctatccctcaaccctttttacaggagaagacattgaggcatagacccatgaagtgggcttgctcagtaacaactgctcagtgaaggggctgggactcccagcacttgcctggttcagatcacactactgtctccttcctatactgccccttcgcccatctgtgtgagccaaggcaaggaagacagtctggggcctgtgggatggcaaaggaattttctagaactaagagtgtgtgttgggaaggtaatgagatgggtttggaaaggttagtttgggtaaagcttgaaaagccagaaaaaggattttagcccatgttctaagccttcaccattttgtagaccatcttattcacattttgatggtcgcttaggtaaactaagatctattttagacttgcaaacaactacaaggagaaattagttgaataatattaaatattgactactgatatgataatatgtgtattcatgtaggaggtaggggttgtgccttcttttccattcattcagaaaaagcgcctatggaggctcgcgaatagagaggcaccatgctcattgctttgggcataccctgcctccagcatgaagtctggcactaggaatttcccattaatgttcagtgaatgaatgaatggaatttcctgccctgctccttgcctccctcccttcccacctccccctaccttccttcctctttttcttccctcccgtcattaaacacatatttactgaatacctacaaaacttctatgactaaaaccaatgagattctcccatgaaatggggtggagagaggggaaaggcagaaaataagcaaggcaattgaataatgtaattccagttagtggtaagtgatgaagaaagcagggctggcttacagggtgagatcgtgcagtggttggggaaggcatggtctaagcaggcctctcctgggaggggacacctgtttagagggctaaatgaatggaggcagccatgcaaaaagctgaaggaaggtcctccaggaagggagagtcatggccctaggaagaggacaagtctgcttcatttagagaacaccatgaagggccagggtactggagcattgtcaacaaggggaaagtgatcgggccgaggacagaaggccaggtcacataggtctttgtagtgtgagaagaactccaaattttattctccggagtggagctgcttaaactgttagtataaattataatggaatttaagtaatgttcacagaggagcagagaagataacagagaccgagaaggacatctgaatttattatattttaattaatttttttagagatagggtcttcctctgccacgtaggctgaagtgtggtggtgccatcatagctcactgcatgaattcctgggctcaagtgatcttcctgcctcagcctcctgagtaggtgggactaaaggcatgcaccaccacacctggctaatttttaaaattttttgtagaggtggggtctcactatgttgcccaggctggtcttgaactcggcctcaagtgatcctcccaccttggcctcctgaagtgttgggattacaggcgtaagccaccacacctggcataacaaggaatttttgacagtgaatcttgactactaagagactaggggaccatgaaagaaaacagtacattaaccaggaaaaggatggctgatacattgaatgatgaagaggaattaaggcaatggaaaatagaacacagacccttggagatgaagaggtcacgatttaccattggctgataacctactgtgatgacatttctcaggaacgaggcgactagaagaaaaacatgaaagaaaagggggctaagagttttcagaattctcacaatactttttaaaaagagtctcaaaaatcaaaaccagttttggcatactgatttctaagacataattcactctccttcttcctatccctcccttccttccttttcttaatagaaattgttttatttatacattttgtattttagttgccttgtcagttaagtgattacattcatactggaaaaaaaaaaacatgggcaatataatcataaaaatacaaatttctggccgggcacagtggctcatgcctgcaaccccagcactttgggaggccgaggtaggtggatcacctgagttcaggagttcaagaccagtctggccaacatggtgaaaccctgtctctactaaaaatacaaaaattagccaggcatggtagcacacacctgcagtcccagctactcaggaggcgaggcaggagaatcacttgaactccggagggcagaggttgcagtgagccaagatggcgccacttcactccagcctgggcgaaagagcaaaactccatctcaaaaacaacaacaacaaacccaaaacaaaaacaaatttctatatttaaaaatgatgtatgtaataatttttttttgctatacttggaacttttttttttaacctactagggatctaatacatgaattatttatgcaggaattcctagattgtcattactacaacacttatggtatatttcttccttgaattgttgagacctgatttattaggtgaaggatgacattgttttcaagggaaaggaatgctgttaaaaaccaagctgttatacaaaggctttcctccaggctctgcaggaactccccagttcttggcttgttgctgattatgctaacaccaacttctggattcatttgagttccgatggctcctgccatactgctcccaattactttaagctgggcatccaatttccacagtaactcctgggttctccttgcccatctgttcctgcagtggcatcaagccccataaagaaggtagctgttaggatattccaacttaatgtcttaccaggaggacctagaccagcaattacaatacaatgacgtaagcattttcctcctctagtcaagttgaagaagaaaagaggagctgacaaacataaggccaaggagtatccctggtcacaaaggctttgaactcttacccaggtgtggagagccatctttggcatgctcgctcccagcacaaaagtgccatggcggtggtctgtccctctaatctacgtaaatctctctacttttctttcttgcttgcttgcttgcttgcttgcttgctttctctctctctctctctctccctctctctctctctttctttctttccttttttttttttttttgagacagagtctcactctgttgcccaggctggagtgcagtggcatgatctcaatctcagctcactgcaacatctgcctcctgggttcaagcgattctcctgtctcagcctcccaagtagctgagcttacaggcaggcaccaccacgctcagctaatttttgtatttttagtagagatggggtttcttcatgttggccaggctggtctcaaactcctgacctcaggtgatcctcccaccttggcatcccaaagtgctgggattacaggtgtgagccactgtgcacggccagatctctctacttttcatagatacagagagggtttggctgtgtgtccccaccaaatctcatgtcaaattgtaatccccagtgttgactggattgtgggggtggggttctcatgcttgtgtgagcaccatcccatcggtgctgttctcgtgatcatgagtgagttatcgtgagatctggttgtttaaaagtgtggtatctctcctccctctctctcttccccctgctcccgccatatgagatgcctgctccccttttgccttctgctgtgattgaaagtttcctgtggcctctccagaagccaagcaggtgccagcatcatgcttcctatccagcctgtgaaaccatgagccaattaaacatcttttctttataaatcacccagtctccggtatttctttatagcagtgcgaggatgaactattacagataccattgcctgtgttcagatttctttagagtcgagcactttcagttatatatcagatgacttcaagatcttttgaaatgatttggttctcttagaaaacttcgtatggacagttgggtaggtggctgggctgatgggcagggtgatgcctgaaggaagaaggatcgtactcattcatttccccaaggctttctcgattgctctgtgaaccacacagggagcgtgagagggcgttgatggggtttgtttcaggatgctctactgcacctggctgaacatcgtttgttgggttgttcttgttagtccaaagggagagggagtctaagagtataatgtgagttggaatcttggagaaacaacttacaaagcttgtgatttgggcaaatccactctctgcacctttcagtgctggcatattaggtaaagacacacatttcagagtggcatgtagagaagttcaaatcccagccatttcatttgctcctggaactttgtacgggaaagtgacttaacttccttttttttttttgagatgaagtctttctctgtcacccgggctggagtgcaatggcgcgatcttggctcactggaacctctgcctcccaggttcaagcaattctcctgcctgagcctcctgagtagctgggattacaggtgcctgccaccatgcccgactaatttttgtattttttagtagagatggggtttcaccatgttggccaggctggtctcgaactcctgacctcaggtgatccacccatctcggcctcccaaaatgctgggattacaggcgtgagccaccgtgcccggcctatgacttaacttctttaaccttgttttttatcctttctaaacaagggtcaaaacattaccttcctcataggattgttgggagaattaagtaaggtaaaactcataagacatataagaactgccatcaagtaaatgctcagtacatgttagctgtcatccatctcgttgttgagaaccaaattaaatatcactctataagtgaaagcactttgttaagacctaaatcaatgttaattattataatgatgaggttgagtattgcttcatccttgatgctactctcctcagtaactttgccaatgatttaaagatgtagaagctattcttgtcagatggatggcacaggcccggggtgggtctcctggtaggacaagaccaagattatggcctatggtcttggacaagaccaagattatggtgacagttgaaattgataaggggtaaaagtaaaagtttcttttatgttcaaaaatgaggtgcattaagaactcctgggaggagacccagcttggaagcagtcaacgtgaaaagttcctgggggttttagttgatggtcagctaatgctgttttgggctgaagaccagaactgctaaattccatctctaatcataagatagttgaaattttgtactttgttctagacaccacatattaggagggccttattatattaggtagaaagaaccttggcaagtcagtgttttgaaaatacggtgggtgaaggacctttaaatgtttgaagttgccatctaaaacaaggattatacatgcttcttgctagcatggaaagtgaaactgtgacagagaagtgggtactggtgagagaaagaatataatttcacaaaagaaaaaactcagtagtaatctctgcagccaaaatggcatgcattgatgaacgtggtgttcccagtggatctgagtagaggctggtgattgtgggaagattctcacactgggtgtcatgttagaccagctgacctctaagggccctatcatgttttatgattttataatatagcaggctgtacagaccatttttaatatagtcttaatttttataaaaatgtattcatgcatatatacatagttataaaacataaccgttaaattctagttaaatgccaccaaagataaaaataataaagtagcttcaaattgtacttattgcaaggtgacctatctgaaatgtcttcttggtcatattataagaggacttaagatgccaaaggggaggatcatagcctattcatatttccatctcccacaaagtgtctggcacacatgtaataattaaagtagacaatctttattgaatgttctcttgtttaaagaagtattttaagcccattatatttaataattcacttaaccatcaaaactgctcaataattttgacactatcattattccatttgacccatgaggacactggcactcactggggtttaaatgacttggccaacatcacacatctaataagtgccagggctgagatttgaactcagaaagtctggttccagagcttgtgttctttaccatcacactctactgcctctgctaatggaaggtactcggtcagtgtttatccagttgatgaactgatggatagatggacgaacggaaggactaacgggggttgcagcacagagtcgcctgaatatgtggcaatgaacaaagaagggcacagattacacgaagagcagatgcagaaagggccgatgagggagggacgctggcaacacctcagtcactgctcttctttgagttgattccgcatagagcatcttagggtgaaacagaacgacgtgcattagcacagagaagcaaaagcttcttctcttgggttcctcctcttcctttgcagaggagatgttttctgtcagaatgattagttagaagtgaacagtgaagtccttcaattagcattccttcaaaatgccatctgtaagtgactaaagaagtgacagccagaaggcagaacacagggctatctccgcacagacaagacaagagccgggaaggcagggacgctcgatcagccgtttccagcaatgttaacgggtccacccactaaactaaacaaatgctttcttcctaccatggagacagaaactgaaaaataatttttgacagcactgtatgatttagtgggtgcttgcagacacagcctatacttagttttataccatatttaatagaacatttcaaactttcataattatttggcagcttttaaaaaataaaaaataaataaataaatagcaaatgcccactgggttactcagtgcaatgaaaataccgtatcatcaggactttgtgatgtcttggcaactcttaccccaactctatccaacacctgctctccaggtaggtcaaggtcaatatacttgactacttcaaagcctcaacaaaaatgttctccatcaccatgttatcaggtgtccacgtcagctgagaagcctgactggtccttttcatgcctgtggaacaagggactgaatcttaaggagagtggagaccttgtgttacttacattctgcattcaagaaactatttctatgaagtttaatgatcaatgatgctttttccttcaaaactatccaaagatttcaaatctgtttgtgcaaggaggcactggattgaactgaatttctagtttcttcatcgactggttccttcattcagtaacaaaactgaacattttaatgtgctgatactgtgtgagagctttacacacattaactgatttaatcagtatgaaaacggtctgcaataagcacatgtattcccatcttacgggcaaagaaatgggctggagaggtttcaggaacatgctccagctggctgaggtgcatctgatgaactctgtgcttccagtgaacttgtaagatccaagtctccaggcgaacatcaagttcttctaggattcatccccagcctttccccagtcttctaggactcctctcccttgctccgccttgaactctgttgttgacatctttcttgccctctacaccgttaaacgattctagagtggtgctatacattggaaataaaatgcgagccacacatataaattgtattttaatatccactttaggaaagcaaaaagaagcaggtgaaagtgattttgataatatattttatttaccacaatatatcaaaaaatttatttcatcctgtaatcagcataaaaattactaataagatatcttatattcttctatggtattaagtctttgaaatctggtttgtattttacatttgcaacacacctcccttcggactacccacattttgagtgctccaaggacgctggctagtggccactgcattgcccggcatatcctaggggagggaaggaatccttagttgttaacgtgtcagacaacatgctatggctcatagttgtcctcctgatgtgtatcttctcctcccgatgtgtatcttctcctcccgtctgcagtataagaagccttcactgggcacgtgtctgccaggtacagactacattccctggcctctcctgcactcagggtcccatgtgactggatctggcacctgagatgtaaacgaaagtgaagcgtgccatttctgggttacgcccttaaagaaggcatgttcccagcccttctccttctctctttgtgcaagctggaaggcaggtatggtgccagtcaccttcaaccacctgagcacgctcaagggacagcagagccacagacgggagcttctgtttccttaccacagagccagccatggggaccatgtcctgagagaaagaggttcctgttttgttcacacaactattgttcatctatgacaagcacggtcatcttcatttactttcatcatttctagaatctaattccgtgctctcttggtggggttagacccaactcttccttcaggtctcagtgaagctttatttcagcagggaggcctttctaatgttctgaagactaggttacagccctcactccatactaccatggcaccctgagcttcccctttctcagcatccgtgcacagggttatttaatgttggtgttcgttctagacctctgtgtcatgggggcatgctgtgaccatcttctgggcacttggcacagtgcttagcacatagaagtgccaaacatttgttcaaagaataaatgtaattaagaggcttaacatgtaagtgatgtgctcttgcccttcccggtttgatgggaatacagaatctctttagattttcctggttcctgttagagagcatcagaatgacagtgcacacaggcaaggctagctgggaggatcgagtggcctgagtgtcatgggttgagttgtatcccttacaaagatatgctgatgtcctaacacccagtaccttggaatgagatcttctttggaaatagtgtcattgtggatgtaattagtcaaggtaaggtgtattagtctggtctcatgctgctaataaagacatactcgacactgggtaatttataaaggaaagagatttaactgactcacagttccacatggctggggaggcctcacaatcatggcggaaggccaatgaggagcaaaggcacgtcttacgtggtggcaggcaagagagcatgtgcaggggacctcccctttataaaaccatcagatcttgtgagacttattcactaccacaaggacagtatggggaaagccacccccatgattcaattatctccacctggcccagcccttgatctgtggggattattacaatttaagggatatttgggtggggacacagccaaaccatatcataaggtcataccaaagtaggttggctctaactgaaacatggctggcatcctcagaagaagaggagggagacacagcaagaaggtggccatgagatgatgggagcagagactggagtgacacagccacaagccaaggattgctggcaaacaccagaagccagaagatgcaaggagggattcttccccatgggtttcagaggaacatgaccttggaggcaccttgatttcagacttctggcctccagaaccgtgagacaacacatttctgctgttctacgccacccggcttgtggcactttataatggcagccctaggagcaaatacatcaaggcagaaaacccgtcacaaacctgctggcatgcccgttcctcctggctacgactccacagcctgttcccaggggtcagcccacaggccagggccaggcggcattgctggctagtggcctgcaggaggggcacttatcagtacttcctcactcccaacatgaaaagtcaggtaaagaagtacaggaagctctgccaaggagtggaagggatttgtacctccttaggacaacttcccaggtaagggcgagtggaggacagggtgtccccactacaggaagaaagagagacatcatcattcagctctcacagacattcctccttcaaaacagaccctctggcaaaggttatcctttaaagaaaaaaaagttcttgctcctctgtcttgaactgggaataaattaggagagataagagacagatattactcctttttaaaactctgtattcccattgaaaagagtcaagggtacaattctcaagtctgtgtgtgtgcacagtgcttacatgtctctctctctctctctctctctcacacacacacacacacacaccatatcccacttacagactgaatactttgcaccacaaagtattttcagctgctcttctcgctcctttccctttcaattcagaaggctaactctagctcaattatctcttccttttgacagaattcacatcaaatgcaaacaagatgagaccaggattctgcctggttctgttgccaaggtgggtgggaagtcggcagcagggatcagtagctgtagctgcttcagcctttgttgaggctaactctcctcccaaggtgtctcaaatagaaaggcttgttcctgatgctttccaattattttcacttcaaagaaatactttaatatatttagttcaaattgcatgatggtaattatgcttctaaatctgatcaaatgacgggagagaggaaacctttgcttccatgaggggatatttgttcttcaatagatgggtctaattttccacagtgggaggactcacaagcactgagactggcttttttcattagttatttataaagctcttattagattggttaaattcacatgtgggaaaaaagacaaattattgttaatcaatttctaacctatactattcataatttagctgatagaaacctctgctcaccaaggggatttttattcaggctgcaaatcagtatcatgttatagagtgtattaattaataaatggaatatttagctttttataattagtgtttgtatttattacatttgttatgttactcctctcctcaacgatcccattataattcctattcctcagtaaataaaagctcactctctggtttggaattcaagcctcctcccaacacaccacatgaccccgccgtgccagccattcacactgctcacagggtcttcagctcccttctccctgagagcttgtgggaagggtgtgctgtcctaacccagttagatgtcgtcaaatgccttgtttggccaatgaaatgtgggtggcaatgacatgtgtaacttgaggccagagcctttaatttctggcactcaactctccatccctcccaccatcctgcttcctgaaggaagggctccacctgccgaccctgatggagaacgaggtcacatcagtctccctgccaaccctattggacaggccttacgcgtgagaaacaaacctttgttgtttcaaaccactgaaatgttgaagttgtttgttactgcaacagactttagtctgtgctgactaatacatccaggatattctttgggaattctagcggctacattctatttttcaagtgaaatatgctttggaacacctatacataataaaagcagagatggtcatgttgaagagtgagatggggtgagtgtgtgtgtatggggatgggggaggattgagattcttctttatcttctactgaagcccccgatgctttgcaacctccgcacatttctcagaactcaggctgaaaccctgtgatctagtccaaaccaaccttcccagctagggtttcgttcaaaggtcacaactggtggcttgtgagcagggtctggacacacacacacacacattttttttttttttttggctcacagagtgcttgaaaagaatctaagacaacatttacagattgggagatcaacgtaaaagatgcatcctaaacttcccttgctaaagtgaagaatgaggacaccctgggcctccactccttcccttcagttgctatttgtcattacacataaatgtctgttgcatatagggaaatatttctgtcccatgtctctatcaaaagtgggaaagggctgtgtttttctaaaagtaagagaaagagtgtatttctttgtggagtgcataattctcctaagtatgaaagtgaaaagctaagatcagtgtttcccacccctcatttctctcgttcatgtcacctgttgcttcttattggctttggaatgtgggacctctcttctagcctcttgcatctacctctatggtttgacttctgaaaatgtggtccctggtccacctggatccaagttagctgagttgctcgtgaaaaatgcagattgcaggtttcatttcagacctactggattcgaggtggtggtggtttctgcattttccataagtaaccctttcccttgacaattcttaggcacaattaatcttgagaattactgctctgtggctgaggtcatcatatattcagaaccaagttctacgaatgggtaaagaatttttattctcttctagctttgaaagacccttcagaaggtagaatttggatgccaaaatgctatgatttctgaaatggtgtccaggaataatacaatgaattatttgaaaccgcagctgttcccaagattacagataaactgaacaccaagttgtcttctgaatgctgccctcactctcctccttccccacttttgttcatgcagtgtctttgccaaaagtccttcggccatgtttccttacaaaatctcacgcatctttaaggtgcagttgaaatgttaatgaaaatcaatgcatccttactattatctaaagtcagttgtgtcaaaacttttagaatttttcatttttcaatagagattatttttaaagacagtttaatttcacggcaaaattgagcagagtacagagagctcccctctcccctctcccctatacatgcacagcctcccccactatcagtgttccccacaagagtggtacatttgttataaatgcaaaatgtacattgacacatcatcacccaaagtcctcagtttacatgaggttcactcctggtgctgtacttcctatgggtttggacaaatgtataacatttatccacctctgcagtattatacaaaagagtttcatggtcctgaaaaccctcagtgctccacatactcatcctttcctccccaaacccctgacaatcatggatctttttactgtgtccagagttttgccttttctagaatatcatatagctgaaaccacacagtatgtagtcttttcagattggcatctttcactggtaatatgcacttaaggttcctctatgtcttcccatggcttgacagtacgtttctttttagcatggaataatatctcactgtctggaagtaccagtttatttatccattcatcgactgaaggacaccttggttgcttcccagatttgtcaattatgaataaatctgctgtcaatatctgtatgaaggtttagttgtatacataagttttcaactaattcaagtaaataccaagaagcatgtttgctagatcatatggtaagcgtatgtttagtttagtttttttttttctttttttttttttttttgagaccaagtctccctctgtcgcccgggctggagtgcaatggcgcaatcttggctcactgcaacctccgcctcctgggttcaagcgattctcctgcctcagactcccaagtagctgggactactggtactcgccaccatgcctggctaatttttgtatttttagtagagacggggtttcaccatattgccaggctagtctcgaactcctgacctcgtgatctgcctgcctcaacctcccaagcgctgggattacaggcaagagccattgtgcccggctgtgtttagttttctaagaaactgccagactgtcttccaaagagactgtaccattttgcattcccaccaacagtgaatgagagttcctggagctccacatcctccccagcatctggtggcatccatgttttgggttttggccattttagtaggtgtgtagaggtatctcattgttttaatttgcaaatgccaaatgacatatgatgttgaacatcttttcatatgcttttttgcatctgtatatcttttttcggtgaggtttctgttcagctcttttgcccatttttaatcttgttgatagttttcttactgtcaattttgaaaagttctttgtatattttggtaatagtccctttatccgataggtcttttgcaatattttctcccagactgttgaatgctttttttttaatggttggtctgtttccaggaatcagaaatcaggcttcacacccagcccagatgttcaagtggttgtttgacttgtctgccatctgcaactgtctctcttctgctttgtactccacgcctctcagatgctggagaaactggtcatttgttctctatagcatctcacattgtgaatttgtacaaggctcagtggcttcttgagccatgggttgtgtgggtctataaaccaaacagacaggccttggacagacaggggtttccttcaggcagcacagcctcagccacagcagcatcctgaggctgaggatgtaacaccaagatatgaagatataaccctacgtttctaagatgcggctgttctgggggaagatataacactacgtttctaagatgcgctgtcagtgagtgacatgagagagaaagtctgcatgtcttagttatcagccatgtgagaaggaatacctggatcactgaatcatctgggcataaaagcttttttatgagttgtgttaaaaactgctttttgtggatcacatgaagcaactctgaaatgcattatcctgatcatcattgttgctaatcatgtccattttgggccatgcactgcacatgcttatcattagtcaattgattaagtttgcactctttgggagaggcactactcctatccctatgttatagctgaggacgctgagacataaagagattaagacgctgtcaaccaagccaataacaatattttctctaagctcatgaacaatgtttggctgtgcagaaaaccaatgacatcaaaaggagagcttctagaagtaaacatgactgatggtaaaggaccccttctaaccaaccctgggaaattagcaaggtttcccagcaccccaagctacttgccttcccaccccttctcttctgaagcaacatcccgactctggaatccattcccacatttaaaaaatgggataatgtgagctgtcatttatgtgcattgactggtagggatgaggatagtaagagtatcctgaaggaggggaccagtaacaagcagggaagagagaaatgggggatttgggagtagcaacctctggagtaccagtgcatttatggaaagataatagttagaacacagtgttatcggctaggactaatgatggtggagcagtgtcggtgagggtatgaggtggctctgatccatgctctacggtgaatgtgtgggaaggacaggtgtggaatggttataagtacatgctctggagtagaaggctctggattaaaaacctgactccacagcttagtaggtgcgtaaccctggggatgtcgcttaattgctttaaccttcactttcttcattttaattgtaggaggagaacagcacttacttcatgcatttgtggcaaggattgagttagatgatacatatccaatgttaagcaccatgtctgatagaaacttcttaatatgttggaaatcttactattttatggttgatgaacgaatggttctagtgactttcagggtatgtcttctggcccaaggctaacagcaggtgtgtattataaaggcaaactgatctcccatgtagagggaggagatgggatctggaaggcctgggtgctacttgtaatactagattgactaaaaggagggtagaacgggagggggctgctgctgtaccgtagagtcttgatgaatttatggctgtcattctgaagattttaatcttgtctgaacaagtcataaaaaagtcttttatacaatagccaagactcatgaacttctgtttgctgcacactgtgctctttctgtgggttattcaggtcattctcaccacaaatatatgggataagtaccattttcatcctaaataacctctgccactaaataacctttgcccccactgcactaagacttttacatgttttaactcacttaatggctgcaacggccccaggaggtagatacttattaattaccctcatttaacagaggtttatggaggtgagggactggactgagggggctatgggggcgacctagtctagctgggttctaaggcagttgctctgcccccagagccctgcttcgagagcctctatgcttctatgaaggtcacaaccagaagcagtccggcctgcagttgctgttttaaaaaagaggttgtaaacatcactcactgcaccacagggtggccgtgacacaaagtcagatgtgagcattcttttagaatccactgtgaggaaaagcctgcttcccccaggaatccacaggcttctattctgataatgatgattatatcaccaccagagtccccttcagccttgatcattgagacaccctagacagggggaaagcattgaagaacctctgtggtcaacctaattctttgctatatccatgatctggattttcagccttgacttctagtttattatgatagtgttaggtctgtccttgttacatgaggaaaggtattaatatatttaaaaagctataccgatgacatgggtatagagacagaagatgtgacttcttatagttagaggtcaaaaagccataagatattcaataacttagaggcttgaagaaagatcccaaagggtctccaaggctggaaggatgggctgaaccgaaccacaagaaatctaatgagggtgacttaaaggcatgaacacagcgttatctgcacctcagagctgggcaaggtctgactccctgaggaagagccggcagggattgccatggggaccactccctgccaggcatagccttttcccaaccctgagcgtccgagcagggtttcaggcagggcgggtcggaaacctcaggtgtgcggggatgggaaaagggggtgaaccctgtgttccccagacctgtactgactgagtcatgttacaagtcaggagttgttgcagggataaatgggaacagaccaaacactgtgaaactttcttttttattattatactttaagttttagggtacatgtgcacaatgtgcaggttagttacatatgtatacatgtgacatgctggtgcgctgcacccaccaacttgtcatctagcattaggtatatctcccaatgctatccctcccccctccccccaccccacaacagtccccagagtgtgatgttccccctcctgtgtccatgtgttcccattgttcaattcccacctatgagtgagaatatgcggtgtttggttttttgttcttgcgatagtttactgagaatgatgatttccaatttcatccatgtccctacaaaggaaatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtgtatatccagtaatgggatggctgggtcaaatggtatttctagttctagatccctgaggaatcgccacactgacttccacaatggtcgaactagtttacagtcccaccaacagtgtaaaagtgttcctatttctccacatcctctcaagcatctgttgtttcctgactttttaatgatcgccattctaactggtgtgagatgatatctcattgtggttttgatttgcatttctctgatggccagtgatggtgagcattttttcatgtgttttttggctgcataaatgtcttcttttgagaagtgtctgttcatgtcctttgcccactctttgatggggttgtttgtttttttcttgtaaatttgtttgagttcattgtagattctggatattagccctttgtcagatgagtaggttgcaaaaatattctcccattttgtgggctgcctgttcactctgatggtagtttcttttgctgtgcagaagctgtttagtttaatgagatcccatttgtcaattttggcttttgttgccattgctattggtgttttagacatgaagtccttgcccgtgcctatgtcctgaatggtaatgcttaggttttcttctagggtttttatggttttaggtctaacgtttaagtctttaatccatcttgaattgatttttgtataaggtgtaaggaagggatccagtttcagctttctacatatggctagactgttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggcagcgtgatgcctccagctttgttcttttggcttaggattgacttggcgatgcgggttcttttttggttccatatgaactttaaagtagttttttccaattctgtgaagaaagtcattggtagcttgatggggatggcattgaatctataaattaccttgggcagtatggccattttcacgatattgattcttcctacccacgagcatggaatgttcttccatttgtttgtatcctctttaatttcattgagcagtggtttgtagttctccttgaagaggtccttcacatcccttgtaaggtggattcctaggtattttattctctttgaagcaattgtgaatgggagttcactcatgatttggctctctgtttgtctgctattggtgtataagaatgcttgtgatttttgtacattgattttgtatcctgagactttgctgaagttgcttatcagcttaaggagattttgggctgagacaatggggttttctagatatacaatcatgtcatctgcaaacagtgacaatttgacttcccaactttcatttacgttacctgcaaactcaatagaggctgaaaaatttgttgcctatttaatgaattcatcaacaaatgctgattgaatgactgctctgggctggtcaaaaagggtcacaggcgagtgagacaagtgcagaaaggaggatgatgcaggtgggtggggcccaggagtggcaggtggctgtggggacctaactgggcttattgagaggcacacagccagtgctcaataatgctaacggtaaaagagtaatattgatttattatacatttaattctttacagataagtgtgatatggctgtcccaaaaagcttgctcagttgtaaactaggccattggtctgcagtaccaaaaagtcaatttggggaaccaccttctgtgagacattaacaaactgtaacccatttgggcaaggctgccacggagccaggagcagcctcacaggaggctgaggaggggcattaagcctccagagaagagacccacaagaggatgtcacaggccgcctgttcagctacactaagcagctcccaggagtgggtctcaagccatgagtgcatgtttcagggaggcagttttaagcctcacgtaaggaagaactttttaaaaattcctctcttcctaaacaaccttcctgaaagatctgaactttttgccacttaagttggacacctgccaaggaaggaaggtgtgcggaacccattccagtagtgggaaagaggtttggtgactaggctttaagttccttttcagcctaagattctgtggggctaagaagacgagtgactttttgtctaagtatcttttcagtgtggcatttgtaacattgctcatctctatgaaatggaatgatccatttcctatcaagtgaatttggggcatcagttctcagttttgacacaatgacttgggcagattattaaatcacattatgtactggtctgcctgtacatggcccaatttaaccctcgaaggtggctatggggtggggaaccgccaattataatctacaatctcttttgctaactagcattccactggtcagggaagttccagacagctgctggggacagccaagctttcctctcggcccagcacgcagctgttcaggaagggatgctctcttcctttgagcccttccccctaccctccattctctgcctcctctatatcttgactcttctctctgctcctgatggtaccatgcacagttgatattttctgtcaatttaatcccattttaggtggtatttcatattttcctaccctcactaaaacctccttaaacattcagtaaactatattttcataacgggttttcacgtccagcctgaatcactccctgaccacccaagtaagctcgttgacttacttttccatctttgtatgctcagtgcaaaacataggtccaggtttataataggtgctcaatacataatagtagatgaaataaatgacctaccttttctgacacatgggaatgcctttctatattcttatttttggtagtgaagtttctgataaaacgtatccagggaaacacgttgctaatagaagtatcgcacacgttaggcataaaagctgtacccttttttaagtgccacagaggactaataactgttagtttgcaatcacagactacaaaagaaatgattgcatgaatagctgagattccaggtgttaattcaatagcaaaaaaatgtgtgtgtccttgtactttagtttctgatggttaggagctgatgtgtacttgcttttgaattcactaaaatcagattcaagaccttctataaatctgtagactcaaaggaatggaaaatgcccccaaaggtcacctggcacaaaccctgcctttaggcagaacaagatataaaactccttgtcgactgtctatcctttaaaaacctgtctcaaggagaatatttttaagtattttctttttctttaacctcggaaacgcttttcctgagggtcagtccttatggctccattacacatgatgaaaaattctcccctgccatattgtaagatcatttccatttgctctgtcctcagcagagcaggaaaacattggtcagcttcctccgtatcatgtcccttaatacacttaataaatccgccctgagctcccttttcctcagacttcataaatccaattcctcaagccgatcctcacagatcagttttgcaaccctttaatcattttaataatttttgtcactctcagttgaatcatttccaatttatctgtagcctactttttttccccctcaattaaacaccatggtaatgcaaaacggaccagagctaagaataggaaagtttcacagttcttgagtgttataattcctttttttttttttggagatggagtttcactcttgttgccgagactggagtgcaatggtgcgctcttggctcaccacaacctctgcctcccaggttcaagtgattctcccgcctcagcctcccaagtagctgggattacaggcatgcgccaccatgcccagctaattttgtatttttagtagagacagggtttctccatgttggtcaggctagtctcgaactcctgacctcaggtgatccgccagtcttggcctcccaaagtgctgggattacaggcgtgagccaccatgtctggccgggtgttatgattctatgacaacatcacagaaacattttggtatctaaagacttttcttttttttttttttaaattagaagagcaccagaaaactttttcacctcctgttcttgggcaacactaccttccagatctttctcagcagtgcttgagaaaaagcacttagtcctagtgttagctgtttattcatcctcgcagagagaaaatgatccattctgagatcaaaaagaatggcaaagcctcgaaaaagagaggtaagaaactcaaggcttttagagccagggaggagcctggagaatagggggcagccaggtgggcatggtggcagattggaagcacctgtgctgtttaaaggaggggatggcctttcatgttaagctgatttttttcttcacatgagaatgcccatctagtgcaccaggagcttcctttggggggaaaaaaagaaaaaaaggctgggcacggtggcttacacctgtaatctcaacacttggtgagaggccgaggagggtggatcacaagtttaggagttcgagaccagcctgaccaacatggtgaaaccccgtctttactaaaaatacaaaaattagctgtgtgtggtggtgcgcgcctgtaatcccagctactcaggaggctgaagcaggagaattgcttgaacccaggaggcagaggttgcagtgagccgagattgtgccactgtactccagcctgggtgacagagtgagactccatctcaaaaaaaaaaaaaaaaaaaaaaaagttaagccacaaatcgatattttaaatttaaatataaaatggcttaattaatccattgtgcagctcaaccctgtgtgggctcaaaaaggtgcaagcaaggttttgcccatgggctcctgcattcatgcccttgccaggaggctaatcctctaccgtccttatgatttctataagaaatttctgaagacatatgcatcgttgagaggcatgttctttacacatgaacacttttataaaattgtgttttaagaggagattttaaagggcaggaacctaggctctttactctctaatgatgaaattccagatgcagtggctactaaaaatgacacaaatttgtggagatgaaccttcttgatgctttgtaataactcaaccatcacaggatgtgcggtatcatgaagcgtgattgtccctgagatcgccagtgaggcatcgtgaagtgtgactgtccctgaggtcgccagtgaggcatcgtgaagtgtgactgtccctgaggtcgccagtgaggcatcgtgaagtgtgactgtccctgagatccccacatcaagttgttgtttccagttaatctgagaccaacgcgaagcccattgaagaaatgcacccacttgtgcttagtattctaattttcaaacccagcaggttcaattcccttacaaaggttggtctaggatagagttctgggtatagaaaggcaatttaaccaaaatgctttaccctaattacacagcaaagctatttgcataagtaaccagtctgggtattaagagacccaagagagtcaatgttactccagcagaagttatgtttttgctaaccttcaagaaaataatagcaagtcaagacttccaatgttctatttgtaaaagcaaatgatagaggatataatcctttatcatttgaatgaaatatgttggaaagagattggtctccattggaagtgggctgaaaatggccctcctttcccctgtggccatttttgcaggagagggtgttgaccgtattgagcgtggataagggaaatagtttttgttatatcaaaagaagccagtccagacatgattttcttcttccaatatggaagatgctatttttaaagaggccactgatcttttgtttgctatagaaaatgaagtaatctcttagggtaatggactcaaactataacaaaggacaggttatcttaaaatttgataagacatttctaacaggtaaacaatgacatcgtttactaggaagaaaaataaatgttctttgtggagatttttaaaaatagacaaaacaatcacctgaagagattggcctatgaggcttaaatcacggcactgcaggagcagttcaatttgtcagattggaaatatgatgtaagtttaaaaaatagaggaaaataaacacaatctagattgctgctacatatatagttcagatgatttaaacttttgcaacaaaatgatgcttggtatttatcagttttcccttccaatagaatataaaccgcacgaggcctaagactgtgatgtcaactggaaacaaatcccttcatttctagactcctggggaattggcaataaggataaagaaaataagtattatgaaggatgagcaaaataataatgcatctttcatggactccacagccatatctgacaccgttatttctgtgaaaggttttagcccatgacaattgactggacacgttaggaattatggtcatactgtcaccatctattcaagaacacccagccctcatgacatgagcaaataacagcactgacctgcctaagtgaccagacaatcctttaaaggagtatcactaaattgcagcattccaaggccaggggtcaagatgaaaaagaacgatccagactgcaagttgccaggttactgcagaatgaaagtggcagatgggttgatcttaggaaaaaaaaaaaaatctgctaactggtgcagaaaacattagtctgggagaagaatatctcactttagcggagacagctcccgcagttccattcattacgatccgcgggaaggctagacttgctgtgagggttcagccaaggctcaggcccacgtttccccctaacacagacacacatgtgcacacacacctacattgttgtcactgtatgcagaatctcctgccaagagccaaagtgacaaaaattatacagtagcttgatgggaataagaacacaagtgtacctaatctattcaatgtaagtctgaaaatggaaagaggtctacaaagaacagtattactaaaacagtaacagaggtggtttcatttttattagtaaaaaatgctctaaagcctctgactgctgcaaatatgataaaacagcacatcccaagctcagaaaaatggtttaaaacaactctaaggaaatgacccccccctgaaaatcaaatggaagtggaaacacacttggccaaaaagggaggctctggtgcataagacaatataataaaattatagggaaacaatatgatagaaatgaatctgatgaagtgtattgctattgtaagtaaattcatgcggagaagtattgaacaaaccacaagaagggacacctcgttggtagggatgacacctttgacgtgctaacaactgctcatttctcacggtcaacagagcgggcttcctttcaggtcaccatattgaacacacctggcttggactgaaattcctggtgaattggtatacaaggtttgtcattaactctgcacccaaaataaccacacaaccaagaggaagctctttctaccttttaatgttgtgagatgattgttctacacgaggagaaaacaatcacgtgtgactatgtagagcaaacgcggagaggcaagtgcccctgactcttacttgccgtcctcctggcctccctggtgcacacagctatgggggctggaagttagcataattacttccaattaaattaaggtggcacagctttttcccctttctctttgaatagctgtaggcttaagaaacaatatccgtgctgatgatattccataacaatatggtttcatcaatactgctaggtgtaagaactttgggagtcatacattaacctgccttcctcttgcctctcagagaaatgcccatctggcctccacagaaccactcttgccacggtttcgatttctcaggtcaggaccaggacaagttccactcacttaggaaagcagatgtttaggagtttcctatttggcgactcatgaaaatgatagactggtttctagaaataaaaatttggctgcctcttaagctattacattctcaaactgtgacgggatattcccatttgagcttaaagatacatgttttgtttgtttgcttgctttgttttttgagatggggtctcgctctgtcacccaggctggagtgcagtggtgcgatctcagcacactgcaacctccgccccccgggttcaagtgattctcctgcctcagcctcccgggtagctgggactacaggtgcatgccaccacgcttggctaattttttttatttttagtagagacgggatttcaccatgttagccaggatggtctcgatctcctgacctcgttcgtgatctgcccgcctcagtctcccagagtgctgggattacagcacatttttttttttttttgaaagagccctttctgctttttttcatttgtttacaagataaatttttgaaggtaaatgtgggcaaggaggtaaacaaactgagccactacatgaaggaacccgaagttggactccttctaggaggtgattttctacctgagcatgctgtacgggccttgctgctgctgttgtttttaacttaagaatgactttcccctgtaagacatctcatgagaaggcggggaaagcactactttacaacgagcatgggaggtgggcttatctcccagatccatcactgaaagctgggctatcttggggaaattatttaactttcctgaccttttgttccctcctctataaaatggtgacaaatagaataccttcctgacagggttgtagagaggactaattgagacaaccaacgtgccagcattttgggaatcattaaggtctatgaaaagttggtggttgtgtaactgtaacagctgtattttaggaccccaggaattacgatcttctcaaagcagaaatgtatttctttgtaaccttattatctagtatatttcctggtgcaactaggatctcaggaactgtaaataaacaatagatttaaagaacaaatgactgaatgaatgagagaaccaaagaaaaaggagtagagagagtggaaaaaaacaaaacaaaaccccagagtccttgctttctcaagatttctgcaaatgaaagatatttatttatccaactgggcaaggactctttaggcaggttgcacagacaggagttggatggtgaatgtggtcatgatcttgagaaacaaaccgggtctgagctgcaggacagggtcagaccatataaggctgggactgggactctgaacagttttttgggggtaaagttttattttgaggagtgataggggttatggggaaaaagggtgaagaaggcaaggttttaaaacagaataaaaccaaggccagctattttgaggatgagcttgaacagatctgaacgcgagggacaaggtgacaaaaagcaagagagggttaaggatctgcgtctgtgactcacgctggcttaggagggaggtgatgggtggggaggaaactggagttgggggatagccgtttgtcctgatgattagaggctggtatctgggacctcattgtaaagagactaggtccagggaaaggggacccagtgactaggggctgaaagaaaactttgttgctgtgggaaccaggagaccagaagggctctggttccaggaggactgcggggaggccaggaacccaccccttgaaaactgcactaggaagtccagagcggcaagctccttagtgctgccgtcatggtgcctactacggagtcctctgggttcctctcccctgaagccaagggtgtcccctggtctcaagcagcactgaactttgaggtggcagttgagaggcccaattgttagttaaagatgggccagggggaatatcttcatcacaagatgcataaaagcgactctatacatgtcttatttcctttaaaaagcatgaggccaacgtgcagtgtcttccaggctgttttctaaattgtgccatgaaagggcacattcacactactgacatgtcctgcttttattgttacaccttcctccaactgcatctactgaacatctattatatgcatagtaccaacgagaaatcagcatccaactgttttcccccttcctgttatctgaaaacacagaacagcgttagataatttaaaatgaaaacagcaaaagtgaccaataataacaccgtattaacctggttaagttttctggattctggatttcttgtgagtttttatccatgtacatatatttttgtaatattgtactcatagtaaatgtaattttgtggagcttattcttatatgactacactgcctttagagatgaatcttaattttcaggcatttggttgtgggatgcttaggctatgagaagctggatctcaacatttaaagcaggatcatttaaaatgaggagtcaattgtgttacttcacatgtgtttcatttgaaacagtatatcgttatgctactatgataactacagcaaatcctccttaggactgatttaagcattgaataaataaagttaaaattgagtacactgccattttcagtgcttcttgacttctacacacttatcaactactacaaatctgatggcatccactttccagtgggttagctttcacctcgacaggtctcaaggttcttcttatgggattttagtccatggcaatcaccaccatttgagcacagtcacctagtatagctggatatttaaagaaaagaaaaaaaagagaagctaatggcttttcacacatgcactgaaaaaaattaataacctgataatttctggcaaaggagaaaattttttttccttataagactgcaaagttcaacattatgtgatttatctcagtgacctgtaagtagtgcctataattattaaaaataaccatcaagctggcttttaagaagcttcattatggtactgctaatacaatgcccaactccattacttttttctatataaccttaaaacagagccagttcattcctagtgtttccaaagtgttactttaagaagaaaagtgggccaggcgcagtggctcacgcctgtaatcccagcactttgggaggctgaggtgggtgggtcacctgaggccaggagtttgagaccagcctgtccgacatggtgaaaccccatctctacttaaaaaacaaaaacaaaaacaatccgcaaaaattagctgggtgtgatggcgggtgcctgtaattccagctactcgggaggctaaggtaggagaattgattgaacccaggagacagaggttgcagtgagccaagattgcaccactgtgcactccagcctgggtggcagagtgaggctccttctaaaaaaaaaaaaaaaaaaaaaaaaaagaagaagaagaaagaagaaagaagaagaagaagaagaaaaagaagaaaagtgggctaggtatggtggctcacgcctgcaatctcaacactttgggaggccgagactggtggatcacctgagattaggagttcgagaccagcctggccaacgtggtaaaactccatctccactaaaaaacaaaaactagccaggcatggtgtcgcatgcttataatcctagctattcaggaggctgaggcaggagaattgctgaaacctgggcagtgcgggttgcagtgagccaagatcgcaccactgcactccagcctgggtgacagagcaagactcaatctcaaaaaaaaaaaaaaaaaaaaagaaagaaaaaagaaaagtacaggaacatgactcttaaataagccaccatttcagtggatgcatttattgaattgatgctttcagtaagttgtttctcattgtatgcatcatgttaaaagttgtatttaatccacaggtttaatgattaatttcttccagttagggtaaaaatatagtattatagagtttatagtaatagtgttgatttcaacttacgatggagtaaacaggttttgtaattgccttgggaaagccagaacagaaaaagtaattctatcagcaacatggaagcaaaatgagtagatgacttcttttatctgggaagcacattttcaatcacgagttcatgattgacaagtgtgagtttgtttggctggggcagggttccgtgtgactgacctatctttttaggttcattcgtgttgaccaatctttatggatctgggagcagtaagtcaacctagaatcaccaaatttggctacttatatggtgacatcacagcgcaccaaaacgtacatcaaaaccactgaatctgttggtttcatggggttctgcttgggtaaggacccagccacacagttataagatgaaatcaagagttgaggtgctaggccgggcgtggtggctcacacctgtaatcccagcactttgggaggccaaagcaggcagatcacaaggtcaggagatcaagaccatcctggctaacacggtgaaaccctgtctctactaaaaatacaaaaaattagccgggcatggtggcggtcgcctgtagtcccagctactcaggaggctgaggcaggagaatggtgtgaacctggaaggcggagcttgcagtgagccgagatcgcgtcactgcactccagcctgggtgacagagtgagactctatctcaaaaaaaaaaaaaaaaaaaaaaaaaagagttgaggtggtagttgcacaaacctacctgtgataagtagagctatacgcatacactgtagcaaagtcaatttcctggttttggtactgtactctagctatgcaagaggtagccatttggaaaaagctggtgaagggtacctgggacctttctgtgctatgtttacaacttcctgtgtatccataactatttcaaaataaaaagtaaagcacacatgaaatcaagaggactattatttcctcggggagactggcagaagttggctgcacagtggcttcaagctggagggagatttggcttctatgagggcatgtgcgagtctagctctccagataccttagatgaaggccactggcctggggatggggccgggggcactcactgcctccctcactggcagctggacagtgactccacaccatggggccggggaggtggcaacataggtgcatgagagggggactgcccccaccctgcatatctgctggcgctgaaattctctcaggacagctcagccctgctttccagaagatgagaggacttcacaaagctgcccactgccactgagcaaacagaatgtcctgtgcagggaaagcagcagaagggcccagaaacagccagtagccaggcgtggtggtgggcgcctgtagtcccagctacttgggaggctgggcagcagcctgggcagcaaggtcaagtgcaggctgctgtggcactgggcgctgcccctggctgtgcaatcccagggctctgggtgagagctgaaccgaggctcacatctgcccttgctgggttccaccaccttctggcaaagagcattattggttcaatgttaatgccacggcctccccctagcagcacaagcccagcctccgctcacccagccccctagtgaggtgaaccacggctcctgtccaggggcccattgcaagtttccacacatcctcctgcctgctgcagagggccggcggtgtgccttgatacttggctatgcatcccatccacctctagcagcccctggcagctgccttgcacagaagagtcacctggtgaacactgactgaattgagtcaaatagaaagcagctctcactcagagagcagccctccacaccaatgtcagggagaggaaggctgagcacaagagaatctccctctgtccacagaaatgcctgagcatggaactctgggaaaactgcactcgtgtccagatgcaagtaaatgataaactcctcgagacttcagacagagagcatagacatttatagcgcaatgtacttgtaacacccagagacaataagccctcttgccaagtctttgctttgggagtataggctaattgagggagattgcactgttagtgaaaaaagtggaatgtttaataccaagtagggagggggtctgcctttccaagctggggaagtagggaggagagaggaggtttgtgtggatggtgctgttcaaggttcccctctgaatcctgctcacctttaaatacctctggcaggcctgcataaagggcccatttcccttcctcatctagtcgaaaataccagcaggattgctctgaatgaggagacaggagcctccattaaaatgcagacgccaattactctgcaggatgggcactaagcttatcctccagacttttactggtctagcaatttgattagtatcagggtagtaacatatctccctccaaagcgtggagagctcagaggggagggatatagtgaaagacaggtggattcagcatgatcagatctggatgggctgagcccaaggagaatgtgggctggagatcaggaataggcaggtgtgatggagaacttacaagggtaccatgaaagggaagagatataaacaagcaaaaagatatgagcttatctgttacgtatttctttacaattttacataaggttagtccttatggtgtactagaataatttccatttatgtgcaaggtaagatcatttttacatttagccatcatcttcattgacgatgcaattcttagagtaccttagagaatctagaggaaatagagtggtggccttcagcgcattcctccatcttattctcctgcccacacccaggaccagaagaagaacacattgtcattcagtctgaaaccacctcaaagaagcagggtttggtaacaattagaaggtgaaagagaaaaatcacctaagctgatctaatttctttctaaagggaggaagtgtattaattgagggtggggaggaggaatagcttgaggaaacttgtgtttccaagaaacagcctcaccagtagagattgtctgtggtttgcctgttcttgctgtaggcaggtgcacagttgatggaaggccatgcttatgagtcttcgatgacaaatgatgggtacatgatgggttgaaactctcctgagctttcttcactttcttggcttctctctatgctcaaatctctctatgcattttttttttttttttgagaaagagtcttgctctgtcgtccaggctggagtacaatggcgtgatctcagctcactgcaacctctgcctcctgagttcaagtaattctcctgcctcagtctcctaagtagctgggattacaggtggccatcaccaggcccggctaattttttttgtatttttagtagagatggggtttcaccatgttggccaggctcatctcaaactcttgacctcaggtgatccacccacctcggcctttcaaagtgctgggattacaggagtgaacccctgtgctcagccaatagttaattctttattttgaaatattctaggaggaggaaaaaaaaatctgaccatatccaaaggttagtagttaatagctaaatatcaacaaagaggatacagctaaagattccctaaagtttgagtcctgggtcttatttaattggtgacttgaataacatatttgaaagtaggctcatgaatctacagatgaatcttcaaaatacctttattatgataaaagagaaatccaatgctgatgagtaggcttgacttatgatgagaaagctgttcttccaaatcaaaatgtagtgaagacattttacataaagacacaagaaactccgcatagtcatctttgtatcacagatgcttacctagtatctgacatagggtcaatacccataaatgcttcttgaaatcagggttcagttagacacaaagctacagagcttaattaaacatataacaagatcattggtcattattacgaataaactcatgtttactggcctcttctcccgtatgtgaagagggatttcttattaatcccgggtcttaaatgagtttgtcctcagcaggatctcaaagtcataagagagctacaaagattgacaattattagacagtgtcagagttggaggtgagtcttaggttgggttgatgaagcaggagacttctagttctcaagaaaatgaagaataagagagtgacaaacagtgaccatatatgagcaacgtattacccatttgcctacatatattcattttgcactatatggaattacatatttttcatttccaagaatttgttgctcatccattgttgcaggtctgacaaattaccgaaagcaaagcataaaattaggatagaaatcccattgtgttaaagttccatggaaattatgcagaaactcaactgcacagaagagtgcattaaagatacagtggttgccctggggaagcttgctttcttcttaagtattaaacatgtcattttcatatttgagcaaaaacctgaataaactctgccctcaaagaaatgaaagataaccactgactgtgcacttcatataagcttcactgctacattttaaagtatcctgaatagtcccatgatgttaagatagcaacactttattatacacattactaacgtggcaagctctgaaggtcagggagtggctggctggtcttcagcttgacccatttgggaggtccattttcatctttggattatctggcctctcagtttgattactggggccataaacagctttcccgtgagagctgaggtgaacatttcttgctcattaggcctcttccagacaagcctcccttgcatgcaatgaatatgcacttgatgcccagtgaacatgcacttgatactcaatcattgttcttgacttgacattctggttgattatcagacatgtaatccatcagaacagagatgcaaactgaggatcttgaattttgttagtttcattccagagaaagctctgttggggctgggaggggtggcagaacggatgtggacggcgaatattgatgcggtgtgtgtgtatataatgttctcctgggagaggtgtttcttaaaaagccgagttggttttcaacgtgatatttaaccgaatgctgccaaattgtgctacctccccagcacgttaaaaaaatccattaataaagtgtttgttgttgtcagaatgcctattccaaagcttgggctgtgtgaagggctgactccccacaagagaccgatgacaggcgagggaggtagaggagagggctgaagatggatatgtgctgccttgctgacaagtggtgaggacaagcgaggcgatggatcagtagaattttccattaaatcaagaaaaacacaacttgccccccaacatcacctctgatggtttcttagaccagctgcttctctgactccctactgaggaacaaattgctttcctggcgggacatttggacactcctgcattaatagatatggatcccagcatgccaagccaagcaagaaggcaatttaatatgagcaacactgtcatctcaatttaggacaacagctagaatgccctacagggcactgcaacagcttcgagaagtacatgacagaagacattctcactgtcttgaggctagagaaagctggtgtttctagtaaacagtcagaccaaggataatagaaaatgtaatgcaaagatgacagcagcattgtcctatctgtgaacatcagtttcaattcatgtgtctttcccttccgtagtgaacggaggtcctgtgtagggtacttcccttctatctcaatcccatcacaaagacacaaacaaaaagcccagtgacatcgtatcaataaagaaataggtaacattagatgacagatgttgtatacctatgtttgaggaaggtcaaagtaagaggtaacttcacgtttgcatgttcaaacttacttatctatctttgatgctatgcaagacaaaataaatggaagccctttaaatttccacctcctaacactagcctgtatgcaagaaaaatatattcttgctttttaaaaaaaaactctaaatgcattatgttttggtacatactttaatattagtttctattttatttttccataataaagacatggttgaatccagtgtatctattatgctaagataatttatgctaggataatatttttgataggaattctcataacaaatcagcttcatgtaccaattacaaaattgggagataactaaatttttataaaacgttttggcaatatctactgatacatcagtttattttaagtcagtgtggtttcttatcaatcatattgccagggattcatacataaattgagaataaaatatgttcacatgtaacaaaaatacaaatgtatctcctgttagagtctctctagatagagacagaaaaagtgacacagtagattcacacttgagtttgctcacagacaatggcgattcatatcaattgcaatgcttttcatggtgtcattttgcattagacacaaaatcgcaaaataactcaattggtcattaccatgaacacttcaccatggaactagctatgtgacagctcataaggctatcattattatgttgtcaaaagtccctattgctaacatttactgtatgatgaaaaaggtctttcccctatctcatgtgtgtttgatgaggtgacattgttttataaatcaatttcatggaaagtaagtatttatcttaaaatggtatccttttatctttctctgttcctcctcttctccctcctgttactgtttttcttcttcttttgcaaaacatttgaacacagaagcaaaccatttttcaaaataccatctgagaaacccatcaagcatggatagcacctgtgaccagaggagagcctctcagcaagagagagactgggaataacatttcccgtatcacttgggaagtaagaggaaaaaaatgaacacaattcaatccatgaattaaaaaaattttttttcctatccagatagttctcattattttttcattaaatattttttaacataaaaatcccttgtttccactattttctatttgtgaaaaggcaagaaaataataccagctttctgtgcatagatctatcacagcacttccaaaaggatgttggaattattttagatcgtggactccctgagcagcaagggtggtccagtcttgtatttccagcacccatgaaaaatgactccatataatattgggcagaagtgctctgaatgaaatgctcccaaatagaaaaaaattgttttgtgtatctataggaagatatttcagaattatattttatttttttatttttccagagacagggtctcactctgttgcccaggctggagtgcaatggcatgaacatagctcactgtagtctcgaactcctgggctcaagtgatcctcttgcctcagtctcccaagtagctagaactacggctgcatgcccctgtgctcagctaattttttttagtatatttggtagaaacggggcctcactatgctgcccaggctcaaaactatctttagactcaacaatagttaaaaccaaaaatagtttaaattgaaggttttgaattccagagggattatgcttttcggagctgaatttcctcaaacaaccgtaacctcatctgcttgcatagcatataatatttatcaaatactaaacaaaaaatggtgaatctggaggtgaagagatatttctgcaaaggagtcttgatgattaaaagttttcaaaattataccttcacctcttatcagtgcacaacatcgtaagagtttggagggagacactcatctgctttccttcccaatgagtaggtgtacgcaggacggagcctgtcagaagagcagggctggctgctgtccttgcatccgtttgatgtaggagatcacaggaaacaatgtgaaattctgcagcctggttttaaaatttcttacatcttttacacatttcaaaacatcaaatatgtttgttgtagcttgttcttacctctattctgcctaagcaaatgatatttcatctcttaatgtgaaaataagatttttgagttgacacattcattcattttctaaaaggtgtgtgtgtgtgtgtgtgtgtatgtgtgtgtgagtagggttctgtgtgagatggacgggtgaagccataaggatatatagtataaagccatcctttataaaacaggacaacaaatcttacactaaaaatttgctctgtagagttgcaagcctcagaaagtttaggagtgtcacctgtcctgttcctgggcctggagatgagggtccacctctcccaggtcctgaggactttcctcctggagcctagcctgccagtgagtaggctgctctgatctcttctccctgcactccaacatcttgctttcagctttgccctctaaatactggaataaaagggccaacaggtcagggatattgggagcaggagaactgtggtgctgcatgaatttaagggatgtttttattataagatcagagaaggaaaaatgatcagaaagcaaagagaggaaaagtttagtttatgagaaggctgtaggaggcagttcccggagcctaagtattaaaatatgaacagagacaagagaacctacctgcacttagtatccctgtacttgggatctttgaaggctatactattttaaaaaattattctattcagcgcattgcatcagaaatgcttctatgttaatctggaaataggtgttctaattatagatgctaaaaatgttctgtatactacttggctatagaatagcctacagatataataaaaaataattatttaaagtaatttttggaaaacaacccaataacttagataatgttattaatatgggtatcaaatattttaaatctaattataccaatgtctcaaatatataacaaatataacagaaaagattaactgaaagataggtttaagttgcctgtaacccaaatctgtgtatataagcaatttagtattgtgtatcttctaaagaccactgcttgaatacaattaaatgatcactcacatataatagtgggctgataaaccagctcttttccaaccttcctaaaaaaaaaggtcagtcccataaatactctcatcacagtcagtttcaagctgccaacatgaagttgctgaacatggagctggaaaaagatgtgcataactggctcctgtgaacctggtacagctggctccagcctccagtagacactcatgtgttcagacacatgcatgtgcgtgcacacaaacacacctgttcaacagattacagttgcttattgtattgtacttgagtattgaataattgcttcttgcttactttgaaaagtacctaagctacaacaatgggcaaaaagtttctcgaatgcacacaaactaaaatattaagtgatattttcctattgtcttcttttttgttgtcctgtcttgctaattctttcttgtttacatgctataaccattagaagctctgctaacatcttaaataaaatagaaatattaaaatatatatataaatataagtaatataaataaatataatgaaataaaatctcaaagcatcagtaattgctacatgaggagcaaaccctctgatataattttacatttactcatccattcatttgcaaatgtttgctaagcactgtaggggacagaaaagactttctttatcctctgaaggttcgataatgtagtctatgaaataaactgacagtagacagatcaacacgataaaatacatacaaatttattacatacatatgcatgagagtccctcaaaatataaggctcaaagaaggggtaggtaattggagtttatatagaatccctgggctacagaaaggaatagaggtttggggtctctggctgggaggtggtgacaggttatggaaaggtgaggggaggaaatgtatgatgaacaaaggctatcttgttataccgatagaaagcctcaggagtagtaaaagttgtttcagtgcatctctcagaagaatctgtgatcacctgtgacagagtctgtctgggtaaggtatcacctccaatcttacctcctgtgataagatcttctctgtttcatgagattcctatgacaattattttcctttatagatatagatttcttttacaaaagaacagctattcagaggcacttctgtgtctgcaacttctcagaataaccagctcaaaatatgccaaagaagtacattctggggtggcatgttctggtctcctaccatcatattttggggtgaagtgtcttgagccccaacggcatcaagtatgaacttggagccagggctttggtgtacatttctgtaatttgtgcttcacacaaacaattccacctataaggccagaagggctgggaaacagggcatttccctccctgaaccttacaacctgctggatgctatgcccacatgagggaggggtgccttctaattcacagcaagatgccttctgctaccaagtgctgtggcctctctctgcctgaggggtggagtgaggaacatctgcccatgggtagtagcaccttgtaaaatctaaaaggtggggaggcaaagaggacacgcactgcatcttcttcccttgcacttccttttactactagaatgagagtttcctctttccgtgatgctctaatattcctagtcaggccaagctattgctaatcagaacattctccggctctccagtcttctttattagactggcctctacagggctggagtctcttttctgacagtgccactgaatcagctgtctgaagaacccttgcgggagactgatggaccttcacagacaccgtttctctaggtcagctcagtttaccccaaggccacaggcattactgcctcctttaacacagcactgcttttaaacatttctttccccccacttagtccccagagacttagagttaacttgaataaattcccctaatctgagattgaaaagacagaaaagatagaaatcttttcttccttcaaaatacttaacatatatttgtgggacagaagaatttccatagatataatatatgcataaaatgtcactgttaaagtaatcctcaggggaaagatttttcatttgtgactttacttagccatgtcatattgagacaggattttattctgattggtagtttttggttttctctttctgtttagtaatgaatactggtaaacctcccagctacaaatatctcctgatatgttaaagaaacagagtcttccatagctgtagtgggtgcacagctgtgggaacgcaatgtggcctctcatacactccaggagctgttcctccaccccttccatgaaggaaaggtgatgccttaacccttttggagaggtgagcagtcttgaagccctcaataatatccaccagcaccccagtgaaaatgggaaataagacaggaacttggagaactcccattgagaaaagatcctagaaatcacagcagagtggcagggtctttctcaactgtgtccaagtggaaatggggttgtgtacaaatagggccccctcatataacacgcaactgactccagggcacacccatacttttaacgtctgattgctttcaagaatgctgtgaaaagttgttgcgagatacatgggattgagacttctgcagtaaagggttgaggttagacactgagtaacttcttgtcagtaaaaggaattaaacactgcctcaggagatggtataattatctcctggggaggtgactttttgtcttgaatgattaggtgaagtccaatgagaatctaagaggctggatgaaaattcttggaaattaagccacaactgaaaaaaggagccaaataaataaggccttctctggggcctcataccgtgtaccaagggtcgaagaagtaaagtttgcctgactcatgattctagcttagaaggcaggaatcctgctttgttttatttgaattattgcattgatattcacaacaacagtcttgtttgaatatcttaatttaggagtctgctacttaaaacagctgtcttatgtctatgagatatacgagccacaaccacagactctacgctgcgttcctctccctagtcaccgcatgccttcctgttccagtgaaatttagggtattgaaaggcaagagtctcatcttcgaatatctgatttgatgagtgattgctggaagtggatgccttagggaaggtgagaagacaatgatggggatgatgttgacacctggttgtggctgacggctgtgtccctccagctgcctcacctggggccgcagtaagcaccaagttcacaggcttagtgaggcgagtcacacattagcccatctgctctggtaatgtcaataccagcatgcaagaaagctccgagtcttagagatggaagaggcctccttttgtagaggaacgggaaacagtggcacaggaaaggtgaaatggcttacttatgatctcacagcaatgggacagagaaatggctggtttctcttcaaactcacacagtttcagttccagtaataaaacatctaaacctccatatttggacgaagtatagtctactcataggattacggcaactcagtttaagtgaggctgttttggaagaagctgtcctacatataagttgtcttctgcaaaataagacacaaaaatagttttgaaatcaaaaaagatttataaacattattggtacaactgatttttgtctctggctggaaaatttttcatgggttacacattctttcatatatttctcacatttgagaagtggagatttaattgcttacattttgatgatgaagaaaaataccacttgacacaaattaatgtcaatccttgagggaccagttccttttccacggcatatataataaaataacacaggaacattaatctactttgtagagtagtgaaacttattgagcatgttataaaaacaacagagcagcaaaagcattttacttaagaagcatttaaaaaaaaaaccctcattcatttcacaccactctgatgttttagccaacagttttttcactgggccgtggctgtgcacacgggcttcttgccatcacttaaatggacacttctcaaactctccctcacaggtgttcctggacagcacaggaaagagaacaaagagaacaaaaactacttggattgtctggaggtcatagtccaaaggaagggttgtaaatttagacattttttgaagattcacgtgtttggttcaatataaaagtatcattccccacccagacctgtcccagtgtctagggaaatgcaccttctcctgtgacattgcatatcatcttccatatcaggtaccctggtttgaaaaatcatacttttagaagaaattgccctttccattttcttaactgctctggagaccagcaggaattggagcagcctcattccgtgtcgaagaagacctatacggcttgcttctttttttctttttttcttttttttttttgagatggagtttcactcttgttgcccaggctggagtgcaatggcatgatctcggctcaccgcaacctccacctcccaggttcaagcgcttctcctgcctagcctcccaagtagctgggattacaggcatttaccaccacgcctggctaatttttttctatttttagtggagacggggtttctctatgttggtcaggccagtctcgaactcctgacctcaggtgatccgcccgtattggcctcccaaagtgctgggattacaggcgtgagccaccacacctggcccaaggcttgcttcttttaagagaaaaaggctgtcatgctgctctacttcagagaacagaccaatttttagagagcttcaacaatttctttctaatgataattcaaatctttaccaaaatcctaacacatcaaatttcagtttcatattttcaactacctacgggatattttattgcttcaaacagaacatagcactccaccatctgataataatgtttattttacctgaatgcaagttccgtaagttccatcatttgcccagccttaataataattgtgcaaggccgggcgcggtggctcacgcctgtaatcccagcattttgggaggctgaggcgggcagatcacgaggtcaggagatcgagaccatcctggctaacatggtgaaaccccgtctctactaaaaatacaaaaaattagccgggtatggtggcgggcgcctgtagtcccagctactcgggaggctgagggaggagaatggcgtgaacccgggaggcagagcttgcagtgagccgagatcatgccactgcactccagcctggatgacagagcgagactccgtctcaaaaaaaaaaaaaaaaattaattgtgcgaacgccaccccctaccctcgcccagcaacacagcaacattgctgaggaaactgatgcactcccacattttaatgacccagtgttggaagaagtcaactaaatgagttaaaagtgtcccaaggtaggtggcccagtaagaccatcccaaagaaaggaacctgggcagaatccaaaataggctcaaaggagaagattttctctttagggggcttgtacgtgtgagtggacatagatatatacgctgcaaacgtgtaggggatatttaggagcactgtccctgctgctctagggcacctattccttggaaagagtcagggtgctctgaaaaaaatcatgtcagtcttaccagcaagggaattgtaaacctgaatatcagacatgcgggtggattacctgcgtctattatccaggcttgggaaatggaggtgctcagggatgagaaggattagattataaaagaacagctttgaggaatgttttggaactgttacaatggatcccacttttagggatacatagaaaaagtctttgcaaataccagagatacaggcactacaaggaaattagatagatgccaaaagcatttaataaagaaggagtttggggtaaaaatttgcaaatcttcaccatcctactcttccctgaaacaaaaaactaatttcaatttaaaattttcactatgattagttctattaaaaatcaatcaatctatccatcctatctctgtcttgcactctctctctctctctctctctctctatatatatatatatatatatatataatctatctatgtgtctataagtacaagatgcttcttgcagaaaaatttgcctagagactgtgatttgtgtaaaactaactggattaaaattaaaattcgcaagttttagggttcacttaagcaaaaaaataactttttcattggtaaaatggtaaatttatttctggatctagtttgtgaagcaggagtgtgtatatggctgtgtgtgtatgagtgtgggtgtatgtatgtagtgtgtgtgtgtgagtgtgtgtgtctgagtctggacccagctccctactcaggagtttactccatactctatctcttccagagtaggctgtgattcccagtgtactaatgttaaatgttccagagacattgaaaatatctagggttgttataaattagctttgtggggtttttttacttgcttttgtttgtatttttgaataaatgagttgaggaaaaaacatccttgctaaatagaaatcatgggttacgagacgggagagacgcccacgtggtaatatggctggaatgtcatggtcagaaggtctttcctgtctttcactttttcatgttcactggtgcatgcacgtggatgctgggatatctgagtcaagaagggtggctgtcactgtccaccctttatacctgccaccacttctcaaatactggtagaaagcctcttataaatctacaaatcttgtcacttgcgggacttttcaatatgaaaccctcttatacaattatatgtatgttggataccatggtggatgctgaggaaacagtaaggaaaatttgctatttcagacttgtaaatattaaactcatatttttagatttaaaaaaggcagcaaattatgcagcataataaagatgggtgagtataaatattctatagtgtaccatattagctattaaacattatacagagagtggttatgaattcaatttctaaataatctctaaaataaaagaatgatctaaatcttccacatccctgaggtattagtcttaaatgcatatgatattacaaaactaaaattcttaaaataatttctgaaaaactagtgatacaggagttgtaaagaaattacttgggcagtgagggtatggaagtcctcagtaaggttttcttcttaatgaaaagcagcccccaaatcattttcttttccaacaaagagcagcctgtaaaatcgacctgcagacacaaacaagcatgctggaagcttgcacaggtacatgctggcagttgtgcccgtaggaatatactacctgggactagccatgttcaaaatggcggctccatcttctctttttgccagccacgtgtccagtaaggagcagacaagatagccccaccaagtggaaagcccatttgcataataagattagggtggggcgaccagccttcttcgcgtgctaagtaaacgtcacacctggtcaaaccaatctgtgagccctacgtaaatcagacactgcctcctcaagcctgcctataaaatctgctgggatctgccaccttaaccctttttttcagacatctctctctcttgcaaggagctgccctcctctctcctttcttccgcctgttaaactttccactccttaacccacccacgtgtctgtgtacttaattttcttggcgtgagataaggaaccctggggatttaccctagactacgatgctgcttcactagtaggaagagaaaagataaacagcgattcctgttttataaggtaggaaggctgtatattcacacgacactcgccgtcacagtggtctctgtgacttcagtgaaccccctttccacctgtcctcctcgccctcacactagattactttttccaaaagatctgatcatgtcacttcccctggaagcccttgcctggcctccattgtctgcaggatgaagtactgaatccttaacccacagggccagactccctttccctgtcctgctcttgatcaggcaccatgagcccacgactcctctccgtcggctaatcattcctccctggccgtgttctctgcagctgcctagctttctgtcccttcactctgttccagaatcttctgcctgaaatatttcagtcaccacttccaggtcaaatttctccatccctcagtgcgcttaatgaagctccccattcttgattccaaaccttttcctttctcactgcatcattcatgattgatacaacgatgagtgtgctgaatgcaggcatcgttgctgaggatacaaaaatgaatagaaggcagctcctgctcaccccaccagcggccccacagcagctccacgtgtgggcaagtggtatgcacacgagcaatgtgatacacgtgactatgagatgtgttcaaggtgatgcggaaactgggtacgaaggcccttaagtatcctggatttctgtgggacattcccctgcacagttacgtgttgccatgcggctatgctgtttcgcatagacatgtcttgtcttcccattagatgacgtgtttcttcagcacagtggctgtgacatcacctctgtgtgcctgtagcatctagcagagagccacatacatgctggataaccaattcatgcatgtagaataaacaattttcccctacaagtattactgatttattttaaatataagaaagaatatactgaattttcccccttggtgcatgtttcttatgagtacagcttagttgctaaaaacagcgtgatttctagtgattgcggtagaagaataaaagctaaaactcctaggacttctgttagaaatgtaaatcagaagctgatattacttcaagtgctacgtgaaataccacattcaatttgtaactccaaaagctttagtctgtggtacatgtggttctacatggtttagtagtgcctttgtatgtgacatgagaacaaaataatcagcaggtgtaaatgtcaatcgaactagagaattttctagaattgtacctctgctttcagtttatggcactactgaatgcaaactctatttatctgcacaacttcagaaggttattgtggcaacaccttttaatagaaggggcgaatacaattttacgggtattattgagagttagaggtctaatttctcatgcctgggaatacggaaagtgaaaaatatatattgttacaaaaaaagataaccaaggaaatactcaattctgttagaaataaaaaagaagtagtttcatgccagaagacttttttcttttcctgcatgaaaatatgaaactctgagactgcacacaagtgaatggtatttgagtaatgataaaaggagacagaaaagacaccagatgaggcagaggctgacatttgtccgctcatcatccatttgcccttttcttcataggaacagtttctagctgggcacatcgcaccccgaatacagatatttcccaactgctttgggggctggccatgtagcctcacaagtaacttttctctgtcggaatacgagtacgatgttgtgtgctacttccagatttgacctttaaagagactgggaatgtcctcttctctttcccctttgtttctggttgaaaagtggacctggggctgagccaccttgcaccatgtagatgagggcaactaaaggcttggtggagtggagcatcccagctccagacattttatgagagagagaaataaactcccatccccttaagccactgcagtcttaggaactggccacacaccacggaactaacgtcagaataatataatggagcctactacaatccatttagccagagaggaacaaaaagattttttttttttattgctgattacagttacagtggacacaaccatattatggaatataataatctggaggtgattttgtttgctactaaaacgctctcatcaaatacttcttttttttccccaatatctgcccaaagtccttagtaaatgaattcctttggtcattattaagagaaataaatgcctgtgtgcccattaagagattttgattggagaaacagaaagccccaatttaactggcttaaatagaaaggaaatgtatcatatcccatgacaggcagtccaaccatggagtggcttcagagctgatgaactcagtagggcaatgaactctagaagggcctggatcttctgaaacctgatcactagtaagggtcaagggattagcaagactggtttagactactcagaactcactactgacccggaaaatgaggtcatttcccaaactggtccacacttgaaaaaaaaaaaaaatctgttctgttagcaagagaaagggggagatggccgtcaggagggaaaccgacattttagtgtacagtctgtctgctgtgcacacagagattctaaccatgacctgatagaaacttacccctgccagctgccagccaggtgctgggggtcatgctctatcagcaagcagttctgtttgtacagggaaggtgcatagcctatagagtcggtttcatgctggctattttattcacattctgaggtagtttgtgtccctgcagatttctgattatacatcagtgacgtttaatgtgatgctcagaatattaaaagcatacccagtaagtgttttatctaaatcatgtttacaagggaagttctgtgcttttctgaggtcttgcaaaaacaatctttggtttctttagaccaagaaactaaaaatagacacagtgacatagcctccaaacagcaattttgagatcgaaaacctctgttacattaacaatgtgaagcagttcccatccatcccattacaggaagttctgggtcaatagatttagtctaacaaagatcttatctctttaatcctatctttctacttcaacttttcttattgattaagcatcttctgaactttacaacaatacaatactgcttatacaaagcccagccatgtcttcacataaaagagtttttgagaagcctactttgatttagatttctttctttccaaatagcagctatcttctgaacacatagcttttctacgtacttcctatttacatgtaaaaccatttaaatgaatggtctaaacaaggttgattaatcactgggaaatttctctttcaggacacatccattccaagctctacattctttaaaaatctagcaaataaaatttcatcttatttctgatgcaaatgactaacataagttgactggactatctcttctatttccttcagataatcagggcaagtcaaaatgcaggcttgtacaaataaagaacaatgcttcaagttcttttttttttcttttcttttttcttttttttttgagatggattcttgctctgtcgcccaggctggagtttagtggcgtgatctcggctcactgcaagctctgcctcccaggttcacaccattctcctgcctcagcctccggagtagctgggactacaggcacccgccaccatgctcggctaattttttgtgtttttagtagagacggggtttcaccatgttagcctggatggtctcgatctcctgacctcgtgatccgcccgccttagcctcccaaagtgctgggattacaggcgtgagccactgcgcccggcctcaaattcttaggacacaatcaaaagcttgcatttgataatgtgtgtaagaattctttaggcatatgtcacattctgcaagtggactgggtttgtctacatggggaggcggccacgggaagagtgaacacagacttcctccaaattacagccctgccagtttagcactaataccttgagaggaattgggaaaaaatcgcttggcatcaaattcccagactgtccctgaactctggtcaataaccaacacggctttgtgaagaaaaatgtgatgtgtgtcaggaacaatattatttctgtctgaaggagagtaacaggcaactttgattggataaagaaacaggcattcttggccttcttctacagaaaggaggaagaaaattgctttttggaagtgcagcaataggcccgcttgacaaattacctcctagagtgcaagagtgaggcttatctgcttctgactgggttccttctcacttgtacacttcttctgatcctggttcaagaatgggcaaacagacaggcaagggttatacatttgacctgggccttacccatggccttgtagttacttgatatttttcttctccttgaaaaaaattcttaaataaattggactttaagaaatctccttcttagtctctatccacaacctcaacttcttaatggacagtggggacaaaggcctgtatggtaggcttggatagctctgccaggtgtacctcctaaggacctccaaatcttaggggaggtgggactaaaggtcaagccaggacagatcagatttgcctaggggacacttcaagtttccacttcttggtgcaaaaagaggccaaagtgagtctttgaggacttcaactggtagaatcctggggcccactgagatgccaagcggagaaggaggaaaaatggctgcatttcttggaatctcaggaaatgtgatttctacatctgttgcagatccttggagaccagtgcccatgggactggctggtctttacccaagaaaagccctattacctcccaggagcttgtagagagatttgattgaataactgatcgacttagcctttcccagtggaatgttggacaagcgagagaaatgcctgtcactctagtcctgagtgctcattctgtgtgggctcccttgaactctgcctaaatgtcatgaacaacaggaataacagcaggtacttagcgctgaccttggtgttcctgtttcgtgtgaagagtgagggcgtgctgcttcttcatcatgccatgaggctaacatgcgatgttcttggcatgtgctagacaatctctgcccttacccccaaggggcactagctgaacaaaaacaacactaaaatcccctgtaggaagttgattgctagaatacagatatgtgcaaagttgcattgggatacgttttcctataacgtaagaactatttaaactatttaaacattttgtgtaatttaattaaaacatcactgatttgcattggctgctcaatacatttggtgacatgtttcagagaccctattttgcgaaggtaaattaaatttcccagtggacttcattctcattaaaaaatgacattcagctacatgggtatgacaggagagttgctcctgacgcattccaggtttaagagtggccagccggaccaccacctgcatgcctggctctttctggaacagcagcgagccttcacggagttggtttctgtgccctcggtctctgccagtgaaaagcatatttccttctccctaagtttaacctcaaagaaacactttgcctaaaaaggtgtaaaattctacctaataataattattggtcacattgcttttatttttaacatgtaacattactaagtttaattaagaaaaaaagtaattcataaactcagtccctaagtaaccatcaactacatgttcagaaacctcaaacattctagaaggttataaactgaaaagtaaaagcttcctccctcacatcatcacttcctctacccaaaggcagccactgttcccggggtgtctttgattctttccagaaaatatcttatatgctcatgtgcatggatccccttttcatgctgtctttacttcattctgtgtattaaaagtgattccgtatcaggacacggattgaccttactcttcataacagagtattgtattccactgtataattatgtcaagaacatacttaactgctataatactatggaaaagtggatcgtttccatatttttatctattacaaaatagtgctggaaaggggaagatcaccattcagaatgctgggggttggggagatgcaagctgcctgtctggtggggggccgccaggtctgccccagctggactggacccaagcactacatccttaggattgttctcactgtttgcagaagcacttcttctgacatggaaaacaaaaacacaatctacatgtcatttttgttgttattatcataatgccccatgcagttaatgtttttgagattgacacatggtgacactcgccctatgaaaatattttatttatcattatataagttattctatgaaattttaaaatctctcatattcatttaattaacccttggaagaagagttactaagcatacacgatcacaaaatttcatcccatcttctctaattgatcttaaacccataaaaatatatatcaatggcagtgttagaaagaaaaagattttactgtaaaaataaattgtagtctcaaaaatacatttgaggcaaataaaccatataatttaaaaagtcatactttcattagttctctacagaaatgaactattgtgggcctaatggctctgatttttgggtatcacttgctcattgtgactagcagtatgcaactcagcactacggattaaaaaaataaagcaagccatctgaatcccaagttgcttcataaaacacctgtcttacaaaatgtaccacacaaaaggtagttcttgctctacagagtttaggaaatgctgagtgtgctgttctgcttgttcaagcaatacatctttgcatagtgaaagttttaagtcctataggaaagaaattggtttaatctggcttacctggtgcctccaactcttggattgcagctctctgctccacctctctgtaccccaactcctgccctgctcctggcagcatctgttggaacctggattgcatgacccgtactctggaaaatgctgctctatatttttgtagtcaagaaattgctttatttctggaaagtttttttctttttttccctcaactacagctgaatagctcaaagtgcttgtgttgaaaacacaggaaacctgagtttgcaaatgttattccttggacagacgtccctgtccttttccagactggaactgtccagtagaactttctgcagtgatgaaaatgggctatatctgcactgttcaatacagtagccacttgccatgtatggccactgagtgcttggaatgtggttactgtgattgaggaactgactttttaattatatttacttttaaatagccatatgtggctaaaggctgccatgtcagacacacagccccagacagaggtcagagcacgaccaaaataaatgcacagaaacaatgctctccacacagaaacaatgcaatcttcacaagaagtctgttttcaggactgttctgagctctctgcagcttataaagctaaagaagtttctccaatcgatttgccataaaactgattttctaacacattattcaaaaagatggatcttacgattttgaaagagtataattattggtcaggtgcggtggctcacgcctataattccagcactttgggaggctgaggagggtggatcgcctgaggtcaggagttcgagaccagcctgaccaacatggtgcaatcccgtctctactaaatttacaaaaattagctgggcgtagtggcacgtgcctgtaatcccagctactcaggaggctgaggcaggagaatcgtttgaaccttgaaggcggaggtgacagtgagccgagatcatgccactgcactccagcctgggtgacagagcgagactccgtctcaaaaagaaaaaaaaaaaacagtataattatttcatatttacctttatttcaacaaaaactggctaaagacaataagaatagctagtggtctgtgttgggttaaaaaatatacttttctatgtgcagctgacccttgaacaacatgtattagaacgtaagtccacttgtatgtagattttcttcctcctctgccacctcggtaacagcaagaccaacccctcctcttcctcctcagcctactcaacatgaagatgatgagggtgaaggcctttatggcgatctacttccatttagtaaacagaaaatacattttctcttccttatgattttcttaataatgttttcttttctctagcttactttatcataagaatatagtatataatacatgtgacatacaaaatacctgctcattagccatttatattattgacaaggcttcccgtcaacagtggatcattgtagttaagtttaagctatctgccgactttcagttgcaggaggggttggcacccctcaactccccgtagctcatcaaagatcagctgtacctcaaaatcacggaacactttctaggaatgtctgccaactgatagatgctttccagatgaatggtatgcagaacttgtttgtacatttgtgaacagtttctttaactaaaataaatactctccaaagctttccatctttgcacttcaagctgtctcacaggcagaaagtctagcgaggcttatttccaatctgcaaatgagctgatcttagagtttaaattagatttttggacacatgtcaaataaacatggactgcatatttttgacatttcataacaccaactttcttttttaaaatgctctttgatgaagaacatcttgtatatcaaagcctaaagtaccaacaagatttgattccagtctctatgtgctggagtgtccaggcggttgaggcaaacttacatggggacagctggagtgaaggctcatgaacccacagttagtcatcctgagaaacacctgttctttctgatgtctccctgaaaacatcatatatttggagactagattttaatctctagtcttaaaaaaactcaatatggtttaaaaaatatctaagcataatttaatgaaattacatatttttacaaaaataaattaaaattggcttgaataagaaaagtaaccattttcttttttccttttattattaaatattgatcatctacatgttttctctttccaaggtccacctattgaaaaaagagcttcacatctatttgttaatttggattttaaactcaataattagttaaatctttgagtaaaagggtaggtatcatcataatttatcttcattgactcctttcctacgttaaaggctgaaaatgaggttcagactctcatttcactaaaacctccaacagtattttaatgctgttgtgataagtcgttcaaaataaccattttcaccaaaaacatatacacgtttctttgcacgaagtaggtcatatcctgtatttgcacaggtctaaaaccacatttgagggaggctttacaacttcatttttataattttcgaaaccctttttaagaaaaccaatgcaagaagatgaacatggttaagaggatttggaaagggtccatgcaagtgaggagcccaaggtgaatgcctcattagttccctgacaaacctgcctccgagcgacacagcatggtgtttgtttaaggacagagtgactgttagatgccttaagaaattctatcgcatttccttaacttatggtcactaatatgatttttgaaattcgattttcatttaaatgtgtatttttctgcagttgccacattttgtttctggatttctaattaaaaacagaaaattccttatccaacttcaaatcattattttaataaattatcacccagacatgtaataccccaagataatatcaaataagataaagatgttttatttatagagaactcagaaggtttgattgccatagctttctgcattcccaggtcagtgagtataatgtattccatattttgttgctgttttccagcactaaacacgtcagcattttgcatcggagtcattaaagtttgtgagatagttctgatgaatagcaataaggccagaaaaaaagaataatgcataacatgaattctttaggaaatcaattaatttttttatgagcagtagtaaaaataggatctagggttagcagagtgaggctagactagtatttggtaccaaaatacattctctgctgcgttctatctatgtaaaaatattctgtgctgagtcaaaactgaaatctcagttctcccaagagtaagacattttacatatcagaatgtactctttacttggccgtgtatgtagcctttgatagagcacaccaattctgtaaattctgcagtactttcaggtttctaatggactttttgtggatccctgaacatagtgttattttggttttctgaattatatactatgtgtgctattaaaacactgtatattgtataagtatataaaggtgcttacgtatttttcaaagagctctttgttggggcaaggtaagcagttctaatactgggataaatgatgattaatattggaaaataaaagtaatagtttgttgatattactcctagattattaagattcactcaaccatttattttattcattcattcattcattcattcattcattcattcatacatttgatgaatgttaaacaccaaatacatgattcaccaagaagaatgaaaaggcttaggacaggaatataaagacaggaaaccactgtaacactgcagcttgaattctgggaggtagtactttcaaataattctttataatggtaataaatttactggatccaccccacatttatcaggcctttcctaggtggactgacatcatcacttaaatggaaatccctgtcttcatttattagttaaggtacattgctcctcggggaacagataagcctgtgacacagtggagcaaagtgtctggaatctgattttccaatggacattcccatatgtttgaacaaaagagtcataaatactaactatagcacctattttacagaagctgaactaaagacacagaagccttcaaatggaaaggatatacaacagaaaccacagctgtgcggaagaccacccaggtacatggtcgtgggtgaaatgactagaagattagaatcctctggagcccagagctcaacacatgggtgtctagctccgaacaattttaaatcccacaaatgacagagaatttggttttcaacttttttatacgcgattttttttgtaacagctaacatttcttgcatacccacatggtaagagttgtactttttctatcttgataattgagggaaaaaaaaattaagcacgggtgaattcacaggcatcttacaataaatctgtgaaccacatcctgataatcactggagttaatgacgtctagggctttttccacatctggaactctgtaattcttctatagctttgctaccaatgacttttccttgaacgatgtattgaatgaggcactcacttctccctgaggcagcttattttgttcttcgttgtccatactgtgagagcaaagagtaaaaagagattcaccttcttctaacttttatgtatttggccatgttctacttctgaaatgacataatctaaccacaatttcttccagacaatggctttccattacactccttaaacccagaaaagatgggcagcttacaaggttatacaaaccacagcaaaacaacatgtatcaggaaaaggggaagagaaagaaggaaacaagtaaagccaggaaaccagtttccaaatccactgtgtttatgacctctatatatgctatagggagcccacagatgtagctttagattttctagcagtcaactgtcagaggaaaaccttatcagctggtttaacatccttaaaggcaactttcctcaggacaagcataaatgtgcctggtactcagatcagacttgaatagtcaccatggttccttgtggaaaagtctgttgggatgtcctgaaccacaggcatcacatttcctgtgtaacgatcacaatataaacaaatggcatggtggcaaagtagtatttaggaaaagcaattatttgaaaggctaaaaatagtaaggtctaggtgcccagtttcctgccgtagatctgactacatcctggattctagactatttggaagagtatatccaatgaatgccatgtaagcaatcttccttgaatgttgggtttttgggtgagctttggataaatattcattaagcttttgattaaatattaaataaatctgcacttaactctgtgccaggaactattctaagtattttacacttattatctcatttagtatgcacaatagttttatacagagttgctcatatataccctattttagagataaggaaaccgagaaagatgaaaaccacaagtagtttgtgaagccagggtttgaacttcacacattcaacgccaccctttttaaatcactgtggaattcctttagcattcaagttaggtgaatatccttctgtgaaagtttgggatttgaagacaaagggcaatgatgaaatcaatttatctctgctgagaagccaaagcaatgggaatggacataagcttgcaaaagtgtatggagactggggcaaaaagacagggagggaaaggaaggcatacagttcagtgcatcctttagaaaatcacttctctgttcttttttcagcttcttcaaattgcaaactgtggtggtttaaaatacgttcataaattctttgacactctttaagatggagcccaactcccttccctttgagagtgagctggatctagtatctcacttctaatgaataaagtgagagtgacaggtgcagctttggggatttggtcctacaaggcactgtagcttctctctgttctctcttttggacaacttgctctggggaaagccagctgccatcatggggacaaacagcctaagacaagggccatgtggtgaggaactgtggccttctgacaacagccagtgaggaactgaggactttttttgccaacagtcatgtgaatgagctaccttggaagtagatcttccagccccagttaagcctccagataactgtgaccctgctaaactgcaaactcaggaggaaccctgagccagaactacccagcaaagccactcacgggtgattcctgactctcagaaactgtgagatgatacatttctatcatgttaaattgttagaatttggagttgctatgcagtcatagataactaatacacaaaccaacaaacacacctccaaaaccaacaaatcgaaacaaattaagataaattaagaatacgctacctacaattgccaaaggacaaagaaaccttgagaacataactatcctcctttaagtaaagttgcctgcagactcttttaatccaaagacattacagcattttgattcacttctaaaataatttgtcatgatttgcagcttaagtatgtatgttatttacttataatttacttgtataaaaaagggaagataaagatattcaagatttcacattacataaacccttcaacattcttaaagcaaggtcaacaaccaaatgcaaaagatgggccagcaaaagtctctacctcctaagaaaagttaaaatcttaaaatccagctttagaggatggaaccacagtaggcaattagcaggcagaagcacataatttagccagtagttaaaaacaattcattaaaagctcattttaaaagacaacatttgctagcattctgatcccagaggttggcaacctgctgaggccacacacaatcattgcagataattcagcacatgataatgactaaggctggagagtgtgtcctgatttccatcgtctccagggagagtaaacacttgagttttcattctaatgcaatcacgattatgaatccagaggtatttctttccacttaggcaccatggtatctcattatttttcaacttccacttcctctactccattgctcaacccaggattttatgagccccactgcatgacatacaggaagctttactaaggggaaccaatgctaatttatttctagatgacttacagtgctcagccccaaatcaagactggctaatacaactctgctatctgtgctccttcttgcacaaaactcctcatgaagttgcaattttaaaagaaatgtttctcatcaaaattcaatagacttttatatgcacatacactttctcacttttccaggctgcatgaaatttaatatcaggattattatccatttgtcattttaacctataatttagtaagcctttttgtgtttgagttatgcttcttccccccttgagccatcagcttgcagccatagattcatttgaaaagccggccaggtcacatggtttgacctcttagaacaaacattttccacatttcttattctgcttccataagagacaccattagttttgttcatctctacttaaaatgatttttatgacataataacatttcaagttttccacattaaccttcattttatttcttgaaatactcaggcaaacaatgtcactaagacgtcactgatggagaattctttctccttcactcctgtctacttaaaggcaactctgaagaaagaataaatttttgctctgcatcagctgagtgctgggagaaaagtttaaaagtctggcctagtggctcacagcatcttaaagtaaatacttccataagcaaccaaagcagaaaatcttcatataactgttttcaccaaaataaatacataaattttcaaatctggagtcctataaaggaatttaaaatctattttcttatatgtaagttcaaagatgtctaagtccaaagggaaaatgaaaataaaataaaaatataatcccagcccatgtgcaaaagcaaacaaggacaggaacacaccgctccaggggtgtgggcagtactcaccccacagcccaggccattgcccccttcgcaggtgactttcctctggtcaggctccggcagcagccccgctccacagccagggcgggggcataacacgccccccatctgcaggacacactcctctgcaccatactgctggtaccggttgtactgcaaaacccaaaaagcagattgagctttcaaactgactgcaaatttcagccaaagggttaggagctacagtgcatgggatttcttgcttaaccagtttcagtaaaataatgcatgtgtgtgtgtgtgtgtgtgtgtagggggagggagagggccacggggttgataggggaggacgaatatggttcaatgcagtaaaagtctaccaaattcaactggcaagacatataagtgtgtttactttttgcttttttgtcttcagaaaatagattttccaaagttttgtattttataagatcgcttctaccaactgtattttaacaatcttatttcatatacattttgaggaacatatttatgtattaaatgatgaacacttttaatacatcgctatcaatcttataaagcaatatattgtcatgcctctatttaaaattcaacaaggttttatatttattttgaaaatcggcccagcattccacctcataatattggcagcccacacaatatcaatgagctagaagaagactaatgttaaacaatcacattttccctttatcattattcttattcttaaagcatgatttcttgtgtccctgatgtcatttcttcctggtaccgttttgctcaatttcctttaatggtttccccagcctgcaaataaattccaaactccatcagaccattttcaaggtcttctttgtggcagccctacacttttgatcttacattatttgtaatataaactcagatcaagtcaaataggtttgctcaattattaattaaataatgcaacatttattgagagcctactacattccagactctatcgaggcgctggggatacagcagtgaatgaacaaacttctccgccttcatccacagcactgtaacagtcaataccgagaggttagaatgtctaggatttccaatggtgctaagtgaggaagaaaataatcaacagggaagagggagagtccaaagaaggtggagatttcaattttaaagaggtgattacagaatgccttacaaagcaggtgtctttaagcaaatgtctgaaggagattagaaatgcaagtcacatggatccctgggggaataagcattccagacaagcagagaatactataaggggccagagccccagtgtgctgatgtggttggctgttcagggtacaacaaggggggcagtggggcggaggcagagagaacaaggagggaaaaaaacagaaggtgaagttggagagtttgtgaggatctagaatatgtagttccctgacagctgctttcagaaccctgggtgttattctggaagataccagaaccactgcagaactctgaggctgaggcatgacataatttgactaatattttaaagacatccacctggctgctatgttcggaataccctctggagggccagggtgtaggcaggaagcagagaagcttatgtcaacatctatgacgtaagctaggagcttatgtcaacatctatgcaaaagatggcactggcttgaaccgggaaggtagtgctggaggtaggatgagtgtttgaattctgggtataaattaaagggagaagttgcagaattttcagtcaggttggatgcctggtgtgagaggaaaagaggagtcaactgtgagtggagtgtagttccccgtttcctgagaagacaggaggcgggtaggggtggggacaactgtggtagaagaaagggtatgtgtgtgtgtgcacgtgtgtgtgtgtgtgtgtgtgtgtagggagttgaggcatgaaataattatttctattgtgctcgtgttcagtttgataagctattacacagcgatgtcaaaatgtccagtatctaattgaataaataagtgtagtttaggagaaaggcatgggtcctgggtacaaattttgaagtcattagcctgagcctctaatccattttctcattcttctgtccccaggaaagaaagaaaaagatgacctggcctccttgtaaacgtgtgaatggcatacacatacagcacctttaccagaaaagaggtctaagagttcggatggcaaacaaactagaatctctgaatttatggggtaaggttctctggacagtgtcataagctgtgcaattaccagaggatacaatgaagatatttcatcaggtaatgaatgatgagacagtttatgtaactgagagattgcctgtgagtgattactgcatagatttcttagaggcttcatacataacccttgcccacagcacagccccaaatgccaaggaaggacctggggaggcgcgctggcgacctgaacgtctccaggtcctgcctgagtctcaggattacctgcatccttgaaattattcgtaaagctcgacactaggttagatctatgacactctgaccatgttatgaggtcagatgtgattatccaacctctgcagggaaggtgagaaaacaccagcaaaggagactaaggagcagcagcctatgaggcaggtgaaaactgaggaggactcaggtgtcccgaaagccaagggaacacatctcaaggaggctgccatgatgagctgtggttggagctgggtgtgtggctgccattgcggtcttgaaaagtcatttcagtggagtcatggagccaaaagcctttggagtggagtccagaaagactcggaggagagaaattcaaagaagtgagaatagacacttttttaaaggagtttgccagtaaaagggagcagagatcggggaggccattggataggactctggggttgtaaaggattttcgaaaatggagaaataacgatatgatactatgctgaaggcaggactgagacgagaagcgcagatggacagtttaagccagagaaagagctctgtccttgagtaggttggaggggaggatctaaaggatgtgtggagggttggccttcagagagcaggcagccatccttaggaagaggaggcccggctgagtgcttaggcccaggtgcagacaggcagaggggtactgggatttgaggaagaagaaacgtatgagtgatgaaggaaggggagggcggaggaagtcggtatcactgctgggcggcacccaggccctcctgaggtcagagatgatgaatttaaaggaaaactcgtgagcagagtcttctgtttctctgcaccaacactgagctgcaaaggcaaagtagaaagaatggtggatttaagtttggttgcagttttgccggaattgtaaaaggaagcgggacatctctcgatcacctctgcctatgactgtgaatgatctcacggtgatcctccaagcccctctccctcagctctgttcacctccgcctatgactgtgaatgatctcacggtgatcctccaagcccctctccctcagctctgttcacctccacctatgactgtgaatgatctcacggtgatcctccaagcctctctccctcagctctgttcacctccgcctatgactgtgaatgatctcacggtgatcctccaagcccctctccctcagctctgcatcaccgaactgctcaacctacttttttgtcttgacctgtccaaatccttccacattgaaaaaaaacaaaaacaaaaaacaaaaaacaaaaaactttttattgtaaatatcacatagaataagcttaatacattataaagtgaccaactttttaaacactacccaggccaagacacagaactttaccaggtccgcctgaagccctccatgtatctattctcatcacaacaccttcaccccttcctaaaagacaccatggttttgttgttgtttttgttttttgttttttttttttagacggagtctcgttgttacgcggctggagtacagtggcgcaatctcggctcactgcaaccttcatctcttgggttcaagcgattctcctgcctcagcctcccgagtagctgggactacaggtgtgtaccaccacacccagctagcttttgtatttttagtagagacggggtttcaccatgttggccaggatgatctcgatctcctgacctcgtgatctgcctgcctcagcctcccaaagttgtaatcactctcttgtttttctttatcactcaaggttcatttctaaacactacagttcattttgtctgttttgaagatgtgttgtttagtccatcaccctccattgtctttttttccttgcaatttatctgttgaagaaagcaggacatgtgacctacagagtttcccagtcttcattttgctgattgtatccaatgttgcagtttataatgcacctggataatttttttcctataaattgataattggtctataggcttcatttaattcagcttctttccttccttctttcctctctccctaccccctctcttttcctccttttttccttcctccttcattctcatcccttcctccttttttggtccctccctctatctctctgtcctcctttctcctcttccttctttctgtctctctgtaatactacttcatagatggtgttttgtacttctatcaggaagatcataatgtctttctctcttcttgaaagcttagcagtcattaatattcagtaactagattaatttattgggattgaaaaatgatattttaattcaaacattccttcatttattagttagaatacttctattttttggttatccagtggtattgtatgaataggaaaggcaggataaaatatttgaatcttttttttcaatgaacatttataaactcataaacttaaacatattatgtgttaagtgtgttttaactcaatgcagtgatttccttcttgatgcacaactatctcatctctggccaatggcaatcctatcaagatgagtttccataacatgatcctgacaccattcaatagcttcctcgctatctgctatggaaaattactcaggttcatcttacacgtttcctgctccaggccaggaattgcctacttttaaaagaagcactgcttcttaaaaatttcaagaccataaattgggtgctaggcatgttcagtgctcctaagttagtcattgtttctaagtcctctcagttctcactttgaaggacaggtatctcagaactacaaggtttttacttaacattttctgttttacctctgttgctcctttcttccacactggttctcaagaacacagaagatgacataattacaatattccataattgctcatttgctttttctcacattacacaatttcagaataacaataccatcactgtgcctatgatttctgaaaacttcaaatatgttttcatatgctctactcattctcccacaaaatttttaaaataattatactgtatccacactgttaacacatgcggccatttcgaactatgctgtctttctcttaaccttcatgttatcttacttctatacacacacacacacacacacacacacacgcatgcaggcacaaccatcagtacttatgttgatggttgatgttttcccagtaattttgattgcttgaatcttgttctctagtaaattcctcaggaagagttcctgggaaatacagtcactgagttcttccatagtaacagtttatttagggcttttattcttgataatgagtttggctgcataaaaaatctttatattatacataaaaagaatatatggaattatagtttcttacagtatacatataaggaatatacaatcctgatatacatacagggattgtgtgtgtgtgtgtgtgtgtgtatatatatatatatatatacatacacacttatatttatacatacttcccccttgagtatctgaaatctcttacttcatgttcttctggtataaaatattatggataagcctgaaaataatgtttttttcctttgtaaattaattgccctcttttgcctagatgcccaaggaattttttccatttctttagaatccaggaattttgttagagtatatcttggtgctggtcatttctggatcaattttcacaagcatactgtgtcaggaaagttgtactgaatttagtttttagggttcactttgttcagttgctttgatgtttttcttatgtcatttctagtatacatatattggatcttctttacctcacttctaattccaacagcttatctcaaatccctttttaattttcttatttgtgttttttagaatttccttcacttttcattttctatttcttttaagacaatatctattatatgtatttgtgtaatttcctaataatttcctaataacttggttcaccttgaaaaggttattttggctttcctttgatttgaggcattcttccattgtccataaggatgctattttgttctacattcgctgcatcattttaatagccctgtacgggactgaaccttgcttcttttctgttagagttttaccttgttcctttgctgttgctcagttttacatgaaattagttctcctgaaattttacaaagaggtaggattcagaaaaactgtagacttttctgttctggtgttttaggcagtgttcaaaaatatgggggcttcctttctgcaatctcacaactctgttaccccatttttaaccggactatctccttcctttttttctcttctattttgagcaaatttctgctcagtgtggggctttgtcctgaggagggcctttgcctgggtaaatctggtgagtgcatgagacctaaagtgctccaagccctttaaaccttattacagacttttgcactcattcctctatccttttgtgcatccacatggcctgagtttggcatagtatcttgtcaatagtttgtggacagtaaataattataaattaataaaatctaactccattaagtgacaattaattaaataattctaataagataatcaatagcaatggaaattaataacagtaactcaggattattttacctacaaaaataattttttaaaataagttgctcttaagtaattgactattttctcatttgacaacacatcacctagtctatttaatttagttaggtaattttattactatgacaatagcttttatctcggaagaagttaatgtatggacaacgtccaataacaatttagaaattcttgttgactgcattcatagtggtctcaaatattgatggaattttaaaaattatgtccccctttccattcattagctagggaatttattaaaaattattgttatttattttgtttatgataaactcaagagcatttgagcatacaattcctttttcaaaggaagacaaatattttaacatatgcgcctgggaatttctgatgattaaaaagtacacacaatacctgaaatatgcctattgaaagtattacttttcaaaattaacattgtgatatttataagaaaaacactgacctggaacaaagaatgtgctagtatttgtagaaagcttaatatactaaggaaataatttagtcatgtaattacatatcattagcaaagatccttactaagttaccttcgagatataatccacagttttcatagatccttttaaccatttactggcacgaagttgaaagcgcattaatggagatttgtgacaaactagcactaatacagaatactgtatttatctcagtataaaatatgtgtgataatggtaaagtaactaataaatctaccccagttggtggaagggaacaaacacttcccttgatattcttgtattggttccaagggcttttttacttatcaatattgaatagcattttataaacagactaacttggaggaatgtgattaatttataatgtgaactgggtttatatagagtccaccctcaactgagctcaaaagtggaaaaatcactcatgcatgttttgtctatggaatgcacagtgagcatctgtgtgtgtgtagatatgctaatatttacatgtcaaactatactgacagttttaagctattaaaaatagtttgcaaatttctagatatgctttcataaagtgaataatccacagacaactaaaataattttgaatttattgtacaatatttgcaaaaatatttgaaaataaatgtaaatattcacaaagaatactactctgaacctaaggaaaacaataactgtttttctcctgtattttatcagattatagcaaaaaatacatttcattagtatgcgttatgcaggtagaatcctgactcactgctatactttctattttatttctttggggagtaaattattcagtctttatgtgaatgctcatggattctcttaagaacaaaaagtattcattttaaagcataaaattcatagaagtttcaataaactcgtattttaagaatttaaataatgggtcatgggagagtataatgaaatagatattgtattctgttagtctgcaggttaggagacctgtatttgggtagaaaagtgttctataatgaaggaacggttgcacgttcaagccccagaagggccagtgaacttcccctttcttgctggctgttgactgcatgttaagtacattaaaggaacatgggtagtcacctgagaagtgtggctatggggaaaccaagcgtaaacatcccccaccactgaaacaccatccaaaaggcctctcctctgtaggagagaacaggctgcttcactctgatgcttaatttgcatgctttcatagaaaaagaagaaaagaatctaattttaaaaactacaagaaatgtgaagtacagggatccgaggtaaaactcaagtctgagaaaaatggcacatgttctgtcaaaatgagtcaatgcttgccagccatccaggagctatgtggccccctttcaggtcctccaagctaaggaggttgattttgtgctgtcatagtgtttcccagagtatccttttgggggcactcaggtacagctcttgggtctcctttgcttccccacaccactccataaattatagcttttgttacatctcagccaaaagcacttcggggactccctccctgggcttctccctcaatccctcctagagcagaggggtcgtgatcaggcttctgttcactgagctactgcagtgaaccaaaccacggcaccgacactttgctgctcggttaattctctgtccactctgtgaagtgatggatgtggcctcggagccacaaagaagtgccatcttttgctgacatccacacaggcagagaacccacagtgctgcattagaactaaggctgaaactttcaagaccacgctttccacaatacccagctgcctctttctcttattcccttctattaaaaaaaattcagtcaggtatagtgactcatgtctgtaatccaagcactttgggaggctgacgtgggaggatcgtttgagaccaggagtttgaggccagcctaggcaacacagcaagaccccatttcgacaaaaaattaaaaaaaaattacctgggcatggtggcatgtacctgtagtcccagctactcaggaggctgaggtgagaggatcatttgagcctagaagttcaaggcttcagtgagctgtgatcacaccactgcactctagcttgggcaacagaatgagactttctcaaaaaaaaaaaaaagaaaattcagctcactattcctctgccatcttttagaaactaatgaaaaatagtttattatagaacttcctctttggattaaaaaaactataataacgtcagagaggaacatcagcttatgatttagccatttctccttgctatgcagataatgtcccattttctatacgcattagaaatttttttcaaaaaagaagcactccttagattgtcagtaatcttcatcttcctttttttttcatttgcaggtagttagcctgagagcatctgtgacagcctaagtggtggcccccatgaccctgctgtttttcttctctattctgttgctaataatgttttcttcatccctgaacatctgtcagctactgatgaagtgaattggctagagaaagggctggaccttgttaattgcatagaaaaaactatcaagatggctgaaatcaaatgcaaagaggcaacatcaaacaagacctaaaaaaaaaaaaaaaaaccagtaaacaaaaaaaacaagcaacagatcatatccggaagcacagtttaagaagtttttggtttttttttttccagatatttcaggtgacccaatgccaaaaagcatctcatcttctagtagttgtggaatcttctggaaaagagatccaaatcaactggcttccttgtcccctctccatgtgtgacacggagcagcacccacttccagtgtagctcccctttcaggggagggctacaaaggctgttttcctcacaagagttcctacagctgatgtgacttcagagactcctgtagactatggaaacagggtggtgaagcgtctcctgatggagcgcactgcagaaagcagggttgtctgtggctgtaaattatttcactctttgctctcatcccagagaaacagtgttagggtagcacctaaatctgcaaatccaagagccttgcccctcagataaatgagcgttgcctctgccttccttgaaaggagctggggcacaggtcactgccaccatcctccttcctggctccctagtctttttctttccctgaattcagtattttcacctctcttctttctgcttattctctagaagctctttgtccagtcctgaagcaactgcgatggtttctaggtgattctgagggaagggtgacatgtcattgtctggaagttttgtgtaaggctacgggtggggcagtgaaatgggttagctccactgagcatttaatgatctaattagaacttggatgaaccaaaatattttttaaaatcatgtggattgtattagatggcttcatatttataactatctgaaatggacaagcctctaacactgaggaagccttttggggtgaaagccgagaagctgccttaatgccaaggcacacctgagcacaggtaacaacagccaggtgctctggatgtccacctacgtccctccaaagatcatcacaatgcatccctcatgccccacatcattgcttcagaggctcaagctgcctgtcattcttatcacccaaactgtcagtcccatatgggtccatacgtttcctaatatcagccaatttccatgcttccctctctcctaagccttttttctgtgtcccctgaaattcctgttcatgataaactaactgccctgtataatcagccttttgaaaggtttccctgtccacactgacttaactgaaactgatccatctcccttgcaaccttttcaagtgaaggctgcttttcatttcatattcacatctttcaaggccagaggtgaagatggttgtcccttggctccttaacgacgcccccaaatgcttgggttcctctcccttgcaaaacccaccactcctttgagacccatgcttcaccctcacctcctcactgctgccccctgatctcctggatgcagcccctcattcttgaagactgtagcttcaggctgttctcaccttttctccgattcttgtcatcattctggggacttgaactcctgtatgaataagccaccatcaatctattctttctgttttaccttctcatcctgctgacctttttctcatccttctattcgcacggtccatccccaggctctgtcatcctgagaaactgtaccacctctgaaatcccaattccaaatatgtctctttctgatgatcacctcttatctttccaaatctcttgctaaagtatgaacattgcttaaattcttcaacttcatcaagacgtctaattaattggccccatatttcctctccagccatgggcctctccaggcccaccttccttcctggtctgacagcttctgtcatctaccaccagaagcattgcctggaaaacacagatttccgtggtcttctttatctgatggcaaaattccacgcctggaaaacatcacctccaccttccctgggcgtgtagccctgcagctggacacaatggcacgatgactttctcttaaataatggaccacaaacttcaaatgggcatttacaacttcctcaagattgtattgtgtttctccagtgacatgttctctcttctttcttcccctcaacccgccgaaaaaaggggtgaaataaaaaagatgaaatgaggatagttacaaaagcataggagatagaagttttcacatagcaagggtaagaaatatttttataaatgttggtaatagttatgataattagtagaattaggataacagtgaagtagttatagaagaaaatgaatttattacttttatctggagttgcaccaattttttggttcctaagaccaatgtaggtaggacctgcctctctccagccatccatactttatatttcactgaggagagaggaatcatggctgatgtcctgatgtgctcaacagatgtttcctaagcacactctaagtgtcaagtactcttctatgtggaagacgcagcagtgaaaaatgacatcttccttcgtggagccatcatactgcatctctcctcttcacatccctgcaactatgaacacacctgcacctgcactcaccctctccagcccctctcacaacacaaaaagtggccttcctcctgttaggggccgattcctccctctctgctggatctgagcccttcttgccttccaaagtacttcccttcttcagttcttggatctctctctcaaattaccggtaattcatctctgtggaatccttcctgtgagtgtaaaacaagttctggcccttcgatctttaaagaactgtcttgtggttgctgcatttctctttctcttcatagcaaaccctctagaaggaattatcctccccttctgttcactcttcatcccataaaactctggctcctgtctttacgcatcccccaaaactgctcattatggtcattcgtgacttttgccacagtgtcacaggcgaaggacgctccctgacctcatcttctgcaaactctcagtagcattcaacacaaatcaccattcctcctctggaaggcccgccttctcagcttccccaacaccataaatcagcattcctcctctggaagccccaccttctcagcttcccaaacaccataaatcagcattcctcctctggaagccccgccttcttggcttccccaacaccataaatcagcatttctcctctggaaggcctgccttctcggcttcctcaacaccataaatcgccattctcctctggaggacccgccttcttggcttcctcaacaccacaaattgccattcctcctccggaaggcccgcctacttgccttctcagcttcctcaacaccatatggccctggattgtcttctactttccttgaggttccttcttggtctcctttgttggttgctgctctttacccaatttccaaacactggtgttccttacggttcatccaatcacggtctctcctttcttggcttcttctgagaatccccatgggtttaaaatttcctctacatgctggtaattccaaagttatctctccatctcggacctcaggtctcactgtcctccaagctctcactcacacatccaagtcccgacttatctccttctccatgcttcaggcatagcaaatgtgttcagaattgaagctcagatcccatgcctctgatctcacctgccccattttgctcatctcagtcaaatagaactttcaaactccttcctttccctgacccacagccagtcagtcaccaagtccttgaattctgcctctcaagattcacttctttttgtctccgctgccaactgtcttaatccagagcctctccatattgcaacaagattgacatactcaaaatgtaatttggataatgctaaccccttgcttaaaccttcaaggatttcccactaaactcagaacaaaacccatatgcttaaccctggtgtccttggtccaggtggccttcatcttttggcactgtccttcctgctcagtattttccagccaccttggtttaatttagtgtcttgaataaagcaagctcttcacctccttgggggcactggatgtgtgctttcctctgcttgggatgctcttctgcccactcccataatgctagctccttcaatagctggtgtcccctcaacgcttagtctcagggctcctcaactacccctcatctaaagtaggtgacatccctatttgttttcatcctagcatcaattatgatcagtaactgtgacttcctcatttactattttatccaacactagcacaataatagtacaagaaagtattcaatacatttttgttgaatggataaaggttatttccataaaatttcagtgattaaacctaaggtggaggaagctggtataaatggaggtacttctgaaatgcaattggttcaaaggccctacaaacctattgactccagacatcatacctgatttctgaagggctcacctggaactgcagagtgactttagtttcctacaatgtgataatgtctttgccaaagaatttggactagggggaaggagtgttgaaaggtgctatatgaatatgaattgtgaacacaaatcagagaaggggctaagaagctaatataaatgtattattttaaggagtttatttttattttgggaaggcagtgatacatagtgtttaatttttaatccaaatctaaaaaatcaagatacctactaaagatcaacgaaaacagaaaggaaccacatacaaagaaattagaggtctgctgtgggtctctgccatacagtaatgaattagtaattaaccagcatttttgtaggttttatcaactcactttctaagtgagtattacgcttactttactgtctattttgttgccactatgtaaagctggaatataaacagcatttaaaatcagaggaattttagtatagcacaatatttgcaacttacttggcaacctatttatttacaaatattctaagagatgattgagcttcactctcccttgtctacaaaaagctaagttagagaaacaaaaatgatttgtccaaggatgcttgtaacagacattaatataaacattttattttatcaagtgataacagttgcctcaagcatccagtgagatcccaagagtttcaccagctcctggagcagttgcccccaccgctggcaggaatgctgggacaagagctctctgcttcctctcgggagcctcattgccaccatctgcctagaggccagtaggtcttgtcatgaataatcaggatataaacgtccctgactgatatgccctgttcacgacagtcaccaaagaatgcctgactcctgttccatctctccaggctgagccccaagctccacatccactctgtgtatcctttttcctaccacatattccagctgccccaaaccctgagacccttcccccatgcttggggaactcatgggcaatcagcagtaactgccctatgactgcaatctgctttctcaatgtttttcttacattcttccctaactgaaacaggcgtgtccctgaggacactacttcgcctgcagcaccctcaaatgtttttgtgtctgcaatcccagtaccacaaagcattgctctacagtgttgtaagtaaaacattttccctttctccttctaaagccctccaactttccatttcaacccatcagcctacaccatgcactatttccccttctgctgtcagctactgacatccatttctctctctctctctcatttctcaaatcttcagtttgcaattctggaagatctcagcgtgcacaggggtggtactcccaactctccgacttcccaattccatgacctcaacttctctcgtcaccttgtcctccatctgaaatcagacacacagcctccctaggcctcctctgacctcgtcggtgctgaccatgcagctcctccacaagctcgatgtgaagtctttcattctttggccaatgcctgtttgtccagttcaacccttctagtactcaaatcccgaaaattctttgagccactggcatctgtaaccaactttccctgtcctctctctcatctgggttctctgcttgcccagctgaaatttcatggtcggtcataatcactcccttagattcaccctcagcttacactgttgttgtaacactgtaagatgagatccaccctcagcttcttagcctccctcttgtttttgttacattttgaccgcaaaacttcaatgccagtgccttttctgcatctgtgcctacacagatgagtgtgtcagaaaaacacccagtggattgacctcactccaaattcaaccatttcccaagtttattccctcctcaccctcctaaatgacaatttcattatcctctcctgacatggtttggctgtgtccccacccaaattctcatcttgaattgtaatccccataatgcccacacgtcaagggcgggaccaagggtggaagtgattggatcatggggatgattccccccatggtgttctcgtgatggtgaatgagtcctcacgagatctgatggttgtataattggctggcatttcccctgcttgcacttttctctcctgctgccttttgaagaaggtaccttgcttccccttcgccttccgtcatgattgtaagtttcctgaggcctccccagtcatgtggaactgtgagtcaattaaacctctttcctttataagttacccagtctcaggcatttacttatagcaatgtgagaccagactaatacatctcctttccctctaaaactcttccccgatctgtactctcagctgatgacctagcttcctgttacaccaagaaaagagaaacaaccagcagagaccctacgcaaggtttaccatcaaatccaatgctcatacgtctgtgcctgcatattctgtctcccccactgttaccaggcggaactggccactctcttgtccaagcccatgcctacatccaaggacactgctcctgaattctcccttcccccttctgcatcatcagtctcccaactcctctactgaatcattaccatcagtacatagacatgctgcaatttttcccattaagaaggtcattttcttatctccatccctcagctacctcatttctttgctttcctcttcagctaagttcccagttgccaaaattaaaatgtatgtatttgcagtctcccactctttggttcacctctcacatgaatccattcgaggcaggctttcccctcactgcccatggtcaaggttaccaaggacctccacattgtggagtccagtgctcatttctcatccttgtccttcttgctgagcataggacacagatcatgattcctcctcctaaagatgccttcttcctttggctcccaggtcatgatacctgcctggattttttcccaccttattatcattattatttttctgagacagagtctcactctgtcacccaggctggagtgcattggcacgatattggctcactgcaacctccgcctcccaggctcaagcaattctcctgcctcagcctcctgagtagctgagattacaggcgcccgccaccacacccagctaacttctgtatttttagtagagacagggtttcgccatgttggtcaggctggtctcagactcctgacctcaggtgatccattcgccttagcctcccaaagatgtgggattacaggtgtgagctgccacgcctggcctcctcccactttattattgcaaccctatctcatgcaatgtggctccttcctctttgttttgctctgtcctcctcccctcccctccaccagtcacacttgtttctggactattatgaatgttaaagccaggcacatgatcacattggagcctctgttgttgcttcatccactctgtggaaatctcctttcccagatgtcaccatgaggcttctctggatacctttcagtctttattcacctgtcacctgctcagtgaaactttccctgaccaccttatataaaatttcacctcttcctccagtattcactgtccttgttttttttttttttttgtgtgtgtgtgtgtgtgtgtgagagagggtcactctgtaacaaagactagactgcagtggcacaatcttggctcactgcaacctccacctcctgggttcaaatgcttcccatgcctcagcctccagagcagctgggattacaggcgtgcaccaccatgcctggctaatattttgtatttttagtagagatgtggtttcactatttcactatgttggccaggctggtctcgaacttctggcctcaaatgatctgcctgccttggcctcccaaagtgttatcattacaggtgtgagccaccacacctgagtgctgtcctttttcatttcctttttctccatagcaatgatagccatctaacataatatacactaaatgtgtttatgtgtatataatatggttttctctaagtagaatatggagatttttcactcctctatccctgtaacctaggatggtatatagcacatagtaggtactcagtaagtatcagctgaaagaaagaaggaagtgtgtgtatgtctgcatgtgtgtgtgtgtgtttgcgcgtgtgtttgcgttttaggaaatagagatcaatattgctctgatgcactatattaccaaaactaatcgtagtgatattaattttgattatggctcaattaaatttctaggagaatgcaaagtgacctgacctttacaaagcagatctgaggagatgattactgttggcttctttccttactaattacccatggactctaaaacaaaaatggaaacactgcaaatattggtacaagtttgaagagaagactccattatctgagcagaattgtcagggtaacaaccagtgattcttgctttaagaagtctttaggctttcactgggaaatggctgtgagatccaggtgtcttcacaaggagttatgtttgggagagtcagttgtcaacttttacctgcaatacgggataactgatttcacttgtatttgaatatacatttatgcctgctattctggaaactcacaatatagaaaaatgaaggggatgtactgtaattctctaactccaggatgtggcagtgattccagtttcttatcctctccttactaatccttttgtttttattctcatattggaaatgggcagttttactttgccacatacatacaccaaacaaaaacacacaaaccaaaaactcattgatgaaagtgagctgccacatctccatttgcatatttcctggtcaaagttggcagagacaatctttaggagtaaaaataaataacactgggctgggcgtgatggctcacgcctgtaatcccagcactttgggaggcagaggcaggcggatcatgacgtcaggaaatcgaaaccatcctggctaacacggtgaaactccgtctctaccaaaaatataaaaaattagctgggtgtggtggcgggcgcctgtagtcccagctgctcaggaggctgagacaggagaatggcgtgaacctgggaggcggagcttgcagtgagctgagatcatgccactgcactccagcctgggcgacagagcaagactccttctcaaaaaataaataaaataaaataaataacactggaagttaggtcaatcagccttttgccaactctttagtgtattttaaggataacttgacacctagatttaacatactaatacagagtttgtagttccatatagggatcaagaaacgtatttttaagcattccatactatatatgtgtgtacatatatataatatttagcaccctgaattatttacttagcatatctatttaaattatgacacgcctcactgagcacaacacagcatttaaataatccacttcaaatggtcaccctttgtatagacgtcacatgttcatacccgtgtacaaaaggctgccatgaaatacagataacaaacacccaatacaaaaacctggtaaaaaaaaaaaaaaaatgctcacacattcacccacagacagcaacttaggaatgtctatgaccatcgatccctcaggcataattcatctctgcatttatttgtttgctcatctgccactatgcagtgcttgcttcctgcttgagtcttgagatgaaatgcactgcactggcagatagcagatgtagcaattaataacctgtcaggtctgatggatagaagaggaaaaaagtgtcctcacacatatctccagcatggttttcttccccatttcagggcacccagggtcaggagacatactcggcctccctggggagcccaaactgtctcattagcgtctatctttcatgacagtctgatgcagcctttgagatgctcactcacctgctcttctcccagaatcctgaagtgatggagctctttaatcaaggagttgggacagccagctgttggaaagaagaattaatcacaaaaacgtcactttcactctgtgtggttatatgttcttacacagagttatgactatcaactgccagtgttgccttttgggaggacacagacgtgtacctgaaaaacacacatctaaccaaccacaaaaaaagccaaaccctcaaaagagctatggccgctgcctggcctccaaccgcacctctttagaaaacagttgcatgtgaccctggccaggctttctctcccctctgattatgatctggccttaggatgtcatgccactctggttcttagaaacatgttcagcatgtcactggttcctcatatatagccaggattccgcagggccagagtaggggagttggtgaccacaggctctgacttattcatcatgtcctgtttgctcaccatcaaggccaggggcctgctcattgagaggtaagagcaaaggtcgggtagctacacatccattctttggggggctcagctggcggttagtaccttgcctggttttgtcaagaggctttgtgaagacctattagatcttgcgtttgagtttggaaagggcatcttacggaaggaccaagagagaaggcccagcagttctggtgcctatcactttctcgttccacccaatcaatccaagctccttcagactttcaccttttccttcttcagttgtaaaacaaagtaagtaaataggtaaaaaaaaaaaaaaaaaaaaaaatatatatatatatatatatatgcacacatacacacacaattaaaatacgtatgtataaaatattatataattatatttaatgtatagatatgagttatatatatttttatataactcacatatataaattatatatgtaaatatataattttatagaattatataattaatataaatattggcctaaatatatatatttatatataataatataacatatataataaatattctatgtaaaataaaatacagttgaccctggaacaacatgggcttgaactttgtgggtccacttatacacagattttttcttctgcctctgctacccctgagacagcaggaccaacccttccccctcctcctcctcctcagccactagctgtgaagagaatgaagatgaaaacctttatgatgatctgctttcacttaatggatagttaatacattttctcttcctgatgattttcttaataacattttcctttctctatcttactttaagaatatagtatataatacatatgacctataaaatatgtgttcatagactattgatgttataggaagggcctctagtcaacagtaggttattagtagttaagttttgggtgagtcaaaagttccacatagttttttgacttcagggatgttggtgttcctaagcctcacattgttcgaggcccaaatgtatagatatgtaaaatttaggccagtatatgcttaatatcatttaaaatgtgttgcatccctgtcttttcaatagaactattcctcgatattaggttgtagtcatttatactattatttttttgagtcagggtctaactccaggctggggtgcagtgtgtaatcatggctcattgcagccttgacctcctggctgaaggtaccctcttgcttcagcttcctgagtagctgggactacaggtgtgtgcaccaccaagcctggctaagttttttattttttcctaattttttgtagagatggggtctcactatgctgtccaggctggtctcaagctcctgggctcaagtgacgctcccgcttcagcctcacaaagtgctgggattataggcgtgagccactgtaactggcttatttatattattctctctggaaacaaaattgatataaaaacctgtttctttgagataagacctatggattatataatctgttgaacttcctagtaaggaaactggattgtatgcaggacatatcaactaaattatggagccatttctcatattcctcagcattgtgatgtgagagtggtcagaagccctgagagtgtttgtctgggggagggcaggctgaggaatgagaaaacctgtattcacacaggtgaaggtgctcattgcgatacagattagatctgtgcattgtttcagagagtaggatttaaaccaacagaagaaaatggaataaactgccttataagacagtaactgcaggtttttcaacacatgctaaatgaatacttatgtaggatattttagagaggaattttactgggtatgatgatgaatttatgtgtctacttgattgggctaaggggtgcccagatagctgataacatgttatttctgggtgggtgtgtgagagtgtttctgggagagactggcatctgagtctgtggaccaagaagatccactctcagcaatgtgggcaggcatcgtcccatccactgagggcactgagggcctgcacagaacaagaaggcagagaacggtgaatgctctttctcttctagagccttaaagatcagatttcctggttctcaggccttctgactgcaagacatacacgactcccaaacctgctgcccctagttgtcaggccttcagacacagactgaattagaccaaaggctttcctggttttccagcttgcagatggcagattgcaggactgcttggccgccataattgtgtgagcccttcccccagtaaacgtcctcttgtctctttctctttatagatcctatagacagaaaggtcctgtttcttgggagaagcctgactaatacactgagttatttccaattccaaaattctatggtcatgtaaaatgctggaacatagctttagcctatattatataacatttcatatgttgagaaagtgcttcacaaatgtttactgagtagtacaaaagattacaaaaatgtgaacaaaatttaaacacacgtgtaaacaggtgatgccaccaagaaaataaataaaaatcctggccgggcatggtggctcacacctgtaatcccaggactttgggaggctgaggcaggaggatcacaaggtcaggagtttgagaccagcctggccaacatgatgaaacgctgtttctactaaaaatacaaaaattagtcagacatggtggcgggcatctgtaatcccagctacttgtgaggctgaggcaggagaatcgcttgaacctgggaggcagaggttgtggtgggctgaaattgtgccaatgcactccagcctgggcaacaacagcaagactctgtctcaataaataaataaataaataaataaataacccaagtgaatattttactggaaaacataatacattagctttcacaggcatgtctggtactgtagagaaggaaaaccagatccttcaagtgagaaacagatgcttgagctgagtgcttctccaactagagaccacggagacttgcaggctgaagattctttttgagaagttgttgattttggggttgctattctgatgattacctaaacaatagtaaaaatatattctggatcatttgactggcttcagttcaaacaaaaactgctgtgaaattcagcctcaagtcagttcctgtgctttggatctctttgggagcaagtcatcatagtttagtttcctgaaatgagtgagaaaagagtggatagaaggcaagggaggcttcccctgccagtgacgtcccatggtctggggccgagtgtccgaagggtagagtcacaggagaagttgtgggggaagggaggcagcctacagctcagggtcccaggcctgctgagatggaacatttgaatctgggccaactcatcagggccctgttcggatcccaagcactgctttagtgtcagtaaaatgacagcctctggcgtattaaattgatagagtccatcagaatattttggtcttgtactttcagttatatttaattgatatgtttttatttgggccttctagttgtataagcataaagtatttatagctcagtttatatctagacacattgaagacatattgtcttaaaaataatttcattcggccaggtgcggtggttcacgcctgtaatcccagcactttgggaggcagaggcaggcagatcacgaggtcaggagattgagaccatcgtggctaatacagtgaaaccccgtctctactaaaaatacaaaaaattagcctggcgtggtggcgggcgcctgtagtcccagctactcgggaggctgaggcaggagaatggtgtgaacccggcaggcggagcttgcagtgagccgagatggcgccactgcgttccagcctgggcgacagagcgagactccgtctcaaaaaaaaaaaaaaaaaaaaaaaaaaaaaaaaaaaaatatatatatatatatatatatatatatatatatatatataaaacttcattcaaccttgggtgttttggagaattttttgtttctttacaagcggtcttttatgtcactcaaacttgagaaaaatggctttattttaatcctgcataaaataagaaacacaattttaaattagcttatcttcagaatgtgtattctggctgtctcctaagatacaagtgaaaggactgatgttgatgatagctcgtatataaacatctttaacagaagactagataattacttgaaacacctggtaggttcaaaaaaacaacaaacaagactagacacagcatagacttagatgagaagagctggaaggcggcaagatatttaagaagaccgtggacggctatctgcaaactgtgctcatcacagggacactagtgtgggaaatggccagatataaactcagtgtgaagatggggcttaaaaataacaaaactggaactgcaagacgggcccacagaatgcattcgcgtagggagacaggaaaacgttagcggagggggcggaggtggcagagaggaaaacatgggcctggcgaataaaaaccacagtactacttctggatttggagcaatagagaccatgtccgatccttccatgccctttaagcatcacctccctcacatatgggttcttctgcattgatttttggtaaatctgcgttgactcttaatgactgcatattactttacgtaatgagtattcctgatgaaattcgtgagtaagcgctcacatgatttttttctttgggtgtttgatgggtgaaactggtatcaaactcactgcttttcaacttttgagattcaacttttcctcattctgaaaagttaaaaaatcatctccggaactctgaactctttattgtatctcaaagattcccggcagcatctctgagactataatagaagtgtttggacatctattggcatttaaaatatttgtatatgccatattatgtcatcatttttcttaagcacaaggttctccttaaattgttattctgtcctttctaacatgggacatattctctttgctcaagaaaacagaacacacaggaatcgagtagtgtttttacctactgacactgtgttagctttcttgacaagagcctattcttctctatcttttccctcttttcttgtcctggactccacttttaaagcccgtcctgctgtccttggaaatttaaaagagaatgtcacctctttccgtgccatcctcatgccgtgctcacaagtttgtgctcttctgtcgtgtttttcctctagttattaaacccatcactcaactgttgcctgtgttttctaaaaatctgagctcattggtgttcaatgaataccagctttttggtgttaaaaatgaataagacaatttgttaaaaagcatataaacacaggattgaatcttattttaaaggacaactgcgaaactgggctctatatttcaattagtatctgtaatcaacatttacttttattctgttgctataccataaaggtcattttatcatctaacggggaagctcctcaatgaaaacgcgtcacaaagttgtgtagcatttccacaaagtcactgacagctactgagaaaaagcaaccccaaacaaaacaaaacaaaacaaatacctttgagagattaactgagccataatgttttcagaaagctttcggtgaatttcctcaacaatcatgctgtaaagtagggaaaactcatttggaaaatatattccattgagaagcattaaaaaccacatgagtcttcgatcactatttttccttttaatttctttgcaagtcatcacaggagcaattgtgatatcctttgggttcaatggaaaatcgtgagcacccaggcttgggatagaaatggaaatggatttcagctctctgatgtgctcctggcactggtcacatgacacaaataatctgcaatttgcagattgctgctgtttggtgcgaaacgctttgaggattaatttctctctcggctatagcttagaatccctaatgtgggcttgacaattacagtgaccttctatttcccccctaagtacaacttagaaaaggaaaccgactaacgacaaaatggcatcaaaaataaatgaagattcaatgtgatcgaagacaatgcagcgagactgaacactgacctctgagcacaagccagagagcatgggccacatgtgcaggctgggctgcagcagtgaaggaatccagtgggcggcttgctactccagctaagccaggttgattagggttgccatacactgtgctgaagtagccatttctgaattagtctgagagccaggcgttaataggatccctggaaaactcactaagctgtctcgacagagtaattgcattcagtcagcagcaggactttacagaatcaagtttaaagcattatcgttttcataaataaagccaagcttattttaatcctttctctctgctgatgggtttttatttataaaggattattcatgcattctttctccgtagccaatacttgctgtctcaagatatcctaagccagttaaggagaatcttgaagatactcaccttccacctaataatgtacttacaggtatacacacgggagagtaacttacatggttacacaaggagatatggaatagaatatttactgcgacatttttgtaataacagcaacaacaaaacgacacatctaaaatgaccatcaacagaagaagagataaaatcattcaacaaatagccattgtgcacccactttgtgccaggcactattacgacacttgggtcgcagccgtgaaaaattaaaacagacaaaaatccctcattggagcttgcattctaaaggggcgagagacaataaaaataaactaataagtaggtaaatgaagtaacattttggatggtcattagcactgtgtggaaaagagaaaatacaacagtataaagggcagggttggctaacgtaaaagtaagtgttcatttcttattgagaccatgacactgaagcacagatttttaggaattgagttaatatgagttagctagagtgaaatgtatcaaaacaggtaaatctcaaaatcataaagttgagaaaaaagttgcaatcgtttatgcacaatgcaatgtcatttacagaaagtttagagaatctattaaacaatgtcgatgcacgcaaatatactaagaatataaaataatgcctgcaaatgataaacgcccctgaagtatgtatcaaattgaagggaagaggaaagaggaacaggaccatagaagggcactgctattcaaatctgtcttaaagtgtattacaataattgttaaaaagaaaagctaatacttctatgatgcttagtaggaacaaaacactcttcacagtgttatgcatgtaattcatttactactcatgacaaccctataaggcaggtactatttttatccccattttaaagatggcgaaatcgaggcagaaaaagaactaaactaatgaagtcatcaaagccgggtagtgtgtacatggacattgattatgctactttaaatatctaactggatgtctggaacttttcataataaaaatctctagatgaaacctttaaagtacatctaaaaataaccttggaaaaggctgaataaaaattcaataacgtatagacctgagtttgtgaacatatatgagcatgaatgtagtctggagaaggaaaaccttccaatacaaccactaattagtagacataacttatctgagtagtatagcatgaaactttgtaaattttgatgctttcagaataagctgaaagaagccatgaaatattatctattcaatttcttacttgtagatgaggcagttaccagtccagaagatgcgaagtatcttttaggagctcagcatagtgtgtatgaagctcagatagctgtgatttcataatttatattaaaattgatgcagattggtattttctggttttttgcagctgctgtattaatccaaacatccttgctgggtcagcttctagtggctatgagactatccatcttccaatgaggtgccagggaagaatcagtctcattgataatgagacacgatcagaaattttcatttcacaaataatattatccttattggccggaggtgaattccaagtaaatattcattgattcttcatcgaacaactcttgagtgtacacttactatgcgtaacgccaggggccatagagaaatcataaatgaatcagacagggattctgccttcctggagcttgcagaagaaataagacgcacaccaacaaaccaagtagatgtagaaagagccaagtgagcagagagcaaccaaagaggtataaaaaaagaaaaagaggaggtggcttggaatcaaagaggccaaagcctggagtgtttgaggaatccaagcagctgcttggctgcagatgagaattgaaagcacctgcatacacacagcctacctactggggctgagaactgagaccactgagacctaattatttgttccagaagaattctgccctggaagataagcttgtaaagcaataaataacttcactgtttgcttcaagaaactcctgcaaataatttaaccagacagtttgctcatctgagtagccatctctcttaacaggaaatcagacggttcacctgggcaataatagctcttgtataagacaacagtttccttatgaaggcttccttaggactttgtctcactgtgtccactgaccccaaactactatgtcattgatctgctcaactccaatcagtttcccacttgaaagatctgcaataagcgcttaagcccagatccccaggctctatgaacaccctcccctgacctctctttcctgtgacacctccatgactgtccacacgatggtgtcacttcctgcactagatctaatcagcgctgctctgcaatagattttctgtggtcatttgggaggtttgagacagaggacaaggtagaacatgcagtaacaaaagatgaaaaacacttctcatttttcttatttgtatgtcattacaatgtcaaaacaacttaaatattttgaattgtgtgtatattcttggcgctttgccttcacctttgaatttcataaagttcttcctttgttattgacctatattttgagtgattgtgatgatacattttacagggcaagtgttttcaacatccagcatccctcagatcacaaatttaatttggctggtcaacacatgagtggccactgggaatgggaggctctcagagtgaaaagggatccttatccattattttctttctcctgctgctctcaaaagtttgtccttggttgacatcagagaaaggaaagggaggaagtgaaggagatggaattttgtgctctctttaatatgtttttccacagattatggtggttggttggttacctgagtgaaaatgtcaatgtctagttaacgttgggggaaagagaatctgtgggactgtcatcccccaagtgggtgtaaccaaaaagggcacttaggttaggcacatccctgtcagataaggcctagttaaatagggtctagagggtcagcggggcacctaattatcatggttaatgaggtttctttaggagaaaagaattctgagttccaaacaatgtatagacatgaacatttatggaacactcccctgtttataaactggaaacttgtgtaatttatatttgtaccctatacttcgccatagagtgtgctctgtaaactggccttccttgtagggcatgttcctgaatagggcatattcaggcactattaagtttgggaaaataaatcatatccaaaaccagtattaaataaatataagtcatcggactttaggaattgatgcaattccttaaatggaggaatttcttaaatggacacaattccttaaaaatgaggtaaagagaggggctgggggtaaagtggaatggggcaggggaacagaaaagagtttatagttttacaagtacttaatggtattttttgtttttgaattttgtattttaaattcatttcagtactttcccttgtcactttagttctgtgcatttggtttcttttattcatcttagcgtaggcataactgcattcattactgaaaggcatctttcaaattcttataaaaaacaaaacccatgtaagcactctaaatattgccacttaaattcatcactgcttttatatagcatccctgcttttatatatttagagtgtatatgctggggtgagatacatttgaaagagattatgaaaataaaacaaaaatccaatttaaaagacaactaatagcttctatgatgcgggaaaacccacacagctttgagtatattgttaattacactatggtttgattgcccagatctttgcattttatcacgagaattagtaattattctttattttaattagccaaaatgatgaatctgagcacgtctcatctgtcagagagttttaccaatgagctcaaatttgctatccatgttttgcagtgcagcatcacaagtgttcaaccaggtgcctctaaaacacgagaccttgagccttggtatgcggctcaggtgactgcaccatggccctggtataagcaattccagacagttaaatccagcccttcatcctgcacacttacataagaaattcatttatagacaatttttttgttgttgtttgtttgttttttgacacggagtctcgctctgtcaccaggctggagtgcagtggtgcaatctcggctcactgcaacctctgcctcccaggttcaagcgattctcctgtctcagcctccccagtagctaggactacaggcgccctccaccatgccaggctaatttttttgtatttttagtaaagatgggatttcaccgtgttaggacaggatggtctaaatttcttgatctcatgatccacccgcctcggccccccaaagtgctgcgattacaggtgtgagccaccgcacccagcccaaaaatttgttttaagcaagcacttatcaactagaaaatgaagctcaatagacacggatatcgttggtgtgtcaaagctgaagattatcctaggaaaaactttcatctatctgtgtttgtgtatttacaacttcctctatcatccagacatggtggctcacacctgtaatcccagcactttgggaggccaaggcagatggatcaccttaggtcaggagtttgagaccagcctggccaacacagtgaaatcctgtctctactaaacacacacacacacacacacacacacacacacacaaaatagccaggcgtggtggcatgcccttgtaatcccagctactggggaggtttgaacctgggaggcagaggttgcagtgagccgagattgtgccactgcaccagcctgggcaacagagtgagactctgtctcaaaaaaaaaaaaaaagtttctctatgtatcaatttttattttaagaactttcataggcatgagtaaagctactgcagtgaaagaacctgtcaaaggtcatttcactacttctgtgctgtccttttggtctaagttcacaaagtgtttgtctccattgtatttgctgtttttgtgtttggttatttagtgactttaaaaatgtcaattaactaccatgcccaataagtacataagcaaaaggagtttttttgagaagtgttgagagagaagaggcctggaatctaaaaacacagataatgtgctgaacggaagaaggtcacggaagaggatatgctgaagtctgaggtttgagtcactggacaatcagaagcaaagacttacttatggacaaggtgaagggcgttgggcctatgtcatcaacagtgagcaagagacaggaaatagaatggaagaaatgaaggaaaaatggaatcgctggcctgagaatgaacatcagcaattggtgttgactcagaaggctgagattctgtttgaggacttaaaggtgagggatgggaaagtggtcctgccgagctgctagtgcagagggtgtggaagccatgctaagctagtgagttctgacaagggctcctttcctgcttcaggttttatcacccactcaatatttactgcgcagagagctgaggacacacattaatgaaacagtccactcttcacagtgcttagggcgtccttcgctcatacttctttgaacatatccactctcttgtctattttacattataacacctccagatcagagaaggagtttttgacttaacttgttactccccagctcaccgtgcccagagctccacgcatgactgaatggtgaatttggaatcattgctttcatctactggtttttaccaaagtgtaaagtgcattttctaaatggctctctggctcacagaaagtaacagttttaaaggagatattttaaaaggtagaatttccaatgacaacccaattctttggataattcgtcttattttataatagcagaaacattcctatatgagaacaccaactcttgttaaaacattgagattaccttgaaacaatttagagtctctaaagttgaaagttcttctttgaagatctatacattacaatgttgggcgcagcagatataatctgaactaggaaagactgcatctgcagactattattattattattattattattatttttgagacagagtctcgctctgtcgcctaggctggagtgcagtggcgcgatctaggctcactgcaagctccgcctcccaggttcacgccattctcctgcctcagcctcccaagcagctgggactacaggcgcctgccacctcgcctggctaattgttttgtagttttagtagagatggggtttcaccatgttagccaggatggtctcgatctgctgacctcgtgatctgcccgcctcggcctcccaaagttctgggattacaggtgtgagacactgcgcctggcctgcagactattattaattttataataaggataaatgaaaccagacgtaagtgtcatacatgcatgaattgagttcagagctgtcgtcttatgactcagatccatgttcacccaggttgggaagctcaatgctgcatccatgtagctgatcccagcataggcctgacataggaaaaagactatgggagcccttgtgccagtgactaaattccaaccagcatctttccagtgagatggcctattccaacacacacacacacacacacacacacacacacacacacacacacacacacatacacattttgtaagatcttgaaaaccataaaccaaaatagatccatgatttactggttaattttttgatgatgaactatagagcattaccaaaaagcctaaaatgtttttctgtttgactttcatgccttactttttttctttctggtgatatgatgtcactctgagcacacagggcataggttatatatagttcctttagattctctttaaaactttcaggaacaatgaaaaataatatatcgactaggtagcagttaggacaaatggtgttaagctgttctaaaaagacaatgtttaagctaaaaaacacatcttgggataagaaataaagaaaattcagttacataatggcactatcagggtatagcatcaaggcatatgtatttttctcttctcttcttagaagcgttggtgtcagattatcatttccaggttttttttttcctatttaggagaagttcaggaaatgcttaatatttacaattccctttttaaaggtgtttttcaaaattaaaatagctttgttttcattgccattataaaatattaaaatagttgagaaaggtagaaattagcaattttaccacccagagacagtcaccagtatttttttatgaatcatctcctagataactcattgcatgcccttacatcaatacacataggatattaaggatgttgcatcatactatgcatgacattctgtaacttgttttttccacctaataataggaatgggcatcatttcatgtcaaatgatacagacatacatcatcgtttttaatggctacgcacctttgcaatatccttgaggcaaaccctaatgatcatattggtgtcagtgagtcacctagacatgcatatttgcaaaccattcagaggcattaaattggacacactccccaaagtgcgactaccaccgggttaaagtatcgttccatttaacatttccatcattcctgccaaaacactcttcagaatttgtctacaaacttaacaccaccaatcacagtgaggccaatgtcccccagtttcccagagtattagagacacaaccctcccctccttggttgtatgtgtattcatctcttcttccttcctgagatgaagcttggcatcactccactctgaaagaaatgagaaccgtttttgcatttcaccttaatcagatcaaattaggacaggtggcaaccctgcaggcaacataattatgaaaaatgtctgtgctcaatacagcctgtccttccagcttcccaatcaaataggacaccagagcccaacctttctatttcagctggtgactcatagagcagtcacccacataattgctctgaatataatggtgctgcaaaatctgaaattaaacataatataaaaagcacaaaaatctattttgtaagattagttaatttaatataataatagttcttctattataatcttcatgtgccaaattgggggaaaaaaccttatggctggcctgttattagaagaaaatcttttaacatatcccccttacacttgccatccaaaggtaaaaagaaatgatgttgaggatttcctggttttattgtaagagagtagctgttgtccctccaataaaaagtgtgcaatgaatatctgtttaaatagatttgagataagctgaagctggatacaaaactccattatacaacagggggatcctacatccagcttcatttaggatattgcttctcagaagacatcccgaacacctcaataacaaatgttatattgaaaatgtgctcagtaacaattgcgggatgagtctctgtgcagcgatttttcagcatgtcaaaattatactatcacaccatggaaacaaattaaacagcacaagcctggctgccgggatggctgtattagcaatgcagtgctatttcataaagaatgcattgcttcagatctgtcaatgaatgtcaacaatggcttctccatttgtatgaagcccaatttgtatttggagaaaaaccaaacagaacacttcagaatctggttccatttcttcccaacatttagattaaaagaaaaaagcccggttatctaatttatctgtagtcagcgttccttttctagggaggcacttgggaggaagcctcagagtgtgagttaagcactaacattctctttctgaagcacacgggcaccattaaatgcttactgacagctcagagaaaacacaatctatgtgctacacattgtacaagaaggttttgttgatatattagattcatatatgtgagctttggttttcttgtatttgtgaaacgtggcttagctgtgtattatggctttttgtgactaatgagtgggtcttgcttcagaaatgattacagttatgtcagaataatgtcaaataatcagtattagtagatgagctcttagaaaacagaagccctcttttgcagatagatatgtcataccaaagagaaattaaaacccaagactattctaaacgccaaatagagtctgctatattcacatctcaaattttgtgtatctaacaattaagttaaatagtgattgtcaattaaatagcgttcaaattgtagctcaaaccgaataagaatttcttgtccctggagtggatgtatgtagacatcaacattttaagacacaaagggatgatgagtttcaggctttgttgcagaagtttggacagccgtttggctcttccctagcagtcctgaaacacatgaagtaggtggtcctcctgcctcttgcctttttattttctacagctggctcgattacagccctgaggacttgacacagcagaagacaacccagccaggcagcaggttcaatacacagctgaaatctcactgacctctacatatttggctccagtaacctcttatgtatgtatttattttttaagatcatgttctcagtctccataagggtaaatttgtaaggaagaatttctttaattgtttttccaaacatgcaattctgtgcctcaatcgcttctttttttaaaaaaaagaacagttagggtgtcactctgtcacccactgttgagatcatagctcactgcagcctcaaactcctcagctcctgggagcaatcctccctccagcttcagcctccagagtagctaggactgcaggtatctgccaccatgcctagctaagttttaaattttttatatagagacaggattttgctacgttgcctaagctgatctagaactcctggcttcaagtgatcctcccacctcagcctcccacagcactgggattacaggtgtgagctactgtgctcaacctgcacctttggttttgtcactatattgccatagcaaaattcaggtcagtgggacttgagttttggttttctccactgagttccacgttcttgctcacgtttactccagctaccctggtgtagaaatgaaattaccccagtcctcatgatgcaagcgcttattctgtgccaacaccttaagctccgtttctaaatgagattttgtgaaacgaatcaatcaatcaatattaaaactcaagactaaaatctgtctttgatttttgttcttcctactgctatttccactgaaaaaaaaattctctttcatgtgtccatgggtagaatatccttgcattctttctgttgaaatagtatggttctagtattcactagctatgagatattaaagaacggaagccatcttcctcattatgttttataacagagaaatataactccccaatttacatctaagttcatcttaatagtgctttatacaaaaagttcctgaagaattacaacagttggccattctgcaaagtgccaagggactgattctgaatccagagcaacaacaaccaattatgaagaaatggtctctgtggctagtatggtctagacactagcaagctacatataatgagactgctctctcctttcaaaggctgtgatttaaatttataggtggggtcaatgggttaattttcactgccttgttttcactacacttaccgctattgaggggccttaaaatagctctgctatcagaactcactaatccaaatcagtttataaaaacactctcagattaacaaatcaatgatacttacacaccacaaaattggttaccacttaaaggctttattctgactagatttatagcctgcataaatcccattctcatgtaatttagatggaagacaagcaagaggtatctctgctgtctactcacagcagtgtaggccaaaaaggagagcgattctttattattgatgtttagcagcttgtgtttaaaagctataaagaagacgcaatgaaaatacaatagatcaattcctaaatttccagtatagtttacaaaattttaagagggattaaggatgctagtaattaacttaaaaataagggcatcattatatgtctgtgtaacagagatcttttcagaaacaaaaaatcaagatttttttcttttccaactataaataaagcaaagcctgtttcagataaaattcatctgccaaatactttaatgctatcctgaggttaagaatgatgaaataagtttgatcattcttatggtaaaatgaaggctatttaaagatgagtttcattcctgctttttttttaaaaaaaaacttttatttctataagtttttgggaaacaggtagtatctggttacacgagtaagttctttagtggtgatatgtgggattttggtgcacccatcacccaagcaatatacaccgaacccaatgtgtaggcttttattcctctcattcttgtttttttaaaggtgttttgaacacataaaactcactgtatctaatatattctgagcattggattctagtaacatcacctcttaagatgtaaaatctcttcattttagtctctgttgagaattaaagactggtaaaaccagtaatgtttttagaagcatatattgctgtctgaacttgggatttctgattcaaaattcagagtaaaattttagctcttgggactgctacagaaatattctataagcattaataagaccatgtcaatagagcgttaattattaggattaaaaatttactctatggggggctgggcgcggtggctcatgcctgtaatcccagcactttgggaggccgagtcgggtggatcacaaggtcaggagttcgagaccagcctggctaacatggcaaaaccccgtctctactaaaaatgcaaaaatcagccaggcgtggtggctcatgcctataatcccagctacctgggaggctgaggcaggagaattgcctcaggaggaggcaggttgtggtgagccgaagaggcgccactgcattccagcctgggcaacaagagcgaaactctgtcccctcgccaaaaaaaaaaaatttactctatgggtatcaataatcaatgtgttattctaactcattctgtgcctcattcagtaaaaggctatgaagcaatttaaggatatttgcaacaaacaagttggtttgctggtgttgctcttgctttttttaatgaagggaagactggaaaagggaaagtgatggcaataaaagtaagggcaaactgggaggtggggctggacctctcggtgcataccgtaaagccccatgatactgatccatgtgagccaccaacttggttctgagtttcccagcaatcagaacaaagagggcaccacaatccctagaaaatacacccaaagtggtttttgagaggacaccatcatctctagaaaataaacccaaagtggctcttgagagaaggacagaacttaattttggcacaagcctaggactgccagatttagcaaataaaaatacaggacacccagttaaatttgagtttcagtaaagtaccaagtcctttttttttagcctaagcctgacccagatatttttgttaacctgaaatgcaaatgtaaccggtatcctctagtttatctggcagccttaccaagccataattcagagagaatatttgtaacagaaggccatttgtagcatgtagttttagttcttggtttcttaaggaatgactagaatgagaaatagtatatttcctagaaacaaaagcttctaatttcaacaacatcaggacatagtatacggcatgccgtcaagaaacctgctgaaatacaccagcagatctgagcaggagcaagtgctgcagaagccagggtaaggaggacgcgcagagacgccccgctgctgagagcgcctgtgcttcagggtccactgcaggtctgcacaccacagggtgggtcacacctgagacgcccgtattttaattcctttctcccgtaaagccctcacctcactccactctaaggatttagtcggtgaaaaataagattatacttcagacaaggttcaaccaaacatcatcaaataaacctattctaagaaatgaggagtatctgtattcgatggtagaagtttgaaaggaaatacagatttttttttttttcctttcaaagagcttgttaaatttgatctccctcttcaggtagataactcgtggtcaaagttttcaaaagtttcgacatgtaagaaagaggaaaatacatgtaaggcacacaaaaaccatctattttgtgtatgtaattccaaaggattttgcttctttcatggaattgcatagagatgtttgtcttattttcagacactgataagccattatcagtatcatctttacctgtgcacatgttttttgttgaatttcctttaaaatacaatgaattgaaaaggattaaattcttttttttttttttttttggagacagggtcttgctctgtcacccaggctggtgtgtagtggtgcaatctcagctcactgcaacctccacctccttggttcaaatgattttcctgcagcagcctcacaagtagctgggactacaggtgcccgacatcatgcgcagctaattttttttttttttgtatttttactagagacagggtttcaccatgttggccaggctcgttttgaactcctgacctcagatgatccacgcaccttggcttcctgaagtgctgagattacaggcgtgagccactgtgcctgggctagagtattaaattctgaaatgcaattataattttatttaggatatattttacatctaattaaataaatatcctaaaattagcttcacagtggagaaacctgacggccaccactttgaccaagtaatccaagttcatcccaccagtaatgggacaagctgacactgtgtgcctactgagaagggtacaacatcctcctccaacactcttgccaaaaatgcataacttggttgggtacggtggatcacgcctgtaatcccagcactttgggaggccgaggtgggtggatcagttgaggtcgggagttcgtgaccagcctagccaacatggtgaaaccccatctctactaaaaatacaaaaattagctgggcgtggtggcgcacgcctgtaatcccagaactttgggaggctgaggcgggccgatcagttgaggtcaggagttcatgaccagtctggccaacatagtgaaaccccatctttactaaaaatacaaaaattagccagatgtggtggcacacgcctgtaatcccagctactcgggaggctgatacaggagaattgcttgaacccaggaggtggaggttgtggtgggccaagatcatgccactgcactccagcctgggtgacgacagagtgagactctgtctcaaaaaaaaaaaaaaaattgcataacttgagtctaaacaggaggaaacattagacaaacacaaattgaaggatagtctacaaaataactgtcctgcgctcataaaaaattccacagtcataatagactagacataatagtctagataagaggggtctaaagagatgtggcaactggatgcaacatgtgagctgggattttcttcttactattaggtatgtactgaggataaattttgaaatttaaataaggtttgtgtaaagtatggcatcaatgctaatttcctgacttcgatcattatactgtggttacataacagattactccggtattgagaaaacatattctgcaatcttcagaagtaaaggaccatcatgttggcaacttactctcaaaggattcagaaaaaaaatatatgcacatatgtacacagatggagacaggaagaaacaaatgtggtcagtgtcagcatgtgggtatctagttgaagaatgtatgaaaaattctttctcttgcaccttttctcatgagtctaaaattacgtcaaaattagaaagttcaaagaaaaagacatttcctttggtaaaaaaaagtcactcagtatcactaggggaggcatccactttgttttaaagcttactgggcctgaaggaaatgacactcgaacagcacagccagctatagctacagcacagaaaaccacctccaccctctcccacaggagggctccccggctagagttttctgaatacttactggatagttcaatgttgtttttttgtttgttttgtttagctttgccttgttttttgttttttacagctgagaaaatttgagtttccacaacatccacagacaatctggaccataatcaagtcagtgcagtctaaagcaatgtttcaaatatccgaaggtaaggccagttctttattttttgattgctactgaaactaattgaatagtgttatgaatggagtcaaatgatgtgcttaatcaactgaatatccaataattctgtacagcctattctatgttagttttctctaactataagatattctaatggagaacaaggaaaggaataatgccatttttacccggccctttagaagacaaggtaaactcatcttttctaacaggatattgaatatgcattttttttttaagaatccaagccttacctgtacggttgtcccttggcgtccaaggagtattgattccactactcctttgggatgccaaagtgacaattgctcaagtctctgatatacaatgatgtagtatttctatataacctatgcacatcctcccatatacttaaaatcatccctagattatgtatatctaatacaaagtcaatgctatgtaaatagttgttatattgcaattttatttgtattatttttatcgttgtgtcattttttatgttcattttttccaaatattttctatctgcagttgggtgactcctcagttgtggaacccatagatacagggggttgacagacactaggttgaggtaatgcttcatgattgttgaatgtaggattttggatatgcagaaacgaatttctaccttaaagactgaggagcaaaatataaggagacaatgcattaagcccatctgttaattttgattagttttaatattctctttaatatactcttctgtttatataatgtggggctagtagacgaaagaatatcaatatcatttgatgatattaatgttctgattatgcctatattccttctacaaatatatatggcacaaaatccaaatgccaggaactggtctagataagaggaatacagacgattagacacagttcctatgctcaggggatttacactccactagatgatacttaagtacacaaactaaagagagaaaaccctaagggctatggagaaagatgaagcagggaaactgttggagggagagggaggatctggaacatcagcaaagtcttcactagggaggtcccttgtgcagaccaagggacagccaggaccagcactaggaggacgagggaacacaagcagagcagacaggtctgcgggccagggtgccgccaggataggagggctggcgggagaggcaggaggtcaccgcaggacctgaaggaaatgactcctggccaggggccagatcgtgatggtctcaagggttgaagtttaattccgagagtagggagaaggcactggaggacttgcacatggtagtgatgtcatagccttcatattttagaaggcattctacattataataatgtgagatttacagaagagttgtaacgactgcacagagcgtcctcagatgcgctgcaccccacgtccgctgctgttaacatcctacataaccaggccatcttcccataatcctctatatttaaaaggtgatctgtccccttactgtatagaaaataattacgaactaataataacgacaatcattatgaactaataacatcgcatgtcaactgcatcccaggagctgttccgagtgcttcgcatggatcacctccttagtccttacgggctgctttgagtgtgagggcagggctattgatattttcattatccccatttaatggatgaggacagtgaggcagggaaaggtgcataaacctgcccagtgtcacaaaactaatatatggtgaggctggtttcaagctaatattggccaatccccaaccctgaactctggaatagtctgggggagcaaaacaagatccagggagcccagttaggaggctctggctgtggcctgtggtcagcagtgcagcggtcaggtgggaggtgatggcacctgggggctggaaggtgaggccagcaggtcttgctggtgggctgccctgtggagcagacaaaggaaaaggaggcaggggttgcgctgccacttttatcctgaggaaccggctggacagtggtgccttctactgagagtaggaagactggggaagagcgagagagggctcgaggagttctgcttcggatgccacattggcaaagcttataaattatccagttgtagccaagagaagaaggtgagtgtttggagagtagagagtgacacaccaagtcatgatgctcaggggtcaaataggtggaggtgatagaattgactgctggaggccgggcgcagtggctcatgcctgtaatcccagcactttgggaggctgaggtgggcagatcacgaggtcaggagtttgagaccagcctggccaacatagtgaaaccccatctctactaaaaaaaaaaaacaaaaaacaaaaacccagcagggtatggtggcgcatgcctgtaatcccagctacttgaggggctgaggcaggagaatcacttgaaccctggaggcagaggttgcagtgagccaagaccattctactgcactccagcctgggtgacagagcaagactccgtctcaaaaaaacaaacaaaaaaagaactgactgctggacttcatgccaaatctatttacaaatcaatttaacactcttcaagatgtagaaatcaacaaaaattggttcatcaattttctgtcctcagcctgtctcctcttcctcccagatccccatcccagctctgtcttatgagagaaacaaggaaagagagaaggaaggaaagaaagaggggaagaggctgtgggcaagatgggagaagacatcaagaaacccaaaggcaaagaaaatgatggctttcaagaagagtggcaggccacacctcttccctttgaacaacaaattcatgtcacttctttccaatatcaagacacccgtaggacacaataatatattttctctcagatttttgttagaattcagtcaaactgtctgctttagaatttattatctcatgacatgagcctctcattacagggtcacatatttgatttatgacatcaccagttaagttgtttctagtataacacttacacagttaaaatatataaatatttttacatagaagttatgaaatttcaagttgactgaataactgaacaactaaaaacactggtttttttatatttgaaaatgtaactacatgtgcaagaaaattataggtaataaaataatagtgaagaaaagaaaaaaataagtgaaacaagaaaataaggaaacaagtggattacaaaattatacattctagagaggaaaaacagtcaaatcagataggcagaagcagggatacctaaacgaacatggatcaatacaagttcttcaactacatgaacactggttgggggggtccccaagaaagcaaaatccaatggaaaatgtgactgtattgggtgggtaccctttgtgctattcaaaaggacaaacaatgccgtgagaaatctaaacctacaatgtaattgttgactccatagtgtgactataaagtagtgacaaaataattatatacttgtttctattgtgtgtcagataaaacagcacaaattcttgcacccatgtattacaagaacatcaaagaacacgttgtcagtgttcaaatacggcaaaaagttgagagggaagtttttctggtaatctctcacattcaacaaaccaccgacaacaagatactccaaaggaacccacagtgtggggcgagatgtaggaatttcatacacacagacaagaggcaggggagctatgttattcaagctcaagaaaagtatgaaagtaaaggcttctgttatgacactgggttttacctgctttcccattgttgtgttacaaaccaccccttactttttattcttttcacaatctctttccacgcagacactccatgtggttagcttggacttcctgacaacatggtggcctcaatgtatctggatttctcatatgaaagcccaggactcttcacgaaggccaagacggaagctgacagtcatgtcaagagctaggcctggcagagtgtctttttccactgaactcagtgcaagcagggtgaggtcagcccaaattcacagggcagggaagtagaacctacctctcattgggagggggatcacattatttgcagtgatctttactatgccacagggttgatcacctttatggcaatttgattgcttatcagccaaaaggaaggaggtggtgctataatttacggcgggaaagtgaaaaaagaaagaacattcctgggtcacttctctaggctgcctctgactaactccactgacaactttaaatccacatcagaggttgcatttgaaacagaaagacaagaaatacctgcaactaatgttgtcctgtggagtggccggtggcaggggacagctgaaagatccacacagaaggacaggggacttgcagacatggggtcggggtgaggagtggggactgcaaggagactgacagcgtggagctgccagctgtacaaagcttgctatacctatcagggttgaggactcatttttgtgtttcgacacattcttggcacgttccccttgagcatgaggcagaacgcaactgcctttgcttattttatctagagaatgatgaccaaggtgctctttccctaaagagaaggcagaacaagaggagagaaacacattactatggttggaggttaaaaaaaaacacttttctggaaataaaagttattcaccactaaaacagtttacacctaaaagtcagagaatcacttatttggaagatttctatctttactagtgcttattgtataggaaaacaactatttaaacaatactcttcacaatatgtatgtttttctttttctgacattgttttccaactttggtttgctattttttccctttattcctcaacttgtctcccacttctcagcctccattcatgtctgccttgcctttcacccaccagtggtcccagcgatatcgacaagaaacccctaggaacatttagcacacacaaaaaaagcctactaaatcccttcctggtggtccctatgctcataattaagtcggtgcatttctgtctggaaggagagttacactagattatttttctgatcatttaagagctagtgcccattagttataacaatggttgtaggagaatgaaagtgctgaccaactcctatctttgcctacacaatagttctctacctctttcttccctgaagatgatttgatgcaagacctggcctgagagccttccatgtctcggcagcagggactctctgactcagagaattgatggctaatctcagtttgcctcaagaatcctattctccgtgtacagtgactgtattaggagtgttcataggacctagtcttggccaatgaaaagtaccgggaagactgctgggggcttctggggagtctatcacttcctgatacctagagagaaattcaaaagaacaagaggctttgggcctcacgcttttcttcctgtttggattccagggtgatgagatgttatcttgagctgcagcacctgtgggcatggggtgatgaacacatgccgaaaggaggagcccagggcttcacagaagtgttagctcctaaacagagccctcacctgccaacctctggacttctcataactaaacagcaaatgttctcaggtttcagacctcagctggtcaggttttctgttattgtagctaaaggaagctgtgctccatgaatattttcatatttcacatttctgcatagctagggcttattgagtaaggattactggcaacccaagttaaagaatgaccgaatggtgaacatgccttggaattcgagatagtgacttgttcctgtgacatgtaaaggctcatctcctctgcagccattcacttacccaggggtgacaaaactggggacctttctctcctttcttcagagaagattcttccacattcccggacaaaacttcctgccttgctgccctccacccccgactctctctctctctctctggagtggagaagggacaagtgtgacagttactctatgtaagctccaagtttcataattccagaggtcctctcctggggagaaagccctgcccatgcaggcacatgtggccctcactgtaccataccatgggagattagtgcatgaggtactggtgctgctatgatgttctgtgagtaaataaaaggtctgtcctctgatccagcgtgcgcacacacacacacacacacacatattctaaacccacatacacacatgtgtgcgtacacacagttagggtagttcatgtacctacttaaatgcatgcacaattctgtgtgtgcatttttcttagtgcagaaggggagaaggtcctatggttttaatcagattctcaaaggtgtcagtaatcaaaacaaaacataacaaaattaagaactagttactagagtataaatctcttgaggaaaataacattgtcttaatatctgtagggcctagcacagtgtttgacatgcagcagatgctcaataaaagcttcctaattgaatgaatagataaattagttgtgtggtcctccaactatgctcgatgcctagtgctctgggtgaaagaaacaagtatgtgacatttaaatacaaactcataagccataaactcatagaaacagatgtatacacgacaaacttgcatttatcagcatgaaagtctgataaagctctatattgagaaacattcaattgtatgatagcatggaacataattttgtacatccaaatgttaattataagagagagaaaagacctgtaaatgaaagagagagatcaccgtgagttatctacttaacatacgggcttggtcacattaagcattcattctgcatttaagcattctgaatcttaagaattttaatttgccttcttagcaatgagaggctggagtaaaaacccaaaacatatacacgcatatgatttctatattatatgaattttgtataaaacatgattatctttctctaattcattagctagtttatcataagcatccactcgatggaatgtgtttttcttccttcaaagcataagatacaggatatttaacaatatatgttacgaaagtatgtacagcagatagattagtaaactcttcttgtaacatacttcttccaactatcctttttctttggatgttgggtggccatggatgttatgggttgaatttactccccaaagagatatgttcaagtcttaaccctaagtaccaatgaatataacctcatttgggaataaaatctttgtagaagtaatcaaattaagataaggtcatgagggtgggccctaatacaatataactcttgtccttgtaagaagaaaagagacacaaagacacacagagacaaagccatgtgataacagatcagctgtctgagtgatgcagccacaagccgaggaatgccgactcctggcaacaccaaagctcagacaaggggtgggagcagatccttcccagagccttcagagggagctcagtcctgccaacaacttgattgcagacttcaggctcccaggacaatgagacagtaagttcctgttgttttaagccatccaagcttgtggcagattgttttttggcagccctaggaaactaatacaatgggtgacaatggatatattcttgtgactcagatcctgctagtgcaatgttgatttccatctgtcactatataaaatcattgacactcagatgggaggagacagatcaaaggagatcaaatcatagaaaatagaaggatctgagaagaccattcttttaacatgcaattgccacttaacctaaccaaaagatgtattttgtaacttatccttaagactattgttctgataaaaataacgtttctttagagttctgaaattcaagagcaaaatgattgcctcattggaattacagttgacttacatttgagacagggcatcttggacatgtcatttgaaaataaggaaggcattggacttccctttataccaggtaaactttcattaaattcaaccaaagcctggcttacagcaatttctgtgctcccatcagcttgaattgttctagctgtgtttggcagtgctgggatagggatggggtaacataatgatctctcgctagctacccagttttctatttctcatttgttcttaaaagcctcaaacactcccaaagtattttcttaaaaattgggctttcgtttatttttggaaagaaaacaatcaaatgttgatgggtgaggaatgtacagagacagcaacacagggattctcaaatgtttctgctactgggtgtctatgatgacaaaggcgagacccaatggtgcaattttcccaaacatcccgcacacgtgaaaacaccatgtttgtttcttcaaccacttctttaaaatctgttatattaacattcaattaatgatataatttctttttattgtacagttcattttcttagaaaagctctgggtattgaatccttagaagttccccaaattgctattttgaatagcctaatttttattccttacttggtattattatttcttctttctctcatccttttctgttatttctctaccccttttctttgtgcattttgatcagctagagttatattcttttccactcccagaggatacttcaaatcccatcaccctctctgaacggtcttccttttctatcctcattcatctgggtggacttcttccaactgcatcctcctgttcaaatccatgcttgcctgggatcacactgagtcagtgattctgatggtaattttttcaacaagcatttgttaatcattctctgtccaagtagtaggtcataataattagatactttaggtaagagataatttgggcccagtttctaccctctaggtatgtctttattgatatacccagacagtactagttagttagttaatatactccgtatacaatatactctagaaaattacggttctgttgaattggcatgcttttgttaatgcagattgatgctacatctccaacactaacctcagttaaactttttacctaagacaaggcatattatggggatatatgtgtgggaaagaagaaaatgttctcacctactagatgggtctttctttcctttcttatttcattctttctttcccttttcccttcctccctgattccccttttctctctttcttctcagaagacactattaaagcagctaagtcataatcttacaggtcagggcaaaaattagaaaactattcaaaaccactattacccaactcctagggaaaaaaataaaccaaactcctattaaaaaattcattacagttacccttgggaatcattctttcatccattcactcataattcatcagtgtatttattattgaaaattcctaagtgtcagcttacaacaaagtcatcctaaactatatgaatcttttctaaataatcaagactgtatctcaaattactcaacattacatttctaagaatttaccatttgacttcatattgaatatatttgtttttctatttatgtcttagtctgttcaggctattacgacaaaataccataaactgggtagcttagacaaaaaaaatttatttctcacagttctggaggctgggaagtccaagatcaaggtgctggcagatttggtgtctgctgaaggcttcttccccattggtagtgctcctagttgtgtcctcacttggtgaaaggggcaaacaagctcctttgggtctattagataagggtactaatccagtcatgtggactctgccctcatgatcttgtaactccccaaaggccctacctcttcatactatatcttggaatactttgaggagaattaacattaattcttctttaagtatttggtagaattcagcaataaggccatcagatcctgggcttttctttgatggaaatgtatagaaatgtctaatatagtggattttttttttttttttggacggagtttcgctctgtagcccaggctggagtgcagtggcgcgatctcggctcactgcaagctccgcctcccaggttcacgccattctcctgcctcagcctcccgagtagctgggattacaggcgcccgccaccacgcctggctaattttttgtatttttagtagagacggggtttcaccgtgttagccaggatggtctggatctcctgacctcgtgatccgcccacctcggcctcccaaagtgctgggattacaggcatgagccaccgcgcccggcatatagtggattttaagtcatcattatttaagacacaatgtatttagcaaaactaaaaactgttatttttttaacagggtgcatgtaatgctgtatttaaatatcaaaagaagctaattcaatgtgatgaagtaaaataattcgtatcacttgccatctttcagtggttgactaaagctgttatctaataaccatatttttatctaagtatatttaggggagattatctatctatctatctatctatctatctaatttgcctatcgatttacctacctatcttatctatgtaatctattttatccaatcaatcaatctaatcaaccaaccattcaatgtatctctctatttatctatcatctgtcttccaaagtaactttccaaacacaattagaatttgtgctatttctacgtatgacactgaatttttacatcaattacttaagctataaaaaaaaccttccacagaaataatcttactaaaacaaaactgggtgcaagtgaaattcaacaccggcttgtctcccagtagccttagcatctctgctataatttactgagagtataaaagtgctcattcatttggacttacttctgtttgttgcatagggcctgttagtcatgctatatttccttacaaaatgttaacattgagttgtccctcaaggaatattttaatgtgagagagaagtgtcaaggttagaactgctgagagatttgctctctgtagactgctggactgtaaataatcagccatctccagcatcaagtgattgctcaaaagataggatttctttctctgaacttaaaaatttagcataacttgtatttacttcatttcaacatttagatctgcatttcagagcactttaagaatgtgttggtaacttattaggccaatactaatgcagctcagcaaatgaatgcttattatgagtaaactaagaactctagggaatataaacaagatctaatccttgccctcaaagagcccacagcttagttgaggggatacataaacaaatatttaagtacagtaagaggcagactgataatggtactaataaagacttctgtttttataaaggtctacacagttttcaaagcccttcacccacattacttcccttgacctgaacaagaaatatttccagtagaccagaaagactgaatcatccttagtttagaaacaaggaaaatgagaatcacaacattaagggttggatccacattcataagcgtagcagcaacagtgctaaattgccgatttttttttggcaccatattgactatcttctgtgaaaataattaaatgggaggccatcagacagaggtggctctaaaaccccgggttcctaaatcagcaaactgaaatataactcagactcatttcctatgatcggctaatttaaaagatgaaacttgaactcagctgatcacaggcagtcaacttggaattagttatattgttctgaacttcccatgggaatcgtccaaataaggtaattgttcaaactttagccaattacataatttatttgcttccaaatttatcctataaaagctttcccttcaatgacctgtggtggagctctgaccacttgtggctagattcataaatcactgtttgcgcacataagctgtttaaaattttaatacgccttagtttatcttttaacacttctattttattcactcttccctctgtgttctgaaattttgttgacctctcttacctgacttttatcttctctctaactctttgtgttcttgtggacttacactattttaactccttccgtatcattttgatggggtttggggaagtagcagatatatggaacttcttcaggaacccatgtgggacaaaattatttccataagctctgggaatgcctcacagaggacagcaaatttgacctgggtctttagaaatgagtaagattagagtgagctgctgagctgaaagggaaatccaagagaaggaggaaaatgggagaagctatggtctgaatgtttatgtctctcatgagtgtccatgcatctcaattagtacccgtataaaacagccccttctactatgtgaggatgcataagagggcaccatctatgaggaagtgggccctcgccagacaccaaatctgccagagactttgtcttggactgccaagcctccagaactgtgagcaataaaattctgttgtttataagccacctggtctatgggatctcattatagcagcccagatggactaagacaggagacttttaagcccacatgataagctacgttaatatagagatcaatgcttttcttttttttccagggttgaaccttaaaaagaggtcaactatttgaaactaaacaagttcttgtaaattaaaaaaagcaccttcaaaacacagagacaatccagaccatttagtttaagacataactttgagcctttcagctagagcgggttttcaaagtaggagtcatgaagctgcctccaggaggatggcattctttacacaacagaaagcctccaccatggtgatatggatgggggtgcagaagacaaacttagcctccaatctactcggctaacaactccctaggcctttagggcagaacgggtggccagaatcgaagtcaaatggagtttattcagctggaggaagaacttgcagcatggttgctcaacttcaggccacggatttgatcctactttatagagatgagaatgagtctctgaatgcacagtgtttaggttagaaatctgacacattggcaagcatgaacggttcatgcctgtaatcccaacactttgggaggccaaggtgggcggatcacttgagaacaggagttcgagaccagccttgctaacatggcgaaaccctgtctctaccaaaaatacaaaaaagagccgggtgagctggcacatacctgtaattccagctacgcaggaggctgaggcaagagaatcacttgagcctgggaggtggaggttgcagcgagctgaaatgataccactgcattccagcctgggcgacaagtgagattctgtccccaaaaaagagagaaatctgacacattcttaagagacaccataaagggatttacttgttactgaaaatcttagattagcttttttctctttgattaaaaaataacataaattagaataaaatacagatttaaatttatattctattttattctatattttagagaaacatatttgagttcctcaacatctaatatttctgcattctcacagtatttctgtgatgtaatttttcaaaggatctgtgtaccatccacccctttcaaagctgagaatttcatattagatcattgcagctttggagaaaaatgcattaaaatataacagttcacattcttttgtgagaaaacatatatacagctatgtacccgtatgtgtatatgtgcatatatattacatgtacatatagaatgtacatgtgcacacagacacatatacatttacacacatatgtattttgatatttcaaatgctcaatgcagcatggccataggtaatagcaatctattctatttttagtggtagccatgtcatacagatgttttgacaccattgtaaatagcagaaaggggctgccctctctctttttttttttttttgagatggagtcttgctctgtcacccaggatggagtgcagtggcgcgatcttggctcactacaagctctgcctcccaggttcaagcgattctcctgcctcagcctcccaagtagctgggattacagacacgtgccaccacgcccaggtaatttttgtacttagtagagatggggtttccccacgttggccaggctggtctcgaacccctggcctcaagtagtctgcctgcctcggcctcccgaagtgctgggattacaggtatgagccactgcacccgtctggactaccctctctaaagaacaatgccaagcagaaattacaaccctctgatgagtggcatatagagaaaagcatcctatggtatcagccagaggagaaaataggggctctacagcaagatgcggacatgtgtgcaaacaccctgagccaagagtttcctcaggaaccaaccataagctctttgggggcctgtggtggtggtagtcctaggaggtggagatgggggttcgaggaaatgcagaaggttttgtatgtaatgaagtgttttcttttcatggacagagactgtttttctatcccaaaggtctgggggagccataaaaacattttagggaaaatgtcatcaattcctgttttagagtcacaatggcagggttggtgtgaagaacaggctgatattggaaggccaatgtggaagctgctcaactctccagttaagtgtgatgtgagcgtacactaaacacacagcaggaggaagggaggctgggagacacatttaagagctaactagtaggtagcattgagaggagttggtgactacctagatgtggtaaaagaaggagtctgggatgacttcagggtttccaattttgaccagtagggatggtggtgacagtaactgaaaaaagaaaaacaagtgttccagttccatgtggcagactgaacaaatgtgtttaaatctcctacttcctaaagcctgactaaaatgatattggtgcagaagggaaataaatctataaggacaaagagtttgagagagaagaaaaaatcagaagagagatgttaatcaaatcatagaacacagatggaatggtagaacctactgtatttagcagagcagagaaagctaaagcctcactgtctgcagaagggaaattcagtcataatcaaggccatttaggtgcagcaccaccggaaggcccaggactggaggatccaggtccctggcaaattcagagaaaagaaagggcccaaatgagaataagtacttgaaaatctcatacagtgagcagtaagatgacagcatcccaccccccagcctatgaagctggcaactttccctgcttccccaggctgaagacaaaatgttcttttcccagagtagccctacagagtggatctgggctcaggccacctggcacagcatgggggggagatgaggggctttattgaaatcagggaattacatggatgactgcatgttgattggtgatagctcaacccctttgttctgcctcccttccagactgacggcatccagatttaataaaaccctacacctccccaccactgggcaggacattattgtagactttctatctgcagttgtggagtcctaccaccctagaaatagtccagtgtttgggtgcaggtgtgccccttcctcacatcctgttcactgctctactacaggtactcaggtgaaatgcagaatttaacaagcctgaccttgcacacggtttccaatcagtttttttaaaatgcttttaaaaaaagtatgaatgaaaagcaaatgaagacaagacatctggagaaagtcttcagtaccaaaggtaagagactccaagaaactgaaaaggaaacagaaaacaatttagggaagagtagaagacttaaaaaaatcaaacacaacaaacactcaactacaatcaatttctttgaatagataagataatggtataaagaaaaaatatttggagaaaaagaagcggtcttaaatattaaaatgatgacggcagaaaattttaaaaatttagtcagtttggaaaacaagtttggagaaatctctttgaaagaagagcaaagaggtagaggaatgggaaacaggagatgggagatttaaagaaagaaaaacaaagaattgacctaacacgtttcatatccaagatgtaggaatcccagaaagagaaaataaagtggagaaaaatatcaaataattaaatacaaagatgtttcccagtatagaaggtcataggtttctggcttcaaggagccactgtataagtaggcccagaacaatgaatgaggaaggcctgagccaaggacagccgtcacagtgagcaaatggatgatgggctgggggagaacaggaacaagaatcagaatggccttggacttcagccaccagccctgaaagcttgaacagaatgccttcaacattctgaaagaaaatagtgccttacctaggtttccctattcccagacaaaccattgatctagtgttggggggacaatagagagaaaaatcagtgcagaataaacctggcattcgggacaatgtggacgacagtgccctccgctgtgctggagggtcctgacagcctcaggaggagtgggacctcagaatgcatgtctccaattggaaaaattggggagaaaatgatatgtgatttttcgtgattatactaagagatttataattctattagaaagtttggggctgaattaatgacgactttacccaaacccaagtgaacaagcaaatgaaaaaaccaagtcaatcactaaatccaagaaaaataaaatagttgtataagaaagggaattataatacctagtctgaacaatgcttttaatagaggaggtgtgtgtgtggatgtgtgtgtgtgtttgcaggcacatgttgtgtacagcattaaaccttcattgatctttcatagctagaatttagcagatagtagttaaaattaaagtaagaaaaaaatagctggatagtcatactatatttaatttttttttttttagacagagtctctctctgtcacccaggctggagtgcagtggcgtgatcttggctcactgcaatctctgcctcccaggttcaagtgattctcctgcctcagcctccagcgtagctgggattacaggtgtgtgccaccacgcccggctaatttttttttttttaatttttagtagagatggggtttcaccatgtgggccaggctggtttcgaattcctgacctcaagtgatccacccgcctcggcctcccaaagtgctaggattacaggcatgagccaccatacccagcctagaattttttatcctaagattcatcttgggctctttcactgatttattttattattattactataattaggctgcagcttaggttgtcatccaggtggcaatgttgtcacagttgtcattgcctgcacatgcccgtcaaacatacagaatagctgtcaggagcttagaagaaaattccaaagacagtagctgctcactccttaactaagggcagcatcttcagcactcttgcttgttgagagcatggtatttggaaaccatagtttctgaattatgggacataggtcccatatgtccaattatgggacaaccataattctgacactgcaagtgagctagctaggagattgcattttgaatgtgttaaaaatatcttaatctattttacttttaattttttatacatgtacaagggggataaataatgaaaaagtgtctcatatatttctactctaagagcacttttgataagtattaaatataagtctgagaaatttgaagtgatacaaagtctttcagagttcattaacagtgtttttttattttttcttgatgatgaagaaaatgatactgttttttagttcaatggcatcttaataactatttggtgaaactacaaaagaatgaaaagtgattctataggaataaggaaagtgagtagtttacagatatttaacactaaatgacaaatgtgaggtttctttgatgaaatattgaaattaaataacagaaaagcttctaggagatggggcttcgggcagatggttggcaaagttgagctgggcctgagatgataatacatgaactttcctttaagaacctgtttttccctattccaccaaaaccaaaacaaaaaaccctaagaaaacactgcaagtgaagatctactaacaggcaggttttgggcatggagattcagggcgaggtctgtgctggactcagcttggggagtcgcagtgcctgggggctggactacggttagagttctccagtcaccaagaacctgctgtttcactgaggaccagaagcacatgaaaggagaatgcttttccaatagcttcaaaggagtcgaattgttttgaataattagctatgagactgttccccatagtttacaaagaaaagtcattgatatatttttaaggtcatcatttgattcacaaaataagcaaaaaaaattttttgaatgaggcaatgactcagagtgcagaattattttatcattattcatgtaaaaagatattaataaattgtattatgtgccaagcactatgctaggaactcaaactgaattatttcatcaactcatcccaaaagcactaaggaatcattactaacactgtccctgtgtcacaaagagggcaacttgcccagcgttgcatgggagctggcctgtggtgggaaagtgggttctgactctgggggcaaagccgggagctgggatgtccgcgagctgcttctgaacgctgcccatagggagttatcttttgtaaggtccttcagcaccaccaaaatacgtacctctaaaaattacgggcaaaacagaaacagggcaggtatttcgttggttgattgacccacttatttattaatttattcaataaatatatattaatatataactaagaaaaatgtatatgtatattaataatacacacacacacacacacacacacacacacacacacaaatttaagaacctctatggaccaggcactgtgaggagtaccagggatatgacagtgaagaagagaaaataaacacctcaaacaacccaggatgttgtgttgcttgatattgggtgccgtaacaagtagaacaggaggagcaaataaaccagggaggcaatggggccagggtggtccagggaggatgtggaggaaggtctgggggaggctatcagctgtgcacagtgcccaggaaagaggatgccaggaggggcctgggcttggccggggtgtccatagcagagccaaggtgcttgtgttggaaagaagggtcgtccacgtggccagaggttgtgataggagaggggtggtcacaaggtgtcaccgaagaggtagagaggaatctggcactcacagatagagttgtttgaattttattctaattataaagggcagttactggagcattttgagggcggggataggatctgatttgcagctgaaaactatcgatgccctgaaacaggagcttgaagccttgttctcacgtctaaagccatccaaatataggggccactgtggtttttgtctggttttacaactcagttaatcccaatgaataattgagtacataaaatctattaattagggctgttaaaaaagatgtgatggaaagatgatcaatggaaccaccaggcgtggaaataatgtgagtctatgtgcgtatatgcagggcgagcttgagcttcacccaaaatctgtgggtctagaacttacttctctcttacagcacaggcacacctcttcttcttgtgtgtcacttcactgcattttacagatgctgcagtttttacgcattgaaggtttatggcaaccctgcatcgagcaagtctgttgatgccattttcccaacagtgtgtgctcactttcagtctctgtccatttttggtaattctcacactatttcaaacttttttgtcatcatcatatttgttatggtgacctgtgatcagtgatcttggatgttaccattgtgattgtttgggagcaccatgaaatgtgcccacataagagggtggactgaactggtaaagtgttgtgtgtgttctgactgctccactaaccagaccttcccctgtcttgccccttctcctcaggcctccttattccctgagtcataacaatttaagttaggccaattaataaacctacaatggcctccaagtgttcaagtgaaaggaagagtcacacaacttctactttaaatcaaaaactagaaatgattaagcttggtgaggaaggcatgtcaagttctagatctcttgcaccaaacagctagccaagctgtgaactgggaatgcaaaccaggagctattgaaggacatttaaaatgctactcctgtgaacacacaaatgataagaaagcaaacagccttattgctgatatggagaaagtttgagtgttctggataggagattaaaccaatcacaatactccattaagccaaagcataatccagagcaaggccctctcttcaattctatgaaggctgagagaggtgaggaagctgcataacaaaagtttgaaactatgagaggttggctcatgaagcttaaggaaagaagccacctccatcacataaagtgcaaggtgaagcagcaagtgctgatatagaaaccgcagcaagtcatccagaagatctagctaagatcattgatgaaggtggctacactaaaccacaggttttcaatgtagatgaaagagccttctattggaagaagatgtcatggagaagtcaatgactggcttcaaagcttcaaatgacaggctgattctccttaggagctaatatagctggtgactttaagtagaaaccaatgctcatttaccattccaaaaatgctagggcccttaagaattatgtgatatcagccaggcgcggtggctcacacccataattccagcactttgggaggccgaagcaggtggatcatttgaagtcaggagttcacgaccagcctggccaacatggtgaaaccccctctctactaaaaatacaaaaattagccaggcgtggtggcgtgagcctgtagtcccagctactcaggaggccgaggcaggagaattgcttgaacctgggaggcagaggttgcagtgagctgagatcatgccgctgcactccagcctgggtgacagtcagactccatctcaaaaaaaaaaaaaaaaaaaaaaagaattatgtgaaatctctgactgtgctctataaatggaatggcaaagacaggatgagagcacatttgtttacagatgcacatggtttaatgaatattttaagcccactgttgagacctactgctcagaaagaaatattcctttcaaaatattactgctcaatgacaatggacctggttacccaagagctctgatggagatgtccaaggaggtgaatgttttcatgcctgctaacacaacagatgaagggataatttcaacttttgagtcttattaagaaatatatttcataaggaaatagctgccataaaaagtcctctgatggatctgggcaaagtacactgaaaaccttctggaaaggattcaccattctagatgccattaagaacattcatgatttgtagaaggtcaaaatatcaacataacaggagtttggaggaagtcaatttcatccctcctggatgactctgagggcttcaagacttcaatgtaggaaataactcagatgtattggaaaccacagaagaactggaaatacaagtggagcctgaagatgtgactcaattgcagcaatctcatgataaaacatgaactgatcaggagttgcttcttatggatgcgcaaagattttttttttttaagttggaatctacttctggtgaagacactgggaacattgttgaaatgacaataaaggattttgaaaattacataaacttagttgatcaagcagtagctttgagaaagtttgagaggatcgactccaattttgaaagttgttctactgtgggtaaaatgctatcaaacagcatcacatgctacagagacatctttcatgaaaaaagagtccagtgatgtggcaaacatcaccgttgtcttagaaattgccacagccacgtcaagcttcagcagccgcaaccctgatcagtcagcagccatcaacatgaaggtaagaccctctcccagcaaaaagataaggatttgctttattgcagtgggctggaactgaatctgcaatatctctgaggtatgtcagtattcattttctactgccattataataaatcaccataaaaccagcttaaaacaatatccatttatctcatagtttctgtggttcagaagtccgggcacagcgtagctcagcttctcctctgcccagaatcccaaaggccaagatcaaagtccagcactgctctgtggggctctggagaagaacctgctttcaagctcattcaagttgtagcaaatttcagttttgtagggatgtaggattgaggtcccttttccttgctgtctacctggaggcacctgtactccctgcctgcttcacagccagcaggggtgtctcaaaagcttctcctgcttcccctccatctctatgcatgcctccacctttctcttcagccacatctctctggttgcttttaaggtctccaggggtgagtttggagagcctccctatttgaggtctgtgacctttatagctgtagctgcattcgtgtttaatggcataactagaggacagaatcttggaggaccctctttacaattctgcctaccacaataaatatttttagtgatggagacattattttaaaccaattcactgaggaccaaagagggctctattaagcaactcaacaacaacaaagagaaacagatttgagacaaacataatttaaacaaagctagaaaaggctttaaaacatcttttagcatgccttgcattagtaagcacatgtgcaaatgtatgccatcagaaggctatggtaatatctatttagaagtgcaccaccggactgaaatctagactatgttgagattgtatttctcaatatttctggtatagtaggtgtctaagacttcttatcagttatttaatacagacatttaaatagttgatattgtttcacatatatgtatagacactacagtgggaatgtctagttttataaaaacaaatctatttggtgccactaatacatgaaattttgacaggtggcagaaatcaaatgacatttacagaaattcaaacaaaatcttcgcttaatattactctcctttcccccacccttaatcaatcttgaaatgtcaggctgcaggcagccactgtgtctatttggaggtggatactgaagctgacctcccagaatttcctccttccatcccccttggcaacaacagcagtttcttatttttagttttctgggagaggaagacagagagagagagagagagagagagagagagagagagaacactgaaactgtatatttctatgagatgctggagtctgataggtcctttgaagaatgaagatgcaaaaatattaggttgatgcaaaagttattgcaattttttccattacttttaatagcaaaaactgtaatttcttttgcaccaacctacacatttttcttttaatgagatgataagcatatagagaggggtcttgaaacagctagatgccttttgtgttattttggggcttctaggctgcctttctgctgccccctaaccctcccttcatctcctcatccacacttttacaataaccccaaagctattattaatattaaggaccaataaaaagttggtagaatttagagagattgaaaatattttttatttcagtgaaagttaaatatctggtctagagaaatactcagggtataaatatgtcaatactttcatggctgttctcataaaactcagctccaaattttagctaggaaaaaacagcagagtgtcgatgaagagaagaatgaaatttcaggattcctgaatgaccactaaactaccaatgcatccaactatgttacaatagccacaagcaccggcaaacagccagccagccaaaggctgtggcagcaacgtgggctgccaggacccttgctccggccccatgccttgctctctttccataaagggggtcatgtgatacaaccgtggcaatgccacagggcagaatctgcagtgagttcctaaggaagcttttgcctccctctcctcctgcatgcaatggggagctgatggctgcagtggctgcaacgtggacctgactatgaagcaaagggggagagaactgcagacgagctgccttcacacaacatcatgaatccatgccaggaccacgtaccccgacctttttgttatgtgaggaaaatcaccctctctcgggtaagcatctgtagttgggttcgtgctgcttatggcctccaatagcctgaatggtaacacacacttctcaccaggactccctcagggtctcccgtctctcttctggccgctctctctccccagccctcctcctagctaccaccccttgctgctgatgcactgactttgatgctctgctgaactctcgtgtggcctgtcaacttgcctgaactccctgtcctgctctgttcatttttactccctcctgacacatagctctgtgtgcttctttatttggtagcctttgcagctcagagtaaaaggtatttcatttgcgaaagcaacacaacacaacaggtttgcctcctgctctccctgcaaggggaggggccggactcatcccatcccttttaaactttaaaccactattaggactgctgaagggaaaattagtgtgtaaaaataaaatgtccccagtgatgtgcacacccatttttccatgtgttcttttttttttttttaattatactttaagtgctgggatacatgtgcagaacatgcaggttcgttacatagatatacacatgccatagtggtttgctgcacccatcaacccgtcacctacattaggtatttctcctaatgctatccctcccctagccccccaccacccaacgggccccagtgtgtgatgttcccctccctgtatccatatgttctcactgttcaactcccacttacgagtgagaacatgtggtgtttggttttctgttcctgtgtcagtttgctgagagtgatggtttccagcttcatccatgtccctgcaaaggacatgaactcacccccttaaggctgcaaagtattccatggtgtatatgtgtcacatttgctttatccagtctatcattgatgggcatttgggttggttccaagtctttgctattgtgaacagtgctgtagtaaacatatgtgtgcatgtgtctttacagtaaaatgatttataatcatttgggtatatacccagtaatgagattgctgggtcaaatggtatttctggttctagatccttgaggaattgccacactgtgttccacaatggttgaactaatttacacttccactatcagtgtaaaagcattcctatttctccacatcctctccagcatctgttgtttcctgactttttaatgatcaccattctaattggtgtgagatggtatctcattgtggttttgatttcatttctccaatgaccagtgatgatgagctttttttcatatgcttgttggccgcgtaaatgtcttcttttgagaagtgtctgttcatatccttcacccactttttgatggggttgattttttcttgtaaatttgtttaagttctttgtagattcttgatagtagccctttgtcagatggatagagtgcaaaaattttctcccattgtgtaggctgcctgttcactctgacgataaatttctttaggtgtgcagaagcttcttttggtacttaaaatatttttagtactgcattggcaaatcaggaaaatgctgatgagaagaaaatgtacttgctccgttattaacaatctacatttcgctatacctttaaaacagactcattgaggttttagactcaattactgtaaagccagcatacagtgtatgggaccaggaacttgcacactgtgtgattaccacagagttttcagggaggaatataatgacaaactttagtgagatgggtttgtggtatttatattttttcttatttctttttagctaggtgtttctcatatccaacataagtggaggtttgaataagctaatagattatacaatagatttgaaggtacaaacatgttttacatatgaaatggcatgggatggggggcaacctattacaatcccaggaagccagtgccagaactgccaatcggaagatatggcctgggccttcctgttaaatcggtagattccttgtctattagaaaatgctttaatgtactcatcaatgaattacaacaaaggaaaaagactgtgagaaagtaaaatccttaaggctcacctaaatctgaccaaaatgtgcaggtagaaccagtgtatgggacaccaaacgggtgctgtacctctccacttccacactgaagcttggaattatgtatgatcataagaactactctgtgttcatgacaatttgcttaatcaatgttactttggatttactacacatgttctagcaaactgcaacatatatttttttcctatcgtacatgaagtgtttggtgtggaactttattttatatcccatgctcgttaattccctaagcacagctcccatttttcaactgctgctttgagaaaaggagttatttggtttgataatcctttccctctcctgaccttgttgccccaggatatgaacaacttcaataagcaatgcacaagggaagtactttgtgttttgcccggaaagccacagaatctttgaatgcaacagacactctctcaaggtaaaagactatgtccaaatttttttttgcttgcccaaatttttccccagcttttccttttctctctcacttttctttttccagaaaaataccaaaaaattaaactaaaggtttattctcagtattatgcccaaacctacctacaaacaatacatcaatataagactaattgtgcataaaattcaaattctattgcactgccgcataaaaatgcaaaatgctacagtggtataatgtctaatgctgagcccagttccataagagctgccccaagacagcttgtacagatgcaattatctctcacacactcaaactgctttctttcacaacattacttttattatgcaaatgtataaatctaattttaatccaaaagaccatctagaagattaaaaccgcactcgtgtcttactttcactaagtgtaattaaagatactaaaaatgtttttcactggaggaaggattttagccaccaggtcaagaaaccacaaagggcgccatggagctgccaagctgacttcgcattcatcttcattcttgagtggttctggtgaagcagaagtgatagaaaaatgagccacagtagcagcagttttcggcagagggcagcagatgctcttcacttggaagagacagaaagtcctggcagagcctgaagtggttctgaatccgccgggtctgaaaggtcattttgttaatcacaaaaaggctgaagatctacaaggtagcaaggacacagattgcctggtttcacagacatatggtcaccggcacaagaatttttggcaagcctgtaaagcaagcctttacaaaaactgtcttcattaaaaaaaaaaaaaaaaaaagagtgacgcaatctcgatgcccagagtagctaaggccaccatagggaaagtcatttgctaagctgctttttttttttttttcttctccttactttcctgttttactgttctatatccaggtaatggtagttacagcagaagttttttatttttttcaataggtctatcaataattgttacactataaacttttcatatgataaaattggtaataatgatatctatataacaataactaacatttacagggttcttacttggtatcagtttaagctctttgtatagatagttttattttaaatctcacagtgaccctgaaatattactattaccatttcctaaatgagagaactgaggctgagagagcaatttatccagtcacacttggtatgaagcagcagtagcccttgacttgaattggggtctctgagacagcagagtctagaactgtaccctccaatatggtagctgcaagccacaagtggttatttcagtgcgtctatgctgaatggagagaggactgtgaaatacatgctggattttgaagactctgtgtgaaatcagaaagtatctcaataatttttacatcgattacatgttaaaattataatattttggatgtattaggttatataaaatatattattaaaattaacttcacctttaatgtggctattagaaagcttacaattctataattgtataattggtacacattattctttttttttttttttttttttttttggagatggagtcttgctctgtctcccaggctggagtgcaatggtgtgatctcagctcactgcaacctccacctcctgaatttgaacgattctcctgcctcagcctcctgaagtacctgggactacaggcatatgccaccatgcccagctaattttttttttttttttgtatttttagtagagatggggtttcaccatgttggccaggctggtcttgaactcctgacctcaggtgatccgcccgcctcggcctcccaaagtgctgggattacaggtgtgagccactgtgcccagctggtacacattatatttccattggtcctgttggctttagatccttgactcccacgctgtacagcccattgtcccaagacaccttcttcctcgccattctcaggaaaatgaatgacgttaaggaattctgtaaaatttctcgacctgaaccttggtagttcctctcactgaattgatttgtttgataggaattatgtcggatgtaggtatcacatggaatggaaggaggacagaattcagggataagagggaagaaaccactactagcatcacctctcactgtgtagacaggaacatcagaggaatccgaatctccactttgcatcgacatttcctggacaggattacctctcaactttaagactccaacttctagagtttacatagattattggtcaggatagtaactaagggatccaatgcgtgaatatttgaacaacctacagtcatggaaggaaaatttttgttttgattcatctatgttaaaaaaccttcaagctcttcttggcaagcactgggccagagacaacgtgtctttggtttacagagaagtttccccatctttttcttttatcagcacatctctttcatttcaacaaagattctcaaccaggaaatggtcaccatggaaggcagtgagatggaggataggctgtataattccgatgactatccagggggattctggcaaggtgcctcctgtccacctttatgttcggtgcttcaagggctcacttgagtttctgcattcttctgttgatgcttaccatcaatgcccctgacagcctgggtgagggtgcaggggagaggctcaaaggggccagggttttgctgtctgtcatgtgccactctattagtcaggcttctccagagagacagaagcaataggatagatctttaggtagataaagatacatatatgaggggagatttcttagaggaattggctcatgtgatgatggaggttgacaagttctaggacaggccatctacaagctgaagaccctgggatgctggtcgtgtggctcagtccaaatcccaaaaccttggaaccagagaagctgatagtgtaattctcagtctgaggctggtgggggttgggtgctgatgaaagtccttgagtcccaaggctgggggtcctggggtcctgatgtccaagggcaggaggaggagagtgtatcccagctccagtaaagagaaactaatttgttttcctttgtttttcctctatataggcccccaggagcctgaatggggcccgtccacattaagggctgatcttccccttccccaatcaatccacttggactcacatcccaacctcctctggaaacaccctcacaaacacaccccaaaataacactataccagctctctagctattccttaatccagtcaagtcgacacctaaaattaaccattacagccgcacattttggttcataggaaagaactttaaagctactgatctagttaaccttgctggtcacccataaatgagaaaggatgtgaatcaaggaggaaggagacgtgctctacaacataggccacccacactcactcctagtatgttaccaagtgacaaattcacacatcacattccattgtagaaaaaaaagtcacttcttaatttcctcaatatctgatctcaccttccgcttaagccaccctctgtttttctccccagagaggatgccttaccacgtgtatgccgcctatctcagtatctgctggtgtaacgagcgcttttggtacctgttaggccccccgtctccaactcctcgcacctcctttccaaggtggtgactgggtcctcatggtgagtgagaggaggggtccccaggctgtttgcagatggggggctgccctctattcctcaccagctgctgcagtagtggtctccctgtcaccacctgctctggctgctaacttctttgaaaagggaaagttctctctttgcttagggctgtgtagcctctgaagatctggccgccattcccattcaattcctgggcacgcaggtctgccccgtaggctctgatggtaggctccgtttgctcagtagccagcaccaggcctgcccctttccagcgacctccctgcccctccccaggcccctaaaggaggttctgggagctgtgcccaggcattctctacctgaagccactgtgctcctgcctggccactgctgcagcccccagcaggaagcagagccacaagccctcacctctcatcctcccccacactctatgcagccttcttgtcatggacacaggtcttccctccaccccacagtccatgtgagcctgaaagagaggttctgttcctcttctgtctcttatctgaccagagctgccactacctcatgccctctcctgggattgtattaactttaggcttctgggaaagttgatttatgaggaagaggaagagtgagaaagaattggagaaacaaaagaaatcagagaacttgacaattttcttgttccttctgaaatgaattttcaaggtgacttattattctgtttaaaacactaaattctcagaatgctatgtacttcttggtgctaacaaactgaaaaagaatcacacctacatcaaacctatgcagtttggaaatcatctgctcttgtggctcatctgcgttgctcacttgtcttggcaaaagcatatctgagttggcaatgtctcttttcttttccgctttttcttaggctgtctatttcatgtgctatagctatttacaatagattgcatgagccccagcctgtttctaagaaaaagataatagaaaaatgtgtataaaattgtaaaaatacaatcatgtacaaagccatagttaacactcgagagcctatgggtgagtccactgagggcacctgccaagacccttaaccacagaagtctgagatatccccaagctgggactcccattactttccctattctggctctctggtgtgcttcctactatgatatcctagtttttctgcctctcttcaaccatgttttcccttaaaaaagatgtatatacagacataagtcttgtaagtgaatgcataaataatagatacaaaaaggattttattgtagtattccctagcaacacaaaaatatgggtatatacacttccagtgtcacattattcaggatgtctttttaaacagtataaatattatcctcaactgtaagcaaatatagaccagtaagggagcgacagacagctttttaaaaactgcttttttgaaaagcttatccaaatcaagcatttgttatctttttgcaatgtcaacagagctcttgaataaaatattagattatgcccctgctttttaatctgaaagtcatgtgggttttggttttgtcataactaccttagtgcctgtgtatactctctaacacccattattttcctaatgattttatgaaactacattggttttgcagatgagccaaaaatgggtaaaaaggaaagaatgaagacataagtaaaacagaaaacatggctttggctaagaaagcaccttttcttgcactgtgctttaatattcagtaaacatttggttacggttaaaagaaataagaaatatgtatgtttatattgaactggctaatttaatggctgctttgacttctactaaagggtcatctaatatttgataataaacacaacacattaatttttcacttttctttgaattacgggaaggaagtcttactatgaaaagcctcattatgaaaggcctcagtctggtctcaaatccgcagaaattatactctttcctcttgacatcttgtaataaataaaactgttaatattttgactttagacaaatttctcttttgctttcagcagctaacagttacaaaaagagacagtgccacattagttacagtaatttactttggggacaccagcagaaacacataaaattcattagtggcgccaaaagctatttccagttctaataaaaaggctaaactacaatttatgaaacgagtcttaaaactttcctgaagacagaagagttgagatgatctttggaataaccaaagcaagaatccctactgtacttaagccaaaatgtttgttttcacaataccgtaacataatgtgttaacattaaaatactttctcattgccaaatgaatataaactggggagatgctctctcagctcatgctcttggtccattaagcccgggttcctgcctctggcagtgtttcatgcttcaaagaaaggcaacaacaacaaaaaaaccttataagcaaaattagaataaatctacagctcttatgatcaatcatgcaaggttagcactgggagaaaaacacattcgcttctgtttcccataggaatcgcatgcctctgactttgagaccttgggaaatacattttcatcccacaggaaactcaaggttgcagatggacacacacattctactaatatcatttttatttaaacagtttggtctgataatttattaaaaagtgttccctaaaggaatgatgctgctactaaaaacattttcctgaattacttttaatctaaaaagtgcttgagaagaaagctggaagatacgatagttgaattcctacagaagccttgccttctattaataatgaacacaaaatatttggaaaataagacaatggaaataaattgaaataaacaagttggtctgcactggtctttcttagaatacattatgccattcaacacttcttatttagaaatgtctttttccaggaaaagtcctatgccctttttaaagtagatgactttcaagctactataaagacacatgcacatgtatgtttattgcagcactattcacaatagcgaagacttggagacaacccaaatgtccatcaatgatagactggattaagaaaatatggcacatatataccatgcaatactatgcagccataaaaaaggatgagttcatgtcctttgctgggacatggatgaagctggaaaccatcattctcagcaaactatcacaaggacagaaaaccaaacaccatgtgttctcactcataggtgggagttgaacaatgagaacatatggacagaggaaggggaacatcacacatcggggctggttgggggatgggggcctgggggagggatggcattaggagaaatacctaacgtaaacgacgagttgatgggggcagcaaaccaacatggcacatgtacacctatgtaacgaacctgcatgttgtgcacatgtaccctagaacttaaagtataattttaaaaaatcaataaaaaataaagtagatgatttctcaattatttcttctgcatataacccatcgttgaggggtaagcgcagaggagcaatgtggcggctacgtagaaccacttcttaaaggggagagtaacatctaacactcgtgctaagatttccatgcaatcatgtgcacaaattgccagctcagggctcagcacacaagtgtaaaatttaaaaatgccagaacatttctgctcaggcctattcataggccaggcctccttaggtttattgatacccttcccttagtcacaaaatttccttacaaagggcctgtggaatagcagttggaggccaaaggtctggccaccacctaataagaccccacccaaagtcatccagtataagaagttggtttcattacagtataaagtaaaattaaaggctgattaaaagcagcagtttacatctgtacatcatctgatctaatttcctcattcctgatgaggaaactgggccgtagacaggctaaacaaattcctcagaagttaagatcctatatgttcctggtgcggttcactgtgtattcctcgccgtgcacacagtgtcaggacagggcaggctccaactccttactgtttggtgaacgaataaggagggaaccagcctgttttggcgtaaccagcttactggctgtgcggctgttaggattcagatttcctgtggctttttactctctactacacttaccaaagaaaggatggttctggaaagcatcacagtgtgacacagatcaagtgcagaccgaactaccacccatgtgtacacgaacaggggccagtgactgatgatgcttcaggtcccgttagtgggcgccagtccttccttcaaccattaaagaaaaataaagggaacacactgatattttttcctttcaactgggtgcttgctgacctcagagtcctagggcacatgtggttgccagactgaaagaacacggagcgtgtctggaggatgccggcaaagctgagaagccaaactctggctgcatccactgatatttacagctttgccagcctaggctctgctcccaccactcttgggtcagacccgcagaccctggccaaatgatggatgaacaaatgcactcagacacagatatctagtgaaagagtgggttagggaaccgggccgcttacagaccccaaggagggtactgtaaagagtcagcagccacggctggctggtgccgcaggcatttattcagcacaaatttaatgacaaaggctttgagtcaacacacttgtggataattaacatggtcaccctccccccaccacccagagcagtcctgctcgcagacgattaaaggccaggttctggggcctaagtaaactcacttatctagatcagtttctttacatccccttgttacctaacctaagctcttaagagaattcagctgccttcagccaaattttctttagaagctttgcaaacccctggccttccaaggtttgcatctttctacaattgttcccaccaccctgaccaatctcctacacaccacaatatgcattttctcaaggcattctgctgaaggaggtacagcatcggagaaaagcctaggaaacagagggccccgactgccttatcagtcatgctaagatgatcttaccaataatgaaataggatctactattatgtgatctaataaagttatacttttttgataaataattcagcaaagtttcagttttctgaatcaaagggcaactaaagtacgtattattttctgaaagaactctacctactttaccagaaagagaacaccatggaatatggtacacacatcactgtgtcatgtgatgtacagccttggactttacatgctacttaaaatggattaaaaacagtgtttactataaagaacaagaggagtgtagcaagtgtcatcaaatgctttcataaagcccatcgccagacagtcagttacaaacactgagaagacctccaaaggtctttatttgtggcggagagttctaggaaagatgggtggaacccacaccaaaagacgtgctgctctttggggagaatgagtggtgtttcatgtctttagctgttgatatgtttgatccccaattcagggagcaaatggccacatcttttgtgtggaccccattggtgcagagatgagcctgttctatgactgcttccaatgcaccagggtgactaggataactctcagtgtatttctgctacatcaccttgcccttcattcagtaatgatacaaagatggaggttttcaattaaaaacttcacttaggaataaattgtgtttcatgggtttatgatgccctaaaatgtctctgagaatttacacttccttttttattttttattttttggcttgtgggtatttgctttgtgggcagctgcaaaatcggtattagccaaaacaaactgataattaaacaaacaaacatgatggtgtcatgtatcatgtcaattagagtaatgttggaaaatggaagtatacaatacttctaaatattgatttattgctctcctttttcttattctatagaaaaactagattaaaaaatcaatgtcatttacatgattttagtccaataaagagtgtaataatttggctgttcaattaatttggtttgaagaaatgagtgtcttagtctgctcatcctgctgtaacaagatactatagactggatggcttataagccacggaaatttatttctccaagtctggaggttgcaaggccaagatcaaggtgatggtggagtctgtgtctgatgagtgctgtcttcttgctgtgtcttcacacggcagaagggatgagagggctctctgagttcccttttataagaacactaatcccattcctgagatctctaccctcatgacctaatcacttcccaaaagtcccatctcctaataccatcaccttgagggttaggagttcaccatatacattttggagggacacaaaccttcagttcatagcagtgggtaaacatttagtgcttgaatatttgctagtgaaaggattaaattccaactagccaagaaggccacaagccagcctttgtagagaagtagagacatagcacttagaagagggggtctgacatctccagagctgcgccagctcttactgcagtaccgttcattgttaattaatgcattcactcattcattcaacagacagaatcgcgcagggctacatttggccctgtggggatgtagaggcgcgtaataggcaggcccttgaggcaggaagccaatgagagtgtaccatgcatgcagataaccagagtgctgagcaggcaatgaagagaaccattcgcaggacacacagctttaattaagtaatttatagttacgggaaatcttcaataattgatatcttgtaagtgggagctgaaacataatgggcaggcaaaggagtgcagaaggcagacacagagctggaagacactaggcactgaggaaaaccagcaccgaggaatggcgtcttcgtggagcatggactggatcaagggatgatggaagaggtggggaaggcaggctagggatgctcatgcatctgggctttgttcaggaagcaggacagactccttgaaggcgtttgctcaaaaatgggacctgatcagactggtgtttcagaaaaatgactcctgtagacatgaacagggtgatgtggatccaggagaagtttagggcaacgctctcagccagcagaatctaactgagaagcaagggaggaggtactgacatcggttagggtgcagtcaggagcgatttcagaagccgcactacaagcctctcccctgcaccccggcagttgctgcccaatcacccctccctttcacctcacctctcccaacccaggctccacattccatcagtcaccgtttaacaggcatccacatttagcccttctgcttaaaacctccactacttgacccgtgaagtcagattatccagtggtcacaaaaggcaccctatacatgactctgccaacctcccacctcctgtcttgcccttcccaggctggccctgaaccacggacgcttttttaatgttttccatcctggtattctcacccaaccatcctccgcactctcgctctgcctgcctccttccccacccacctagcaaatgccaatttgatcttcaggaagatgctgcacataagctcgtgctgaagaatccagttaatgtgagtggagcagacctaaaatcttggggcgatagtggttacctagtgacccacatctttgtgatttgctaatgctgataaaagctttgttgacaagccctttcaaaggcactctgcttccactctgtgacaatagcgccaggtctgagtctctagcttaagggtttgtgaaatgctttcaggtttttcactgaaggagttcacaagctttggtgcaccctgagttgagctgtgtcaatgagctcacatagcgttcattgtgcttacacacccacggtatcataataacagaagccttttcaattttcaatttgattgaatttcaccctgaaaaggcataggtttttactgtgtactagagtaagtcccactcttccttgggaaactcataatataatatgaaagcagagcctttagggtctgaaaaattgagctttgaaggtctgacaacacctaccatctacccaaggaactgccgagcacccaccaataactccctagtttgaaaacgtggccaatcagcgcaactctctgaggctcagcttccctgtagagccgtagatgagatgctttgaagtaactggcacttgggtgacacacacggtatgtccccaataaatggaagttaccattgacatagtttatactgtcatcataatagaatttcagaactgaaattaaataaaccaaatttatttaatttaatgagtttccaaaagcagagagtatcttaaatcttcctgtacttccaagaattacattgttttaagatgtcttttaaagcagtttcagaagtaccagtgtgttgccatttaccagagtcaaattcaaactttcacaaattcatcatctttaagttatggcgctctctggataccctctccgcaggcatccacggttttctcttgtcatcatcatcatcagtgaagatgtttgtcccccaccatgtctagggccctagactaggcactcaggaagagaagcagtgatgaatcaaaaaagacacgtggttctctgccagcaaagggcttgtaaaagaccacacagtgacagtcaaccacttgggaaagaaccacatgacacaggaagttcgagtgtctaaatacaaaaacggttttcttccaaaatgttagtcacagataaaataggatacagacaaaaacaatcctttaagggctgtttgcatccccaggggtgtttgcgggcagcactaccccagaagggtggggccacgctttctaggcaggctgctcctgctaccctcttggaactttgtgctcccagccacagccatggaagaggaagagagggtgggagcccagcaatggttgattgggggtgagtacatcagaataactctgccgtagcagacaggagtgcccaccatgtgccatgcatgagctagtgcttactgaaagccttcaacattgtgggattccatagatagaattttttctgagaaacagttttctgatggttgtaaaggaaacaaattctttaccaagcatttaacatctgcaaagcactagagtaccaataagctctacaagacccgaaatacactagagtaccagtaaatcatgcaagactcacaagtagctcagtcagactggtaagagacaagacaggagaagagtagctttgccacgtgttttatgcaaagtgtcaagtgacaggtgcaacaaatccatggcacaaatatcacaggccctcaaaagcaatgagtgtaaatagaaaataaaataatctggaaaaataattgcctatggcataaggcatcttatttatttaaaaatgtatccatcataatatgaggatgacttcaggctatgaggaatttattggacagttttcattcaatggggagataaaaacgctttttgaaatgtcttgctatctgtagttagaggaatatcctcctcttcttacatttctatttcattttctatatgcagttgctaggggtacgcacacacccagacaaacacacacacacacacacacaccccacacacacacattcctcagggctttttattcattggaaatttgccatagctaaacacagccactgaaataaaaacatatcctgacatgcattcttacccaatttatcccatttaggactgtagaaagtatctgggaagaaaaactaataaaaaaatgtgtaagtcgttaactatttcttgttgagttcttttccccccagcagtacattaaaatggtctgtacaaattgatagcttcagcattcaaagtgcattaaaataagccaaaccaagactgtgcaccaatgtcagagagcagctcctgtttccaattaaaagagactttccagtggaactgatgagtcatggctcaacatggcagagaggtcttatttatttttttcaaattttctttttagttttaatgatagtcacagcgtcacacatttttgttcattagcatagatggggcctaaggttacaaaagctgtggtaagaatcgtccttaattgcaagggttattctaggatttacatgagaaaaaaaaccccataaatggcaacccaggcagacacaggcatctgtgagcatcttataaaatatctgtaactatagtgtaaatggcaaaacgttatctagtcttttacttaatatgacatttgggtgaaattgcatcttgattcatttgatcttgctgtttttctttaatatgaaattagaaaaaagtagtttcacttttgtttttagtcacattttgaaataatagaagtcaaaataaatccagttgtctgaaaaatgtatctgtttctaaatattctataaaccattggaaactgtattagtccattctcacactgctaataaagacatgctcaagactgggtaatttataaaggaaagagatttaatttattcacagttccacagctctggggaggcctcaggaaacttacaatcatggcagaagggaaagcaaacatgtccttcttcacacggaggcagcaaggagaagtacagagcaaaggtgggggataccccttataaaaccaaatctcgtgagaactcactcactatcatgagaatagcatggaagtaaacactcccatgattcaattacctcccactaggtccctcccatgacacatggggataatgggaagtacaattcaagatgagatttgggtggggacacagtcaaaccatatcagaagctttgcagatcattgtctctctctgttagacctatgattatctaattaaatttctattccaggctttgctgtacaaacaatactgtattcatttggcacaataaaaattaaaacagaaatatttgtcccggaaaatgtaaaggtatgaaatacctttcagaaaaaatgcatgtgtatttgtgtgcatgtctgactgcacacacatacacatacactcccaaaggagataatttagttggttttctttgttttctgattgccaaataaatttctctgctgaatacattgcaagtctaccctcatgattccagtttgtcatactgtgtttttatattccttccaattgaggatgttatgcctaaacatacaatgttccaaagagtctacttcacttcatactatattccccttagcaacattgaatccttaagacatccgttaaaagtcaggagcattcagttaacagcttaatagggttgggatctgtagaaatttatcaaacaaattaacattattgacttttaaacagacactgtagacagtttcaaagaatatcacgaggattttgtaaaagccacatcatactgtggatattaaatattcctggtggaataagatagctggcacagttaaaagaaactgagatattgcaaggccaggagcactgctctcctctgttgcccatgaatcttctaaggaaagaaaagtgctttcttgccacttcagagttgtttttggtttcctgaaactgtcataatttaattaaagcactcagtgtcctgcatatgtgacaccatctagttgacagaatcattccactcgatttttctaacaggggacaagatgcaggtgccaggcagctgctcatacagtatgagaatgggaggggcctctgtccaaaatgtctcctgtcagacgaattaaaatgattatgggctaaagctgggtgctaaaaatgtgtctgtgtgtacgtcacatgaggagggggctttaaccaaatggaaaacttaaacacacacacacacacacacacacacacacacacacacacatcccccaccccctaaaacccaagcaactttttgggactcctaagactgtaagtgagttatcgttactgatgggaatgggttctgtcccataggtgagtcagaacggagaaacggatgcctgtggcaaggcagtgttgtcagagacagaaagcacatccccttgtcggcctgtaaccacaaggtctggatgagctgaataaaaagaatagtagacacccctggtgagcgtccccgcagatgggctcagtccccctgaaggcctgtagcagggcagcgggagggccttctcaggctgagtgggacctttccataggcagacggtgctctgagcctcctgtatacagtagaatgggctcagcactgacctgtggcaactcatgtaatccccacaagtatctccatcttacagacaagaaagtgtgttcttaggaaagctaagcaacttgctgcaggtcacacagctagtaagcactagggtgtttccaaagcctaactgttcaatagcactcttactttctactcaactcaccccaagaacaggcacgaggactcaaggagagctggggatcacctggacacgaggatggaagttgaggtgggctcgccatcctttggggttggtcttcccaggagagaagagccgtggaatttacctggagatgctctgtcttgggcctcaccaatttcgaatttgttcatcataggctgccctccacattagtaggcttcaagcaggtcataagaactcaaaaaagtccaactaatcaacaaatgcgagtactttcccttttaaaatactttttcacaattgagagaaaggaagagaagagttaaggatctgctgagtgtggcatttcctcagaacttctgtatgtcttctccctagagcaagctgtgggcttcgcatagcatccctgttctcaccccaaagaacccgaggccaggacagtgatgttgaagcgggcagacggtgaggccgatgctccttcctcagggccgtaattaaaacgggagacttaggagctggcagaatccttgggaatcattttgtctgacctccttattggagataccatggccagtgatagttgataatttaccaaaccccaaattccttagtggtgaagtagaaaaaagagtagatttctggtttctaatccagatctctgttccttatgctgtaaataaggtgcaaacaaacaaaaaacatcaaccagaaaaatttaaaagccaaagagaaatcattttggaatatagtagaatcgcttctctacataactgactataatcaaagaacaggtagactcctgttcaaatgaatactgttagaacatctggtcttataaaatgagcctatttacatgtgctgacagatggcccacagtgaaaatgctttgctagtctgattacaacaaatcctaataaacccgaatcctctctcaggtgccttcctcagcccccattcatgtgagaggcaatctctattacaaggacatcggtgtgcaggcatttttcaataatttgccatacaactctatctgagcatcatcagacgcactacattgaaagaatcccggattttatgcaaagctatcttcattgggttttattttgctgctttttttcctggaggaggggcccggtggaaggaggttgacagctgcagaggcagtgactcagtgaaaagtggagagttccagagtcccaggtaggtgaagagcttgggggccgttgaattggtgggggattaatgatcaaggaaatctcagaactttaagtaactaacgcacttccctagacaatcctgaaagagctctaattaaaaataaagtaaatgtgtccaggcttttttgatatttcatcaaatttttgcaggaggggaagtgcttgtaagagcccaccaagggctgaatgtgaagacaggtgccccttcatccacacatgccccagggctgtgtcctcaaccctgacaccctgcaacctccttcagtcctctccatcctggtgcccccgaaacatgagtctcccatctcgagtctcccaggcactatgagcaggccgttgtgctgagggcagcacagagctagagacaaggccaccctgacaaggcactgtgctgggcatgtgatgtgctgggcacatgacagcactcactatgtcagcacaggacagcctaggggagccgcatgtccactgcccctgctctatccacagctctgtgcaggatgtgcatatttgtctcccagccctgatttgtgggcaggaggctcagagaaagggctggcaggggccagagggcaggagcagcgggcaaggctctccctgccacctctcgcaagggggctgtccattccggagacactgggccggacctctgtggatataatcccctgtctttcaggctgctgctgcagctgctggtgaacagtcatggcatgggggctgctgtgagtgaaagcagggagcgtggtccttaatgcacatgcgggagtgcccctttgatacagagttcccctgacttaactatttgcaacgaaagagccacttgctcctgtttcggaatgcccatgggaaggatggaaatgccaaagagcaaactcacaaagccactgtgggaggctgaggcaggatgatcgcttgaggcaggagttcaagaccagccagggaaacatagccagaccctgtctctatgtatatataaaaaaaatacaaagtcgagattaaacaggaggcccaacagaaatacaggcctgtggtccacacaggatgtttacaggctgtttcagagcttcagtccgacctacagaaaggcaggaggagggatgaccggccgcacgtcaacagctgtaagcacactggagaactgcctgagcgctcaggtctgttcatgttcattttagatgaagttttgcagaaaaagaacacctgttaccaaaagtgccacgccatcacataaaatgcctcatcagaatgtatcagccactgcagctctgagaggctgatggagcacgacctcataaaaggcttgaaatgaagcttaaagtaaatccctgttggtggaagaggtaagatgtttttataaaccgctaaatcatgctgaaattggaagtgtgtctgctgaggatctgaggtttttctaaggtattcatgcatgtaggaaatgcttctgagggtcccttcaccttggtgacaccatgcttctgcaccgccacttaaatgtactaggtgtgacttgggagtccattaacgcctggcaggcaaggaggttacatcatgggaatccatttcattaccataaataaatgtcatatggctgccatacattttattgattaaactgtcaagaacaaaattgtgtaagaacaaaaactttttattcctgtggcaaaaaaaaaaaggagggaaagaaaaagaaatgaaaatatctacataatttaatgtctctggccctctaacttcttacccagaataaaagaacaaagcccagcttactgctcccttggaggctgcagcacgacctgcctttcgtgtttctacagaacaaggtagccttttctcctctgcgttcccaggcctgttgtcaactctaaagaattgcttaaaagcacctcttcaggtagtagagcttatcttgagatgaaactaaaaaatagactcatttgccttttatccttaaaaaaaaaaaaaaaaacttacaggttggtaaaaagttaagttctttggattggccccaattctgtttaggatacagtttttctgcttcccttacttgagagcaaatagctgttgacctagaggcaaaatttgggcgtgctcccagaggggaggtggcccaatccaaggtgactgatcccaagtgtgactggggcaaaggtcttgatcccaggtttcctgtcaaaatagctagaggtagagttggctttccatacagtcttaaacttttttctcttgtgcttgcttttatttttctatccccttattgggccagggtattttttttcagtccaaggacaaacaatgcctcccaccatcacagataataattacaaaactttacctttgcacagagccttgcagtctgcagtgatattcacccctggtttttttttttcgagactgaatctctctcttttgcccaggctggagtgcagtggcacgatctcagctcactgcaacctccacctgctgggttgaagccattctcgtgcctcagcctcctgagtagctgggactacaggcacatgccaccatgccaggctaaatttttttgtgtttcagtagagatggggtttcaccatgttgcccagggtagtctcgaactcctcagctcaggcaatcttcctgcctcggcgtcccaaagtgctaggattacaggtgtgagccatcgtgtccggccacactgctgattttcttaaacaatcttgtccatctatgaaggcattatttatccctgatttacaaatgagacagaggctcagagaatgacttggcagaggtcaaatgccaggaagtcctacagctgggactagaaatccctagtaatatggtttgactatgtccccactcaaatctcatcttgaattgtagttcccataatccccatgtgttgtgggagggacccagtgggaggtaatttaaccatgggggcagttaccctcatgctgtttttgtaatagtgagtgagttctcacgagatctgatttttttttttttttttttttgagacagactctcactctttcagccaggctggagtgcagtggcacgatctcggcttactgcaacctccacctcccgggctcatgcaattctcctgcctcagcctcctgagaagctgggattacaggcgtgtgccaccatacctagctaatttctgtatttttagtacagacggggtttcaccatgttggctgcgctggtctcaaactcctgacctcaggtaatccacctgcctcagtctcccaaagtgctgggattacaggcgtgaaccactgtgcccagccgatctgacggtttttcccccttttgctcggcacttctccttgctgccgccatgtgaagaaggacatgtttgctttcccttccgccataagtgtaagtttcctgaggtctctccagccctgtggaactttgagtcaattaaagctctttcctttataaattagccagtctcaggtacaactttattagcagtgtgagaatggacaaatagacctagtctccaagtgcagagctccttctagactctgctgtggtcaaatgaccattggggatcagtccaatgaccatacaggatcgagtacgttcacatcttgaaaagcaattgttagcgcaacgtcggcacactctcttttctggcttcatctttccccatggagggtcaccaggtagcagaaacactcctggcctcgcctgtactcctcactccctcttccccaggaaaggaaaaaggagtgtttgaaatttgggagctaaacctggtggtaatgctcagccctggtcctcccacctcctcaaccctgtttgcctgcactgtacgctgcctggactgcacctccgggaaatatgtttgctagagacagcccagccccgatccagccccatggagagggaggcctcaggtgtctgccctgcacaggactagagtgagagccagcaccaaccctctgtgtatctttgccacattctccattattagtctttttagtcacagtcaactctgtctcagttggttcagaactcaggcaaggaggaggggctatttattggattccctcatcctgtaacacaaagcagttgatatttttgcacaaggcgcaatgcctaccaccccatcaaattctgctctgtgggggactgctgactgtgctactcagaataccatgaggctgcttctagtaaaattctttcccagatgactaggggctccagagagatttcattcaaaactgttggcaagtccccagggggcttgagtccttcaagaaccagagctcttttaacgtctcctggggactgcagtggtcttgtgcttaggctaaccagcactgtatgtattttattcttctttcacactttttgtttatttccaaccacttaatcctttttccattaaaattatgcaaaagcctcactttcctcattcatatgaaaatactttttcttctcttccacccccagttttctggttgtagttttactcctaaaatcagcaagacttgtttcacataatgaaagaagctattatacgtcttaaaaacttgcttttcattagcttctaaaacatatacagataaagtgaaaattccaaaactttatggagcattttagttttatgtggtctggaaggcactcactggggtagtcttggagcacatatgggcacctgggcagctgcttatgcttagctgtgtcgcacagacagatgtgattattagtgtcaattagtctcaactggtatgaaacaagagacaacgagatatggaatacaaaatattggcctacataataggttacctcttcagcttgagaataaaaagggagtatatcccactgggactctggcagcagtggtcgacatcctattttttgaccaggcttgagttgacagactcagccacggcctttaccaccgaggtttctttcaggaaaggaaagacaccaagtgaagggaaactattcaggctggtggcaccaacagcaacagccacatcctccccagaactaacacagaattgctgtattttacacagttttctcaggttagtgtgatcaactggagaaaaaaagctaacaattatatttctgagggatggaaataaagtttaaagggtgctgtgctgaataaattaactttataggaagggtacgtccagtgatctttcgaagccctgagctcagcaagaaggctggaaagccggctccctgcaggaatgaagccacctttgcgaaagtataactgagaaaattattatagtgaaagagatctgaccaaaccaactccatcttccttctcatctccaagctatcattgttcattcccgggcataggacaaactgactttgggagaaacttagttgataaaataactttgaaacaaagacggtaacagcccttttccaaaacaaacccccttcctgcctagggactagactgcttttgcaggacacaataaattagctacaaggttagaaatgatggtttaggagtcatgcagctggaggctgcaaaattctcaaccttctgaaattgctcctgggtataacatcattattgtaaaacctaaaatctgtgcttgagagattttgctgaccctgcattcaatggatcagttgggaccacccagatggataaagtggctcatctggtcagaaaatgactcagcacaagagggcagctttgatttcatttctccctatgatttcatttctgaccaaaccaatcagctccccacttttcaacttcttacctaccaaattatccttaaaagtcccatccccgagttttctgggagactgacagagtaataataaaactctggtctcccgtacagccagatctgtgtgaatgaaactctttctctattgcaattccccagccttgataaatcggctctgtctaggcaatgggcaaggagaacccattgggcagtataggatgaggaactcaaactcttcatctgatattttgcatcatattcagaatactttcacagccccaggcaaaaaggagtgtaacaaaggcaaagtgccctgtggcgcttaaagcttctgtgccatacaccatcctgatgggctgggtagtaccattcctgtaaattcccttgcagacaacattaaaaggcaggccacctaccaatgaaccaagctcattaccaaacatttcccaacaatgttgaagtttctgctagtgtaaagagtttacatacttcttttcccctccagtgtggggaagcaattctctaagaaagaagtttaatttatgaatgtctggctgccacaaaataataaggattttcccccactactgtagattaaattatcttatgaaatggattagaaagcaaagggtctgtcttatttaaaataataaaaagaaaaaatctttccaagctgatttgaaaatctacctagaagtcatttagctgtctgttccttttgttttagtatttccatctatcagggaattagttttgtccataaatgtaatcaatatggaatataaagtcatcaaattaaaaaatagatttagagttttcatgataaagtgtacctttaacttgagttaatacaaatgtaaattagatatagatatttgatgccttgcttattgcatttctttggtatgtgacagaaaaatgatcacagtgcttattttaattaaaaatttgttctctttctagaattattgtgatatttatggactgtaatagagaatttctgatgtatacaagaacacaatatcctctttcattctggaaatcaaaaggaagatcaaaggagtcttaactgagttactagtcaatcactttttaaaaaaagacaaaaaataaggtgtcaggtgtaacagagaggtctaagaagtcagtggaggtatacacatactaagtacccacaaaaattttaaaaactacaacaacaataacaacaacaaaaagtcagtggaggaattgggagaagttggaaaaaagaaaagccaaaataagaatttctggtgagaagagaggcagagccaaggatagaaggaactccttactatgatgtaaatgtggtgggttaatcagaaaattgatgcatgttttattatttctaaaaacatttaaacatacacttatatagcaatcttttaatggaagatcaaagcctgttttattttttaaagcatagatctacttcttggagtgtccagtcatcattcttttaaatcagtctttctagtttctggtttcaatttctttaaagtaaaactaggacataaggacagtaacaatgcaatctgaagtcagaattggtttcgagttttagattctttcatttttatagtaattctgcatgcaaatagctcaacaatagttttctaataagcctgctttattaaatctttgcaaatcactcaacttagttttttgtagaaacacttcttttttcattgatggtttcctggcttacttgatttttttaattaaattaagaaatccatattaagcacaactagtaaaaacaggtctgcaaaggaacacaactgacttgttaaaacacacaattaaaccggagggaggagaaatgctgaagctctctagtctcaaatatttagcatgctatggacatcactagggatgtatttcagaggaactgaaggatgttggttaacttgtgagcctcttctatatacattgctaggagaacattttttatgctactaaatttagataactcaaattcaatagtgtttactctcggaaaaataatatattctaaatggacatctttaaccaaaaagttaaattcatttaaacataggccagtgaacagatattaagaagtgtatattgcaatctactttatttaggtattccaaagatgtcatataactatctctcaatagctaagatgattcagttcttaaacctggctaacgcattagatagagagggacatcagtgtcatctcaaaaattatctgaatcttgagttttataccatctattctcattaatctctctcgacccactttttactactaaaacaagtaaaattttttttaaaaaaactttcatattaggcataataataacaacaatgacatttacaaaattacttccatggcataaagtactttctccagtattatttatttcattagcattgattgaatgtctgttatatgccagtttgacatgtgaattttttttagcctgtcttaagatatcttggtggggggggccacagttcatcaatgccagaggagcaagtaaaaaactattaacttcagtagctgcttcttgtgacaactggtagggtcccgcaggaaggagaatctttcctccaaggtggctcacctccaatctcagagggaaaaagcatagtctttttgagaggggttctaactcttggctgtgagcaatgagggatgcttggagtcagctaattaggaggcttaaaatttggaaaacccaaattccctgacccaaactaaccagactgttgggtgcaaagttagggattcactcaggttagggcatttatctacagattgatcatccataaaaatggtatctggatcaggctaggaaatgcatgtcagttttgaaagacatgactcatcttgctgttattgtatgtgagagagttgcatattagttaaggatagtctttgaaggtttataaatgggaagaaagtacatttggattctgtctgtcctccctggaagaggtggtagacacgtggatttcgcctgcctggcatgtcttccggcagctacatctttccctgcccttagttcgtttgattcaagtgggcttgtctcatctcccaggtccaagtgtgggcgcctgacctaggcactgccattcagatctctcatgtcttcatggcgtctgttggcttggacatatggttttggctaagccagggaaatatagatagggaactacctgtgctcatctctgctaccacctggggagagagtctatttgagagcagtaaacatggcatgagagccgagtgaagggaagacagacagcttcgagacgtcatttgaggacatgcacccaggcaggccaacagccaaggctgcccgaaatgactcagctgcacaaataattctcttttttgttaaagctaactttagttggattctattacaatggagatcatcctgactaataaaaccagactggaagcagaagtaggggtaagacctagaatctgtccttgccaacctgcatatcatttatccttatagccaacccaggagtgagtagaattggttagattttgtttctgtgacattttatcaataagaaaaaaaaattcaaagatgggaagccaatggtccaatattagatggttaatatttggcagagcagtgactaaaacccaagtattctgactctacttcctactataattgtgcaaaatatatgactgatgatgtttcaaaatcttacggaataatctcaggactaatttcctcaataaatagccaaaaaaaaaaaaaaatgaattacggaaacatactaaccgatatttggggatgtagatgcttaacttaaaccacagataccattcaacttgtcaaccatgatctgaaacgcacttgacaaaggtatgttcaggtaaactcatggaaatcagttggaattattggtctcatttaatcattgggataaatgataacattactgaatttccaaattcctgaaaatcactgtagtcattatagcaatcatttcaaaacattcaacttaaacgtttataaaatgaaaattcttactaaaattttttatagagcataatcctataaagcagtttgattgatttggttttattcccattcaactattttgcagtttcattcaatttatattatgttagatggatgttaatgtcctagctatatgtgcatttggcattgttgcctaattaaaacttcccttaatttatcaatgaaatcacaataaagtgtccatcactttgtattgcatggacacggggtttaagagcagaataatggcactgtgccctcttcaaagtcattatacagatgaaatcatgccaacatgtccagtagaaacagtcttgaaaagggaaataagttagaaaaggccgctgtctcagccatgccagcgcaggtggcggaggaggcggcgtatcagtgacagtggtgactgcgtgtgcatgcgtggcggaggaggtggcgtatcagtgacagtggtcactgcgtgtgcgtgcgtggcggaggaggtggcgtatcagtgacagtggtgactgcgtgtgcatgcgtggtggaggaggcggcgtatcagtgacagtggtgactgcgtgtgcgtgcgtggcggaggaggcggcgtatcagtgacagtggtcactgcgtgtgcgtgcgtggcggaggaggcggcgtatcagtgacagtggtgactgcgtgtgcgtgcgtggtggaggaggcggcgtatcagtgacagtggtgactgcgtgtgcgtgcgtggcggaggaggtggcgtatcagtgacagtggtgactgcgtgtgcgtgcgtggcggaggaggtggcgtatcagtgacagtggtgactgcgtgtgcgtgcgtggcggaggaggtggcgtatgagtgacagtggtgactgcgtgtgcgtgcgtggcggaggaggtggcgtatcagtgacagtggtcactgcgtgtgcgtgcgtggtggaggaggcggcgtattagtgacagtggtgactgcgtgtgcatgcgtggtggaggaggtggcgtatgagtgacagtggtgactgcgtgtgcgtgcgtggcggaggaggtggcgtgtcagtgagagtggtgactgcgtgtgcgtgcgtggcggaggaggtggtgtatcagtgacagtagtcactgcgttcatacgcgtggaggaggcgaaacgtcagtgacagggctcattgtatggatgggtggtgtttgatgcagcctcctaagccatggatgcatttacaaatagcccctattggttaagcacagtgggaccctgggagttgaatgccacaacccaaacaggattgggatcttgagtttaggatcttcagactcctttagttctggtcccctacaatttgtactgatggttccattgctgttctagaatcctgggcacttttaaaaaattcatactaaatttggcccctgtaggaaagaaagtacatttatctgtttcaaatttatttttgataaaacacttaatttcctattggctctgaactacaataagatcagtggcaatcaagtggaaatatgagacattgaatgttgatatttttctctctgaaggaaattgtgctcataatgtaatatggtgcaggggaaattgtattaatagtaacaggttgtggaaggtgtcctacacctgtccccaactagctgtgtaacccagagtgattcaccgaacccttccctgagacgtacatccttacctataaggatttccattcagagccttttcatatattgtttccaactgttatcttctgaacagtatgcagaacatacaaaataagagagggtctgatagggcatgacaggggcagagcaaaaactggttaatagcatctcgtcgacaggcgtggctctctgcccctgctcaccctgcagtggcttcttcagtcagggctaaggtctctgagcagccatcgtgcagagtgtgtgaagtcaataaatatttaaaaacagagcatagtaagcagagatgacaagtgcagccaccaccacagctcagtcaattaaatcctgctgccagcacaaacttcctgtgtttaaaagtgcaactgggtatgggcccatactcagagagtatattccttgtcaacatttttttttttcaatagaaatagtaagagttttcagatttgggctgtgctgatacaaacatgctcaaaatcccattgagaaaaacatattagtcatctaaatgaagaagtttgctaatgttctaaatctttctatcctgggatataattttgttttattgagtttcttcagtgttaagcatattgtgtcacagaagtgcttttagcattaggaaaagaatcatgttttaattttaatcctttcagataatttattaaaacaaaataagagcatgcaaagagcccagttaaagtgagcaataaaggcctagatattttcgtgcttctgagaaatttagtacggtatgagatttgctggaataaaatcaatagaattggttttatggctatagcattgctatttcatctctttgtttacttgggcatttattactggtgcatgatgcacagaatgggtagaaatgctgaaatgtggtcttttggctctcttccagccagggattattcaggtggagacaaaacaagcttgcttctccagtaaaagatctgatagccttgagatgcccaaggacagtggccagaagtaattgtagttttgccttattatttttttaaactcacacagatatggattgtacagaaatgcattttcatattctgaaagtgtaataaaagcctcaaagtcaacagctcagtagtatgtagacaaagctttgatccataagggaggtcttactgagtatatatcccttctgcccattatcccagtatataagccatcaatagatcgggggcaagggtgtgtgtccatcagagtttaatgaaacagtagggaggagaacaaacacctaggctcatgtttataggggccagggatagtctgtggactttcctgcaactgtccatggagccagccctatagttcttaattgccaatgtggattctcataaaattaaacagtattattctgtcttcactattaagagtagccatagtaaatcacctcctctccagttttctgttttaactgtgaggtgtagttcattctctggatagggatggcttctgtttgcctttgtaattcgttgcagaaaacctattatttgcatttcaagcttaggttcaggtgtctgcagtagatcaacagcataattctttgtactaaacttaagcattcaagcccagtctagaacacatttcacagaatgtcacagtgtcctagagccaaaaacacagccatagagtcaaccatgaacttggaaaatcctccagagtatgcagagctatcaagggcaacgtctcttaggaataaagcaattaattcagaaattaaattttctactttactctttctgcaagaccttagtcacatatatgactttcttcagggatccttaaaactatattagccatctgtgagtttgcaagtagctaaatacaccacctgtaattattagtttaattattataacatagtatcctcacaaagcattgctacatttgtcaaatgtgctgaaatcagttctaaccagagaaagtgttgaaaagacagtgagacaattcttctcaaaattggaggaacataaaagaggcccagctgactcacatcagtacatttgcatgactgaccccctctctcatatggtctccttatggtgagcgccgttcacaatgcaccctcctggcctcttgcttgccttagggctgagtgcacctgtgctgagaaccagggccattcaactcattattgtcatgatgcaacagtgaagaagtacttgaaacagtaaggatgcttctctggcttaaagaaaatattgagggattaatggtgttgattgcttctctgtttgcaacatgactgtatataaaataaaagaagtacgtgtttgattttacccaatggctgacaagcatttgggacatacttcttaagctgtttatataaaccaggttcagaatggtttagagacgtagttcatggacctatttcctatgaaaaggacataagagacttttgtgttttatttctcaccttctgaagtaatatatttcaaggcttttaatcagaaagaatgaattaaatgactaaaatgccagacccaaagtatggccaactgtatcttccaaagatggctgtcacatatttatcatttgaatgttcttctcacaatgtcaggttgacactccgccactgagtggtagggacaatgttgtctctccccaagctcaggcagaacactgtgagtgtctcaaccaacagggtacagtgacactatgtgactttgaaggctaaggtcataaacatgtcatgcacttccaccttgtttccttgacaggacccaacttggaagtcagccaccatgttgtgaggaagcccaagccacatggaagggtcgctgcaggtgtgccagcccagagtctcagctgaggcctcagaagacagccaacatctactgtgatgacgcccagatcataccagtccccagaggtcaagttatctcaacctacaggtcgttccagatgataacccagtaattttgcaacaaaggcaagccagctcctatgttctgcttatatgcctgacccacagagtccacgagcataatgcaatatttgtttatgtcagctgtggtatagttttttactaacttttctttatgagtttgtacagggagagagaattaagagactcagatgccagaccctaaagataaggtgctttgttacgataaggaattctctttccagacatttataatttaaggtatgttgatgtatttagtgcctaaatgtcttagcatggtatttccttgtgttttatacagtttgtctttctctactccccagcactacaacgaacatatgtacaaacttgtgtcaccagaaattgtaagtgacatctgcaaagagagagattgagagaaagagaaagagagagagagagaagacaaacagagacagggagagagaggcagagagaaatggagaccgagagagattgatttatcctgtaaacatccacatcactttacttaacctcttttggtactcggcctttcaattttgtaatacggccaatgaggaatttcggcaaatctcatatctaggagacctaggagcttgtgaagtccttgtccatcagtggctgtgcattcactggctcctggcatggtgtctggtcttgagtgtagacagtcagccttggagaatgtttactaaatgcacagtgaagggagcatgtgcatctcaccttcctggctaccttagttctcatgatatcctcagaggagctctttctaataatggttatttgtcatttccaagggtgtgctacattttgcatttatttaacatcctgaaattgttacataatacgtttattatattataatctcctttgtgtctctggtaatatgcacttttgttaaattttcatatgtatcattgctttatctaatagatcacatttaggacaagcaatggattaagactgccttatcagggaaatctaatgcttgtctttaagaagagaggtttagcttcaattaagacatatacatctaagatttatcactgcaagtagatacttaatgtctgtgtttggaatgtactaattaggttccaattagcagggtcaaaatatgtaaatcaaaagcacttcatcccctttggtgtctctttctctcccataactaattatctgtactcttcttggtcccagcaaacaccacggaccatgtctttaagtctctaatatggtttcttcaagtatgggccaggtgctgtcaacctgtatgttcctcctgaataagtccctgagggtgggagcagagggtctgcattttaccaagaagaccaagtaatctcactggaaaatatagcttgagaaatactattctttagccacttaggcattttcactatgatatctttagggtttatctgatggatacttaccaagtgtttctcatctctccaggggctgtgagtagcataagaaagcctaacccaccgccctatcctggaagtgtggtcaggttattaaggtattgcagatgacaatcatcatacagggcagctttttcagtgactcaaagaaaacccttagtattccataagctgatataccttttaaagttcatttctaaactaaacattgcaaaaagtttcttgtcaaaagagatttcagatgtctctatatactgtttcttgtataaatcacacacccttaccaagagccctgagctgggacccacaaatggaaatcaaaggtaatgtgttcctccattatataataggaatttcataaaacccatacaacagtcatctgtgttatacagaaaaacattcatcactgagcatttgaacattttgatgtttctgaagtacagaattcatgacactctgcaagtttttccaaccaatttacaaattattttcatccctcatcttattatcctacctagtgtcaacttgttctttcggcataatcaatctgaatgactggtaaggtttcatagtgcagcactttagtttatgcagacatctgcccaaaagcatctcaatcactcatagcaagaaacaggggcagcattagccatgaggaaatgctgttttgttacacatgtatatctaaagacagggctatttgtataaaagaaagtcagggtagtgatagacagaactaatgtatcaatgtcagcagaaaatgcaagtcaaggtatggcagcaaaaatcagcctcacagggtacctggaacaccattaatttaaatttaaagcccttgtggggaaacggatatgatataatcactaaattatcattcataaatgaaggtctatcaagtagactatagtattatatttatataagaaaatcttttcaccttgcattcacacataggggtttatgttgctttaagtatttttctagttttatcattacattcttaaactacagtccaatgtgtagcgataagggattactgacatttatagtaagttatttgttcttattattctaaaacaatagataattttgatatagaaattaagaaataacttatgtatgtagatataaagaagtaaaacatgatatatgattctaatggagaagataatgtgatactctctagctatttatgtgactttggaaattacttattgcatgctagaatacaaccaaaccagctattaaaagttaagaggaggtggcaaagcagaaaatactttaaaggaaacttccaaagagccccaggtgatgtaaagttataaaagctgaatttgcttttaataccaattcaacatagtttttcaaactgacgaaaagtacctagatggcattaaacccaaacataaaatctgtctgcaattaaccataaatccttcactatcccgtacacatcttgcttcatcggaatcaatgttgacttatcatgagcaatacctctgattctttagaagtatgtgctacataagatacaaattggctgggcgcggtggcttatgcctgtaatcccagcactttgggaggccgaggtgggtggatcacaaggtcaaagatcgagaccatcctggccaacatggtgaaaccccgtctctattaaaaatacaaaaaaaaatagctgggcgtggtggcgcatgcctgtagtcccagctactcagcaggctgaggcaggagaattgcttgaacccaggaggcggaggttgcagtgagccgagatcacgccactgcactccagcctggcaacagagtgagactgaatcttctcaaaaacaacaacaaaacaacaacaaagatgcaaatcaacagtgctgcatgaagaagtactcacccagaccctggctgggtactcatggcatgctccctcattgaaaaccgccatcatcagtattagcctctccacctcacacacatcataaaatgctcccagtaaatatcatccgggtgcgtgccatgaatttcatgtagttccctctaggaactttgttccactaactgcaacattctctctagccatttaggaataactagttcatacttcccactgtctgtcctccaccacagaatagagaagtacatcgtatatatactataaatacttcatttggtgattaaggtctgatgtatctgttgtatattgtgggtctttatagattttcttttgttaggagagcacatttaagggtaagattccaaagattggaaacattactggactgaagattctttgatgtaactgtgaagactcctaagaggaaaattctgcttgtaaactggccggccagccttcagggaaacatgtcacaggagcacgctggggtcacattgcctagcacaaaacagaactctattaaacatttgggatctgatagtctctaatgttatttagataactgaataaaatgcattttttttttaaagatggggatcttgccatgttgttgaggctggtctcgactcttggccacaagtgatcctctggcctcagcctcctgagtagctaggagcgcaggtgtgagccaccgcacttggctctaaaaggcatttttaaaaatgaaggtgaaaacaattaaaaaaaagtcgagtcaataaaaatttagccaattttcacatccagagaatcattttttataaacttaattatgttattttccttttgcatttggattggccctacctgaaaatgtatacatcatttggtttatgcttacccgtgtggctactgtgaaagatatcaaatcatgtaccccggaagcccttcatttattatggctccagggcaaaggggagcaaaggccacttccgggaggacgcactgatgacacagcaaagtctccagcagccatgaagaagcctggcccctgcaatgccgagagggaggaggatagaagacgatcaaggaagggccaggggcttggacccagatccctttcttggtctcctttctggtctgtcagtctggaaggtggcagtttcttagaaaacttctaacatctaaggtttaggaaatcccagggcagtggggcttttaaaaattgcttcggatgcagacaaagaaacctcaggcctactgtgtgcacctcccacgtgtgtatctacgtaggatgtagagaagacaaagggacacagtgagcatggtggtggcgaaaggtcacctgtctcccacggaggcatggcttcccatggagagaaggaggccagcaaaggccacaggggcataaccagcttaccacgccccctgggagggaccctttcagaagagacaagggtggatggcccactctaggagtgcagccttgcccagatcctggaagacagggtggtgtgactatggtgtgccactcagctccaaaggaacaagggtagaagctctggtctgagagctgacagggtgaggacagctgcagtcagagccagacgaggtgtcagcatgggcccagtccctcatcaccaccaaggtgcaccgtcacagaggcattcctgggcccacccaggctctcagcgtcattagcatgggcctggcccctcatcaccagcaaggtgcccagttacagaggcattcctgggcccacccaggctctcagcatcattagcatgggcctggcccctcatcaccagcaaggtgcccagttacagaggcattcctgggcccacccatgctctcagcgtcattagcatgggcctggcccctcatcaccaccaaggtgcactgtcacagaggcattcctgggcccacccaggctctcaccgtcattagcatgggcctggcccctcatcaccagcaaggtacccagttacagaggcgttcctgggcccacccaggctctcaccaccattggcacgggcctggcccctcatcaccaccaaggtgcactgtcacagaggcgttcctgggcccacccagcctctcacctccgtcagcacatggaagaagagaacagggaagagacccctctgcagacagtccactccatctggggctaagctttgccaaaccgagagagaaaggctttaaactgtgaacaatgtccacaataacgacaatactggaatcaactggatactgtcaaaaagagtctaggttttaaaccagaagtagctaaaaaatgattacactgattttactaggttggactaaatttagttctcctgctgctgagagaaattggcagcttgtcaaagaaaagttacagaaaataaaatgagttgacacatgttgattattgatttccagttcaaactcaccacacaggcatatcaacacacatgcacacacacacacacacatacacacacacacacacacacacacacacacacggtcatatgcataaatatttcagtcacattctttgattcacgtgtatggtataaatcagaaagcaactgagcatcttcctggctgcttccagaataaaccacgtttgttacagctttctagtctggggagacagccgaggtagcccgctgcctccaaaagctgactgtggcagctcgggtaactttggagcttgttttctccacttcagaatattaacttgcgggaagatgacattctgaaagaagacctgttctccaaaccattcggtcaaggagcgaaatcctcagcgatgggcgtgcagactgaaagtcagcgctcgggcccctgctgcatctttgagttgcttcaggagcctcccacctgactgctctgccatccatccgcgcctctcacacttctgttcctccccgtcttaggccccagtgttgcatgtccttggactgatgtcctgataggcttcactggctttgattttccacccgcctccagaacacagcattaggggttctgctaccagtcttcctaagctaaccccacaggacaggggcactctctgcagcaccccccactgctctgagctgttggagttgggaggaggcctgcagagaccttccagggactctgagatgccgtggaacatgcctactggttcctaaatccaatgaaacgtttcagtcctttaaccagcatctcaacgaggatgattccaaatctctgtctctagccccaacttttcatttgaattccagatcctgatgaggggcacagaggccttctctgaacttgatcaagtagctcccacccttggccccttggtcactctcaaccacagtgtcctaatttatcttctccaaaatactcaccagcatctaaaattatcttattgatttgttctcatgtttattgtatatccccctacctcttcccaaattcaccagacaggtgacgtgatattctaaggaaatcatataatactgctttagggtcaaataaaacacacgaatgtcaacgaagacggggactcgtaagttgtgtgtttctgaccctagaatggtacttggcgccaacagattctccaaaaaatatttggttactgactcaccaatctgtatcacagaagtcaacttgacacttccacctggacatctctcagacactaaaaattcagtccaaaattgagtgcacaacagttctttattatcattctgtctaatcataagccaagggcactactctctgttcagttccaaatccagacacccgagaatcaccttaactcttcgttctctttgacccccacatctcagcttgtcccagtgacctcacggctctggatcgcccatgccgccacttctcatgtagatttctgggacagtcttctctctggctggcttcctattaggcccttttagacataattagttttttaaaggcgaatatgaataagatgctcttttatttcaaatctcctcagtggcttgccactgctcctaggatcctgctccacatctctggaagagcattcaagaccctgtgtgagtggcctctccacccgcacccacaggctggcctttcctgatgctctagcttttcattagtaattttttaaaaatcctgcaaacacctgtcttattttcctaaggagatggaactcacttccaaaacattcaacgttgcaacaaccaaattgctaacagtccaccagtttaagggctgagaatatgaactctgcttctgtttcttgacacagcctcactcgacattaaaaataaattggttccccatctagatcaacttgaaacatgaattaaaaacgagtatactaggctgggcacggtggctcacacttgtaatcccagcactttgggaggccgtggtgggtgaatcactttaggccaggagttggagacgggcatggccaatatggtgaaaccttgtctctactaaaaatacaaaaaaaattagctggcatggtggcaggtgcccactcgggaggctgaggcaggagaatcgctggaacccgggaggaggaggttgcagtgagtgaagattgccccattgcactccagcctgatcaacagactgagactctgtctcaaaaaaaaaaaaaaaaaaagaaaagaaaagaaaaaaacggtgtgccagttgaaactactcacattttaaaaggatgtcacacaaatttcagccacattgtagagttttcttatttccatttaccttgcatgataagctccaccaacaaaaagcaacagaatttactatggcatgtatatattaaattgtatttttttttcagaaatgcaatttctttctgagattactttaatcaaaagaataattgcattattcatgagccatgctccgttaattggaagtgttggtcaattattacatgagatcgcatcacctttcaataaagagaaaagagttctcttgtgctggtctttcaaccacaattaccccctctcagtccagtgacttataacacagcagcaaagttaatcatttaaaactagaaatcatctttgaaaagtcaaccagtggaaacatgtttctaacaacaataacagcgggagagtgtactttagaggaattcataagtgcctctgcaacaggatctggataaaggtcatatttttaattactatgggtacaaattttacaaatcacatgctgtctttaccggtacaaaaaatttatcagaggtggagcttggggacatgcgaaataatagggctttgagtagttcctccaactttacaaatatttcatccttaagaagcagacatttaaaaaaattcactgaggaagggaatgcgatattctatgatactcacagcatactgtttagggatcaaatagaagaagtaaatattcaacagcaaggagctgttattacaatgggcttgatttttaaccccttatgttgtccaggtcctgcacattaaaagttctatgtgtgacaattcattgttttattcattaattctgtctgtctagaagattctgaacctgcttcagagggcatagaataagaaactgaggacgagaggaggcccagtgctgagtccctggaactcatgttgtgctgagcacagcgactaccatttagtacatgtttaactgccccataactgctggtctctccattgtccttgactgtgactgcctgacaaatctatgttctgtgcttcagctatgctgagcaccacattctcagttaggtatagaagatgtggtttatatagcacttcttacagtgcctctaagtcagtgacacttagtattccagggcattgagatgtaaatgtatcctgggcacatagagcatatacgctgtgtcacaattgttcaaaattaattatatataattcttttcttaatataggagtccagtggctacctctttgaggactcatttgagccttgcacagtgtagatgacactaaaaatgcatgatatgttgaatttcacacacatgtttaagcaggcctggtgatggtacagtggttgagactgtcctatttgtctatgttggcatgagattgaagcacagagctttctggaaggctagttcactgctgaggatacagagcagtgctaagtgtggggcagataaggccaggggctatgggctgggcataaggatggacagggcgggactctcactgggaaggggctatgggaaggtgcttggtgtcactcgagggactgggaggaaggctgacacaaaagcaggtgggcaacggccctggaggacatggtctccaggtcgggttttggagtcagacaggcctgaggtcagatctcggcttgtcgtcactggctgtgtgatcttggcaagttatgaatggtctttctaagcccctgggtatctgcagaaggaggcggtgactcaggactgcttactatccacacttattcaggttctacatgtggataatgagatgcttgatactgagtctggacagagatgtgttatctaaatcccattcattaccgagttcatacagtcagagttcaggtagggaggggtactggttataataactcttcttagagttgctgcaacaattaaatgagatgatgtatccgaatggcagcagctgggacttactaaggtctcaaaaagcattgtgactgctgttgctactactactactactacaactattactataatgattagaactattagtctgctatacaactatcacagataatattacttaattagaagggtagcggatggaggccatggctctgcttgaatgaagtggtttgaccttgattcacgtagtacgcattgctgagctgaagcaggagaatcacagaattatagcagtgctctgaaagcctggtatggctgcaggactcagatgagccagatggtcaaagtggaagagttggtaaatcaaggttattgcaataactcagttagtactaataagggccagggatgaatacggtagttacgaaacttgaaaggacaggcacaattctaaaaaccattcaaaggaaaaaacagggatggaataaaaactaaaaggtcatttctgtgaagatcaaagacacacagctgaagattcacaaggaaaaaatggtgagctggcaagagagatgatgagcatggcccattccttagaaaggagtctgattgtgaacaaaagaaaaaaccagacgtgaacagcggcagtggcctcacctctctgagctgccttcccatgtcctgggccgctctttcccctttgctgtctggtcctcctctcacaagtctggactctgttgctgcaggctcaggtttagaccctgcctttgctctgcgcacatgtccttcccgatctcatccattcttcttgcctttaaagaccacctatttgatgatgatggcacgtcctgactcagtttgaacatcccattggatgctgaatctcaaactattgatttttacccaaaacctgctcctcccactgccctccctatctcagtaagtggacacccagtcttccgtgactcaggccgagtcccacggtgccatctttcactctgctgcctgtctcatgccagtatctaacccacatacctctcgtatgtgcagagactggtggcttctcactgacctcagcacgcccactgctggtggaaacctccatcatctctgatctgggttagcacaagagacttctgtgtcatcatcttcactccagctacagaattctcccagcatggtagcccctaaagtaaggtctgactttctgcttagaactcttcaatcctttctcatcttatcctaaagaaaagtggagaccctcacggagtctgacagggccctctgaacacagggccctgctacttctctgcacccaccttgctcttctccacactcactgggccctggcaggttacatccactgctgtctactcaaccacacaggagccatctcagggcctgtgtgtctgcagctccatctgcctggaactcccctcccagatatctgtgtggctgcccatcccagttcctttggatctatcttcagatatcatgtaccacagaggccttccctgaccacctcctagaccgcaggaactcccttccccaccactacctgccccagcctctgtcacctgcttccattttttttttttctgtagcaagtgctgtctcatttctgtatatttgcttattaatttcttgtccattttcactaccaaagtacaggttctgtgaaggcagaggtgttgtactgtatacagccacatcatcaacatctagaacagtgcctgaaagatacgtattgaataaatgtgtggtacaagtacgctgggcacagtggctcccacgtgtaatcacagcactttgggaggccgacgtgggaggatcacctgaggtcaggagtttaagaccagcctggccaatatggtgaaaccccgtctctactaaaaatacaaaaattagccgggtgtggtggtgggcacctggaatcccagctactcgggaggctgaggcaggtgggtcatttgaactcaggaggcagaggttgcagtgagccaagattgcaccactgcactccagcctgggcaacagagcgagactctgtctcaaacaaacaaacaaaaaaaccatgtagtacaagtaaatacttaaaaaaaataagtatcccattctgtatggaaagatgaggaatgagctgcacagagggaaagttcgtaacgtgaatgttggctcaaaaaaaattcttcagtaagccatcaggggtggaataaaaagctttaaaaagtgcacgtagagggggttctaagaggaatgtgctattttgcgatgagatttagcctgactgcactctgcctgtgctgacctggatgcagacagtcgctgcctccaccgaggagggcgtgcatctcttcacccactcggctgaacttcagcagcttccacagtgacaggaacggatgggagaatggactttgttgtttcgagggatggtggtggtggtggtatttttatttgctcatttatcttggaagtatcgagtggtagacagtggcacatggcagtggcaggtgcagcagcctccagggagttaaatcctagccctgccactggacttctgactttggctaagggttgcctggtgaatggcagacagtggcacgtggcagtggcaagtgcagcagcttctggggagtgaaatcctagctctgccaccagacctccaactttagcaaagtctctgaccactttgtgtctttgtttccttctctgtaatatgagaatatgaatgtgggttcctaacctgtatctgaaacccaaggtttcagagcttttcagattttaggaaggtaatacagagtacaggctgtattttatggagcacccacagcagggtctaatcgaacacatgaggatatctgtggtgaaatacatgaacattcatacctagtgggataaatcgaggatattgatatggtttggatgtgtccccacccaaatttcatcttgaattgtagctcccataatccccacatgtcgtggaagaaatccggtaggaggtaagtgaatcataggggtgggtttttcccgtgctgttgtcatgataatgaataagtctcacaagagctgatggttttataaaggggagttcccctgaacatgctctctctcttgcctgccgccatggaagatgtgactttgctcctcctttgccttctgccaggaatgtgaggcttcccagtcacgtggaactgtgagtccattatgcctctttttctttataaattacccaatctcaggtatgtctttattagcagcatgagaatagactaatacatgtggcggtggcaagtgcagcagcctctggggagtgaaatcctagctctgacaccggaccttcgactttggcgaagtctctgaccactctgtgtctttgtttccttccctgtaatatgagaatatgaatgtgggttcctaactcgtatctgaaatctgaggttccagaacttttcagattttaggaaggtaatacagagtacaggccatattttatgtagacccacagcagggtctaatcgaacacatggatacaactgtggtgaaatatatgaatattcatacttagtgggataaatcaaggatataaacagcctcactgcagttcatgccaggatttgccaccaagagtgcatgtcaggcaagttttgtctccagatgagtcagaaatattagactttatctgtcaggttaatgtatttaacaacttggactttttattaaactgcaaaggatttcactttatgtatgattttaataacaatatttggcctaagttaaactctttccttctccctccattcttcccttgcctccttctttcctatgattctctaagctcccaacagccggccctgtggtgagagggtggctggtggaccacgaggagcagccgccgggagagaggctgggatgctgcacatgggggagtggcttgggttggctttggctccgcccctagctggccccagaatcaacagaaccctgaggtcaaaacagtgctcccgggagctccgctaatgcagcttctctctggggcccgcttccacactgatcttgcccctaaacccctttgatttatcaattctggccccatttctggtaagtcactccctgggaggcaagcttctccaatgcatggaagtcaggagcttatggaggagaagtgacctgggtcccttacatgccaggttatgtaaagcaaccccaaatatccagctgtgaggagtccgccagaaatgccaacagacgagcacttttcagggaaaaatagagacacagctccctctcacggtttaaatgtattgggtagagatgagcacagcaaaagaaatagagggtcttcctgttacgggaaaggggtgtacaaatggcacttaagtcaaggatgttcaatttgttctcactgtcaacatagggtaaagtggttctgttcagctttctaaatggccaggctattggctgagtacagcctatctgttcgagtaactgtcactttatttatagttacggcaacttcttagaaccggtatcctttaaaatacagcctaatactagagccagatgggaaaaaatcctagggtaaaatattaaattgtgactagtcatttaatagaacaaagttattcatgacagcttatatatgtcaaagcctatatgctggcttgtctataaactggcagatggatttttttccaaatactgagaagaatttcagtctggattttaaaacgagtaagttatttcaaaacaaaactgaccaataaaagaactgataaaaatttgtttaagcttattttattaaaaacaacaactgactttttctttttttttttttgagacagagtcttgctctgtcacccaggctggagtgtagtggtgcgatctcagctcactacaaactccagctcccaggttcaagcgattcttctgcctcagcctcccgagtagctgggattacaggtgtgcaccagcacacctggctaattttgtaattgtagtagagatggggtttcaccatattggccaggctggtctcgaactcctgacctcgtgatccacccatcttggcctcccaaagtgttgggattacaggcgtaagccaccacgcctggcccaacaactgactttaaaactcaaaaggctttatttaaattatactagtaaaaaaaccaatgaacattcttatttatcttctaaaccatgggaatatttaaataattttatattttattatttaatatagatttagtattatgttcctaaatctgggatatggctatttttttctgttgaaaaaccaaaaaaggccaactctatatgtggccagtatacaggtaactgaggctgacatagaagagagttacatgtatccaccaaacaaactcaacctatgaagatcttaaacattttttttctgttgattttcttgagttttcatgactattgcataatggtagatttatactatttccatgtggatgacaggagataatgtccaacatcttctacccctacaaatcagatctgaaatttctttatgatttcttaatactatcatcgagcattcaggtaggctccatgccggaaatttagactcttctttactgcttcttccttgctcccatcttctaataggtcacccaaccttgttcattctacatcaaaatctcctttggaagttggttcactcaccctacattagtatcaaacattttaggtcaaggtggcaattctgacttccagtagtgatttttaaactcaataatgacaacaataacaaaacacgtcatcggccttttcttcatattaagtcttatatgaacgcccattgtgtgaaacgctgaactgacagcctcccctttaccctctcagcagccccaaggcatcctcaccactgatgcggaatattagggccctctgtcttgtcttttccaacagcctggatgtctacccactccagcccatgcccagcatggacatcagagtctgctcctgcctcctggctcaggttcctgggggcagcgtgtggagctgagaagactgcatcgcctggattccatcccagctgggcggcttactagcccatcacacctgggcagtcccgtgagcctcttctatcctgtttcttcatcactaagatcgagaataaattacaatatctattttggggcatcctcagacaaacccactacagggcagggggtccccaacctcccgagccatggaccagtacctgtccgtagcctgttaggaaccaggccgcacagccagaggtgagtgggtgagcgagaattatcacccgagctccacctcttgtcagatcagtggtggcattaccttctcataggagcatgaaccttatcgtgaactacacatgcatgggatgtaagttgtgtgctccttatgaggatctaactaatgcctgatgatctgaggtggaacagtttcatctgcaaccactccactcaccctgtttgtggaaaaattttcttccacggaaactggtccctggtgccaaaaaggttagggaccactgccataggacctttggttcttccaacactcacacatagctgcccctcaccactacttattgattttaagtaagaaaaaagccagtgagtcattgcaacaaataaaaactacatgcaaggcaaatttactacaaaatgtctgactttcccagaaattatggttgctttttaaaacatattttattaaagaaaaggaaaaaataaaaacctctgcccctcactgtcctgaatgatataagactatctgattggatactagtataagtctgatgttgctgcctggaagaaagcagtgagaggcgtcagaacactccagcacactttggaatggccagggagttttgctggcagacactcagcagaagatgccttacactccctacctcaccagtccccacagtaggcggtggaccttcatgtaatgggagactcacaccttctgtgcaagagccaggcacatgggtaactccaggctttaccccatgctgcatttatgagaagaaataagacaatgaatgagcctgttaggccagtgtctgtcttctatgattaacacagccaaggaaagtctggcccacacagaaagagcagccctgcagaaacactagtccccctgagctttgtgcttcagcttttccaaacccaactcaatccaccatatagaaaactcagcaggagttttagccgtcatcattattaccctggatctcacaccactacaggataaactccacagttcctagcatgactacaaggccctccaccctgcagcccccaccttctgctagactttcttgctggtccattgctgacaggcagctgtgctctggcctcagggactccatccctggccccttcctagagcatcccctgatgcacatctgtggatcctgcaagcttcgcatggccaggcttatccccactctttccttctccagcccacaggtcaatctcctgcgatgctttctccaccccttcacgcagagtttattttcttctctaaactaccagaatcttttgttaatatccttgttagagggtttattgggtgctctcataattacagccaactataaactcctagaggtcaagagctggttttatcattcttcgtatctctagtatcttccctagtccctgatagatgctacataatcaataactatgtgttgaccaaatagatgattaagtcagcattatgttttaaattttatttaagttcacaaaaagacaacatattatgacacaaaactgttaatagttccttaaatccaggcagtgaaattacaggtaattcttattataatatttaaacttttcttcatttcctaaatttcataacacagcaataatcatagaaaataaaagagtgagaaaaacctgggagggtttatttatttaacatttcagataatcaaacaatgttaagtactaatattagtgttggcctctcctgctaaatattatgggaacttaccattgcttacatgaatgtatggattagtgcaataaaaattacattggaattctctagatcttgatgtatgttttcttaatttattctgacctaattcattagcttaagtggttcatacatttcacagctataagtcttgttcgctcatctgggaataaatctggtagtatatgctgacacttactaaaatgtaacaatatgattctatttttctgttagagacctttagcccagaaaaaactcccattaaaaaaaaaaagaagaaacaggtttttcatataaagaaaaaaaaaaaaaggcttcagtacaattggcatcttgaatgtcatggccaaaaactagagttccatgaaactgggtacagatctcattatgagcataaaaacaacacacgctcttaaatacaatgcaaaatttcctgctgattaaaaatacaaacaacaatgaacaaagcataatatgagtacaggaaaaacccatctatggattctatgctttagttatgtaacattttcacattagggcaggttctaatgttgatcaccatcatgaccagaaagagttgcaccaacatgaacaagaggtccctaagatattaagctccattaattcttctctgtgtaggcagttagggtcggacaagtacaggagggatggacttattataatgaggcctgggatggtttcttttataatagtctatattgtgcagaaaaaaatacattatacttacaaatatttggcacatagtagatggataatcaatattaactaattaacaatcctatggcgcaggaagatttttcataagcatgttgtggtgacagtgacttctcacatgaggccagctgtctatctcacccacatcctgtgacctgcttctaccccactggttctaccccactgaccttcttctaccccactgtgactaaggcactcctctccacatgctatatggtctgcatgtttgtgaccctccaaaattcatgttaaaacctaatttccattatggggatgttaagaagtgggcctttgggagatgattaggccacgagggtggagtgtggagccctcatcaatgggattagtgcccttatagaagaggcctgagagagctcatctgccactttcactatgggaagtcacagcaaaaagacacaatcctttacaaacaaggaagtgggccctcatcctacaccaaatctgccagcgtcttgatcttggacttcccagcaccttcccagcacccagaactgtgagaaatagatgttgttgtttgtaagatactgagtttattaagttttattatagcagcctgaagggaccaagacaccatcttcacagtgaccgcctccagctactttaatcatgggacagcttcctcctccccatccaatttgcacacaggggtcagccccagtcagtgcctcccctgcagccacagcaatgtttggctgggcttggaacaccacctgctaaaaaatgaccatcccttgggtttcactgtgaaatcttattaatgtcagcattgtatgtttccgatgttccaatgtaatggaagcaaaattcactaaggattgttcttcaagggtcagcatgcccaatatgtaacctgtcttaccacacagagagacaggttcatttacgtctctttaaaaatggttcttctgcttcaaccactagggattctcaactcccagaagaaagtgaaggactgatcatgcttttatctgctgcagtgttggtaacaacagctgactgtgggatgatcactgtttctacatgtggtgtgaggagcctccatctattaactcatatcatctggatgcagtgatgtcattagtcccgtttcaccatccaggtaactgaagtcacagagctggaaagcagcagcagtgggggtcacgtgagcccagcctgcagcgcacaggctctcagcccccagcatgctgcccctttgcagaacgggccctgagaaatgggaagcttttggttttcaagagtctctggatctcagtctggcatccagtgacataggaatgtgtgttagagatgactgaagatctgagagacataagcgatgtggcagaagtatttcacaattttgacctcataacttcttttctgttttgaagccctgggtgttggcaggtatagaacaatagagtggcttcaaagaagtgactctccgggtactatcctctgtgcgcttcccagagcccagctgtgttcaagccaggactttaggagaggaggtaggagataatgaagggacgtgattagctttgtgggacagccacaaactgggtggctagaaacaacagaaacgcatcctctcgcagttctggagcgggtgttggtggagctgcttccttctggaggctctgagggcaaatctgttccaccttctcttgtggtttcgggtggctgccaacaacccttggcattccttggtgtgtggactcatcattccgatctctgcctctgtatgcatgtgagtctcctctctgtgtctttgtgtcccttctcttcttataaaatacaccagtcaagctgggcgcagtggctcacgcctgtaatcccagcactttgggaggccgaggcgggtggatcatgaggtcaggagatcgagaccatcctggctaacatagtgaaaccccgtctctactaaaaaatacaaaaaattagccgggcgtggtggcgggtgcctgttgtcccagctactcgggaggctgaggcaggagaatggcatgaacccgggaggcagagcttgcagtgagctgaaataatgccactgcactccagcctagcaacagagcgagactctgtctcaaaaacaaacaaacaaacaaacaaaacccaccagtcacattgaattttgacccaccaaatccagtatgaccttatcttaccctgattacacctgcacagactctatttccaaataaaggcacattcatgggtgttggggattagcacttcaacattatctttttgggggacataattcgacccataacaggaaatgaagtgttttttcgtgtgttttcttcatgtttgtttttttccctcaagcactaaaaaataatgcaatttggctcctgacaacatgaatctaaaatctaattctgtgagcaggactctctgagcccgggcgcagatgggatacctgcatggggaggggcttgtgtcttgctctcagaaacataataaaccaagagattctgctgcattttcaacacatctctaagaataggcagcagtgcacctccttcttagtgttggcagtgaggctgacgtgacagtctgaatggtacatgcgtcccaggaacctcatgtcatggtaacagaggctacagcacctcacactgaaataagacgggctcagaccccccactgcaaccggctgcattgtcaccttctggggtacacatccgcggcatggagcttctttattctgttatcatccaggctatgagtcggagtattcaacattttaatgctccatatatcaataaattaagtgtgatgctggatggatgtgacattttcaatattccacagtatgactgacgggctaccgtagttcctcccctgtttgtaatttgagtaatctggatgggggacatgaactggccggccaataaaagtgaagactagtggaaagagcaaagtcataaagcaagcatggtccttcagagactgtattaaaagattatcgttttgtatatcattgttttttctttccagagcatgtaatcataaactgaaaagagaagagacaaaatgtaatgttgaccagaataaacaacgctgtgttcatcacttaatgttattacccagtcccttggttgtcttgtcctctgtttgttatcattttcgagggttttattctagacacattttttggtctcagtcagatttagtacagactaatataaagttctgctgctccacagtggtagccgacgcttctggaaactgcagtgaaatctcatgaactcgatagagttcactcttgcttggagcggtccacacacttcctttgtttaagcagcaatgatatgtcatgccaagctgagttcaactttcttggtaactcttgaagacaaatcaaccacactaataaattattcgacctgcaggttatatgagtaacaatggaccaccctaaactctaggcagcacagtctgatttccaacaaaagacaggagatgcagataacgtgtagatactaaatgtataaattgtattgtaattctgataggaaaataaaaccccaaaccctgaacaccattaattcaccatatgtcaacttaaaaaaatgtgaatgctagataataaaactttatgcccatgtaaatgtctaaacacaattttaataactataaataatgtagagatttatttcttattcattttaacaagcttttcactgaactatgatatggtattctaatattaatcttaaagatatcccagcatattctcaacttaaaatttaaaatatggctgggtgcagtggctcatgtctgtaatcccaacactttggcaggccaaagccagtggatcacctgaggtcaggagttcgagaccagcctggacaacatggtgaaaacccgtctctatgaaaaatacaaaaattagctgggtgtggtggcagatgtctgtaatcccagctatttgggaaggtgagacaggagaatcacttgaacccgggaggtggaggttgcagtaagccgagatcacaccactgcactccagcctgggtgacagagcaagactccattacacaaaacaaaacaaaacaaaaatttaaaatacgatgaaataaggcctttcctgtactaaactatgagcaatttatttcacaagaactcttgagtctctgacctattctagaatcatccaaaattgaaattattataaagtgttttctatgaatttcctacccaccaggcatcaaatgacagtatcaatggaacatgcacaaccgaaaaggatctcggccagcactgatgagatccttcataactataaagcaacaggactgatgaaccacacagtgaatccagccacataacttcataatcacccgtgcagaacacacttctggaatgctgtccactcggcccggcactcccctgaggactagggatagagagtgaatcgtagggagatggtctccaccctcacacacactcatccaagaaggcaagacagagcccaccatgcacaccgcaggagacaaacatggaaacccaagtcccatggggataagtgtgcggggtgggggctgggaatgcctggagaaggaggcaagtcctcagagaagaccactgatgataaagttgcttttcagcagagacctaaatgaagtcaggtgtgagccttctggaaactgggaaagggttccaggcagaaggaacaagggagcaagaccctgacgggaagcagattgaggtttgagagaaaggcttgaaaggatggcagtgactcagcaggggccagggcacattggccaggcacccattttaactactttggcttattccaagggagctgagaagccattggagtctgagcagagttgggacgttatttgacttcaattttaaaatgactgctctggcatctgtttggagaccaggctggaaggagaagcagcagagaagtggggaggtggaagatcagctgggggctgttgcagtaatccaggaaacagcccatggtggcttgggccacggtccaagccatggtcagattgtggaaggtgttttgaaggaattgtctgcaggatttgctgatgggtaggtagcatgtgtggtgtgagagcaagagaggagtcaagataacttggagatgatgcttgtgtccatttatggaggtgatgatgactgaagcaaaagaaggatcacacattcatatttggcattatgaagcaggagacaccattaggaactatggggaagtcagggtggcagctagaggtttaattttggggatcaagggtaaagttggagctaaagctatacattttggaattatcagcatatggtgagtatttaagtcaatgatgcaaggataagactacctacggagggaatacagactgggaaaaaagaaacaaagggggagaaggggtctaagactaagccccagggaatcacaacgtttagactgagttctgggctgggagttaaagaagaaccacaagatcatataatatcatgaagtatcctaagtatgaactgaaggcttatcagctgtcaacatagtagactggctgtcaaaggatggctttgctgtataattgttttatttttaatctagtatctcaaataaataaatttaaataaattgctctgtaaattttaaattaccacactcatctgcattatcattactgctcctatagtctctattaggttaaccacagttggtggctgttcaaggatttactccaataatgattatgtttcctttattttaaaatgcacatttttcccacattttaacatccctgaaatcacaatgtatcatacaattgacagcatcttagaactataattttttaaaaatttaaattttagattcaggaggtacacgtgcttgtttgtttcatggatattacatgcgtaattgtgggggttgggcttctaatgtacccatcaccctaacactgacatttatgatcagaactgatgctattttttccttcttagaggaatacacaaaaaagatacatcatataatctgtgacatctcagctctgatcaaataaaatatgtatttctaaagtcacagctctgttctattgtctttggttgatgtacaagtagaagagttggtctctgcacagctgccctctggggctagtgtctactgggatgatgaagagtcaagggtaggaaggaggcagcgccaaggagccccttgtgggcaagcctcttgacagtcaccgtattttgcccagggcttgctattgattagctctgggtgtcatacacctccagtgacttttgccttagcaagaagacagatacagttggaaacttacacaagggcttgctctggtttcattctccaggcattcttttcccctggagtcatacatccctgaagaatagaagccgtgtctctattaccttttaatccccagaactgagcacaatgcataaatatagctggtgctcaataaccattttatttaaattgaaacccaactccccagtatttggaaagacttgtggcctacaacctcagaggaaatgtacaacagattccctccctgggctgcggtagttgaagatcaccgactaactacggtcacataaggtatcatgtctgagtgcccagtactagatcctggtgtagtctccatggaaacatagagaggagcgcttgtatccttgcagagaaacaacaaatgcatcctttataatgataataaaatgcagcatttatagagaggataatcacctgtgttatgaaacaggcaatttaataactctgtctgataaaaacgcaaagacaactgtgatgctgtattttacttctgggggtgtcggcatctgagttcacgggcagtggtgtgagcagcaagaatgaatcttcttcatctccttgtcaacctgttatatgctctcttgctgcttactatgccgttttgtctttttctcctcattatattccccagctcatacatcctaacctactattccacttatttcttcctttacatcatgacctgtagtctatattcctcacaagaaggtcctcaaggaattacaaaggacttttagaaataaagacataaaatattttttacagttcctgcggaaggctttttgtgaagattgtgctttacatgtattaaaaacacctctgagagtagccataaaagtaaatttgaaaatgcatttgaaatgtaaatagtgtttgcagcactcaggtgaggctgcttcaggtcacatgtagcaagagctctgcttaagtcttgagttatcttttccttccagtttcctgaattatgtgacctctgagaggcactctgagtcctaaatgggtagtactcggcagtgactacgattcctaaacaattcctgtcctctctttcactccaggatcttccaagcctgcagcccctggctgcactctggtgccactagaaactgtgggccatgaaggagagatgctggcctgggttcgtacttggccacccaagagaagtaggatgtagtgctatctaacaatgtctctccaacaaggagttcttgagtctcttttaatcagggacccactacattaatttgcataatctgatctggagttcaatagatcaatgattcaaggtaaagaaagctcctgcagcagttcctagcccagccatttcctagccagctaaaatgccttggagctcaggtcagcaaactggctctgatctaagaatggtttttactttttcaaatggttgggaaaaaatttcaaagaatactatttcatgatgacagaaaataatataaaattcaaatgtcagtgtctgtaagtaaagtctgattggaactcagcagcctcactcattcgttcatggactgtctagggctccttttgtgctgcgacagcgtggttgagtagctgggacagagaccctatggcctgcaaaatccaaaatacataatattatctggctctctgcaggaaaagcctgcagacccttgccttagattggcaggcctagtcaaaggctggcctgttttggggactttccagcaatctggtttcatgtagggtgctgctgtgagacatgctgattgaattctgaaggacagggtgagacacaagcagggaataacattctgagaaaaaaagttggctctgtcagactacagggatgagaaaaaaacagctccttggtggtgtaattagtagtttaagtagctttgtctgcaatgatgctagagtaatctgcggtctttcatcatgttcaaggagaatgcacaaaaccactcagctcactataattgcaaatagcccttaatgaatatatatttgctttggctcctctgctctattttacatcaattcttgtgattttccaagtcataaaatgccccagatgcctttcactaaggcattttcacctggataaaaagatgtaaacagattagaccatttctaggtgagttatccaggaaacaggggtgatacaagtggattatctattttccgatctggaaaagtaggagtgatatagaagagaatcaatagttctctacaatgaaatcttagccttggagaagtgtttggtgaggggggtgaagatgggggaagtggcattgcgagagatgcagttactcactgatgccttgcatggtatcacatgatgtcacatgacactgtatgatatcacaaatagaaatgcggactctgatgagctagaactgagtgtcggcttctccgttgccatgcagcccaaggtaaaccactgactgctgcaagccttggtttccttgtctgtgaagtggtagcacgaagccagcactgctgtgacctcccaatgaggtagacggagcaagggtgccttctatgctggcagctggtgctcacctcggcagcacacacactgcactggtggatgggaacttctatgactgacgccaaatagcacactgaaatttgaacacagtgtttatgatcctgaggttgaaattttaaaaaatttctcaatggcaagcatcaacctcaggacactaagtggagaaagtgagatgttattaccaaatctcaagcttgactaacattaaggtgcttgacttgaatcagtgtttctaaaagaaaatgaaaacttctccttcactgtgactcacaaataaccagtaaacaagaataatatgttatagaggtgaaaccagctactcatggactcaaattttcagttgtactgaagtgaactgggcaaaaaatcttttaagaactgcctccaggagtgttggctattttgtaaatagtcaaggatgatggttttcagactgtctagataaccttaacctcaccatgaaatgcaaattatttgctttaaatggcaaaaagtagaaaagctctattttgaatggtattttgtttttaaaatactcttactctttaaagtaagagtcaagaaataaaagacatttatttgggcttagaacacaatttatctgagattttatggtaataacaatactgaatcacttttttttttttttttttttttttttttttttggtgaaccacaggcccataagatcctggctctaattctggctttaccattcctagctgtatgagaattggaaaattccttaatttctctgaggctcttcattttcttctatacaatggggacaagtgtaataatggtattaacaaagtggatgtaaacatgaaataagataataagtgtaaagctcttaccacaaattaagagcataaaaagttatcagaaatggtcatgtatccttggttataaatacaggtcatatatcaattctggcatttatttaagcaaaaaacctttaaattccactcttattttggtgcctgatttttttttttttttttttttgagacagagtcttgctctctcacccagactggagtgcagcagcacaatctcagctcactgcacctcccgggttcaagcaattctcctgcctcaacctcccgagtagctggggttacaggtgtgcaccaccatgcctggctaatttttttgtatttttaatagagatggggtttcaccacattgcccaggctagtcttgaactcctgagctcaggcaatccacgcaccttggcctcccaaagtgcggagattacaggcatgagccgctgtgcccagcctaggtgcctgattttatttttaaaaattaattttcaggcatggcaacaaataaagaaaaaacacacccatttcacgatgcttattggtgacccccaggagaagtgaattgagctatttgagggaaggacagacacacacacgcacatgcatgtgtgtgcaggtgcacatgtctctaaacatagtataaatagattatgccaaccagcacagctccagatgagagtgtctgatgccacagcggcacatcatgagcagtcacccttcactcaacttctagcttgaatagaggacagagatttcaggagcatcgccaagtgatgggtttgggcctggcagatgtgattctgagtagctactgcagcttcggtgcctataggactaatactgcagagatacagtgttttatctttcaaagccagtacattccagggaggctgtatcctggggctgctaaagacgcctgcaagactggcctggaagaaatcctgggagggtctgcttcaggccactgagctaggctggaaacacctgggacagcgcgcctctgacccctgagccacactcgggaggaaccccacactctggcaacaaggactgggaatgtcctagttaggcctccctccctccaccacagcctcggaaggtacttcccgcttgggctctttcttggcaagctggagtttcaagtctttttttttttttttttttttttaaacaccaacctagacatctctagacagtacaaaagtactggaaaatggggaagcaagttttaataataggtacctttggtttataatagaaccaccccccccccttttttttttttaagaaacaggatttaaagaaaaaatgttttcagttcagagccagctttttttttttttttttttttttttttttttgagatggagtctcactctgtcacccaggctggagtgcagtggcacgatctcagctcactgcaagctccgcctcctgggttaacaccattctcctgcctcagcccccccaggagctgggactacaggcgcctgccaccagcctggctaccttttttttatttttagtagagacggggtttcaccgtgttagccaggatggtctcgatctcctgacctcatgatctgcccgcctcagcgtcccaaagtgctgggattacaggcatgagccaccgtgccctggccagagccagccatttttaagtgggacaattccagtacaattggccttgttgctgggcaaagacactaggattcattgtgctattctaaataaacttttcgatcaagagatggaaatgcacaacacatcataaaggatgtgaaggaacatttccccctttctccttaattagagcacttggtatttgtgatgaattaggctgactcggtaacctacaggacataaatctgcagaacaattctattttccaattgctagctaggttaacacgccttaataaacaaataaatatctccatatggactattatccaaagcaattgtgaatccttgcagtacggggcagcgtgtggtggtgacatcctgtgaatggccgagttctgaggccgtcctcgagcgtccatttgagtagtggcctaaatgaggggtgcccttcacggatggaataaggtaacattttgattaatgcaatgagcatgctgctgaatgttacagtcagtattaaaatggcatgtgctaatttaaaatcttagttgtcattagattagagtgcaaaggagagccaccttttgagaagacttacttcatctcagggggcagaaacaagcctgtctctgtttgccactgcaggtgtctggccaacaatgcttgggctctgaaaacatcctgaaatacatatatatatatatatatatatatatatatatatatatatatatatatatttttttttttttttcttttcctaaaacaacatggaaaggtactaagcagcttacttgtggaaatgtataaaactaaatcaaagactttaatacaactgcaaaaagtcacaaagtggaaaaagggcagaattgaaaagcaatgtgattcatgtctggtaataggtttttgagtttttaaaattttttaaattttttattttttgagacagagtcttgctctgttgcccaggctagagtgcagtggcacagtctctgctcactgtaacctctaccgcctgggctcaagtgattctcctgcctcagcctccccagtagctggaattacaggcacctgccaccacgcccagtgaatttttgtattttgagtagagacagggtttttgccatgttggccaggctgatcttgaactcctgacctcaactgacctgcccacctgtgcctcccaaagtgctgggattacaggcctaagcgactgcacccagccttgttaataggtttttaaagatgggtatgcttttgtggccaaaatgcaaaagacgtatttttgtcagcaactaaatattatttggaatttcttctcatgatctctagaaaatacttgatcaggaaaaataacttaagttatcatttttacctttttccaattgcaactctttttaaagagtccaagtaaatcttttttttttttctcctgattgtctttggaagtattgatccagaaatacttcatttcaatggttacaagtaacaataaatttaaaatagcatctgatttcctacaatgctcatttctgtatttatttgaaaatgagacttgcagggagccattatccacactgtgctttgacgccaggtggcttcgctcctggttctgatgggcagctcaagtggcgctggagcttttgctggccacacactcactggaggaccctgtgtcagacagtgcatggccgatgacacagctgtggtcaggacctgccgctgccctttggagctcacagtcccaaggggtaggcagatatgtgtggccagataatgtactaagtcacactgtgttcacctgaagttctcgttcttcatgccaaagggcatagagccctttgtacctgtgcagaggacgtctgcaatgccaagagcaaagggctcctgcagatagaccagggaccgcctcctgggttctgtgaaagccgcagttccccaagtctcctggactcctgagaggaaagagagagtcagggacgagtggctgtgaggagaagagagaggacagggtaaagacggcagataccaaaagaggaagaaaggaccagcgctctgcacgcactgggctcagctccctggaagcccccatgggaggtggccaggtgtccacagggagggctgcccaatgggccccacgaggcagctccactgggcatggcagcagtggagcaaccacttgggaacacacaggtgtggaaaagggcaacatccagagatttttcggattccatagaggcctccctgaggcttgggtgatgccggggaggaaaagagagccgggaatgctgagatggaatttgctggtcagccaagagtcagatttaatttgattttaagaaactaaagaagtatggcatttcttgcacatttaagtttgtggtttaaattttgaactcaccaaaacatgtacagaaatggttagggtgcattgtgaggactgaggaacaagactaccctgggcagaggcaggagtgagatcggagctggggaaaggcctcctgtggaggggctgcggggagcaggctcttgagggtagagtgcaagggggttgggtggagaaagatggggggcattctcaggcactgcgttcaggagaagggccctggaggtgaaacaaacagcttctcttttgtcttctgtggtttctcagcctttcattcggaaacacttggcaacatgggagggagcagagggccgctctgcaagacgcgaggcctggtgggaagccaggcgagaggagcagaacatggccacagcatgaagaaccatccctgcaccacacagtagagggtgagcagatgcctggatgcaccccaatcccccagcaaagccctgagctgctttgagcctcagttacctcggtggcccaatggagactgcactgtctcccggcaaggctgctgggcagctcacggaaaggacaactgtaagatacaggtgttttctgcctggcggtggtgagggctcctcacatttttcttttatcctaaaagcaacaaggagcagcagcagtttttagggaggagcatgcatggcacgacctacgtgccctttactcatctggcaagggcccaagctgagtgaaatctgacatcgtagtagagcaggtcctttgggcctatgaggaggcagaagggaaggaagaaggacggcttccctggtgttgactcagcaataaagctttcacctgcagagaagggtcgggatgctgacagcagcccactgattgcaactcagtctctcttgttccagtttcccagacgcgtctgggtcctgggaaaagaggactggagtgtcaaaatggggaagaatcatttcattctaatctgcactcgatcttagccaaaagtctgagaagcaatttccattctaattgtaaaacaagtggcaagagctaggcatctctgggactcctttaacagaagacgaacaaaggggaagaccattgcctctttctctcaatccctttcctctcccctcagctcagagctccaggtggctccagcagctctgacatcacctgcacccatagcgcttgacagggcagcacctgaacgcttgtaagtcagacctgacaggagcacctgtgctgcttggcagggtggtgtggggcgaactggagtgaatctgtccttgggtacatggaaaacatactctaaggactcctgaaattgaagaaggcttactgctgtgaccatggccatattgatagctgtaggcaggctgttggggtgtggtgagacgggcattataagacagggatagcagtggcacagaaggattgatgtggacaaagagccacagcaaaaacaccagcgagaagacagctgccatgatttaaatgagagaatatagggctctgaaatttaaaaactgacaaaggtgacacaaattcttcacttaaatttcatatccctgaattatctgcataaaacaaagggtaaaagggagaaggtggattttaatcttagcatggaaacacccacatttaaatgtaaagatgtgaatatattctaagtattttaaaaagatatattcaaaataattaaaatgtttctcattttaaagaaataagatgtcagatgaaagatgttggacagttattcttgaaagtggtctaagattgtttacaaatcatgtctgcttggagaaaacatttttcaaaaaaatttatttaaaaaaaattttcattttaaggctgttaaaaaaatttatttattattacaacttttttttgtagagatgagggtcttaccatgttgcccaggctggtctcaagcaatcctcccaccttggcctctcaaagtgctgggattacacgtgtgagttacccaccgtgcccaatctcaaaaaaatatttaataagaggaaaatccatgtattggctcctatcaatcactgcccactattcagcctttctccccaattgactaagaaatttatgtcacatgatagaagtgaagaaaaattaagtatattcacgttatatctaaagctttgtataatatctaattattccaacaccaataaaatctgttatcacctattagagggaaaaaatgtccactatttagaaaatgtatagagaaatgacctggaaataatgaccattctaaagacacatgtaaatatctatagttttaaagcatattttaaaatgagataatttaacaaataagagttacaatgataaaacaacaattatttcactaaagtctatattttaggtcatagaaagtgcttttttaaaaggaaaaaaaaaaaaacattcctgtgcagcattttacagatttcaaagcatcattaaacaactgagaagtgaatttcttttcagaacaggagaggccatgcatctcttacaccacatctccatctatttcatcagcagttgtgttaaaattcctagatgagggatcagaaagctttggaacttgaaatcagtttgtcctcaagactggtggttaacatgatatcattgactattggaaacaactgaaaaactcttttttttcctattagaacatcgaatacttctacagaatatttctattctatgttctaatgtaaaaatattcattttttaaattttttaattcttttaaggctttaaattttgacaggtttgccagtactcttgctcggcagttttttctacttcatctgttagtctgccctcctccctgtctggaatgatctgcatagaaaggattgtgcaaattctcatcggccacaaacgttctgctcacatgtaccagatgaccctagtgccttgcaagaaacttgagacccatcgcatgatttctccagaatcagatccaacaggatgcactgctcctgctgaacaactaagaaacgttattttcaaccccagcttgaaaacttgatagatagtgttttcttattagtaatgacccactggctaagcccttttcagacatctaacaggtcatgagtatgtgattatcatgctcaaatttacacatatgaggggccctagtatggtttctctctttctatatagtgcaaaaacctaacgattaaatattgatttaaaagagtgtttggagctcagccagtaattgtgcagcccggttcctaacaggtcacagccaagtacgagcctgaggctcaggggctggggacccctgatgtataccactggcgagggactctaataatgggaaagactacacatgtatgatggatatgagggcaaagggtatatggggtatctctgtaccttcctctcaactttgctgtgaacccaaaactgctgtaacaaattaaggtcttaaaatacatatattacttctcttcatcactgaggtttctgatacccccttaaattttgtactccaggccaatgcctcagcaacctcaccccggtcccaggcctgtggctcatcatatgtttccaaatcaccgatgggttttgcttctagtgacttatgtaaatataagcattattttacaatgtttttaaatttaatgacaaaaatactgcacactcataaaaagtaaaaagtagaaaacagcaaaaaaaaaaaaaaaaaagagtgggtaaattgttgactggtcatgattttgtagaaaatagtaaatttgagagcataagaagtttgagatcagctttgaagttcctgagttcaggtcattagcatttaattatcaatgccacctttcagccatggttctccatttttataagtggatgcctagagcacttggtgggatttcagcaatactttcatagctctccaggtgatgtcaatggctagggtaaatggtgtgggtggcatgatacagaacatctgactttcccctcattcttcccatatgtttacatcctacttatctacatagatcaaccaataaaccctttgcgtaaaaattacatacacactataatgctcttataaatcttcacactttgttgacacttagtaaatattaaaaaccataaatcacagaaaaaatattattaagttttgttattatgggtccaatctacccagtggcttaccatgatctacggaataaatttcatactccttagatttgaattaaacatccccagagtctgttgccaagattttccagcttctttcaaactacttcctatccatacacagggctccagtgagttaggaattatattctccgagaggaccctggaatgtctgccttcgtatctttgctagttttgttcctttgacttcaaacacacttagcccagactccctattcaaagcaaaccacagccatctccttaggaaactttctccattccccacaagggcgtgcctccatggccccacactgcacacatccctacagtaccaggaaccacgcctgaccttggagctggagttgtttgttactggctagtttcctccaggacaaagtaaactcactgaagacagagaaggtttcttatagcttcttccttgctgtgcactttatagagaatgaaaaagtgttccattgaatggaatagaatcaagaagtcatgtttgggtagtagaaatggaatggacaatcctcttttttaaagaatacaacactggccagtcacggtggctcatgcctgtaatcccagcactttgggaggccaaggcgggcagactgcctgaggtcaggagttcgagactagtctggccaacatggtgaaactctgtctctactaaaaatacaaaaaaattggccaggcttggtggcatgtgcctgtaatcccagctactcgggaggctgagacaggggaattgcttgaaccagggaggtggaggttgcagtgagccgagatcgcaccactgcattccagcctgggagacagagagagactccatctcaaaaaaaaaaaaaaaaaaaaaaaaaaagaatacaacattaacaaaataagatatatctttttttttaaattaaaaaaaaatgtatgttttgagatagagtctctgtcacccaggctggagtgcagtggcaccatctcggctcactgcaacctctgcctcctgggttcaagcaatttttctgcctcagcttcctgagtagctgggactgcaggcgcgaaccaccacgcccggctaatttttgtatttttaatagagacggggtgtcaccatattggccaggctggtctcgaactgctagacctgatgatccgcctgcctcagcctctcaaagtgctgggattacaggtttgagccaccgcgccgggccaagatatatctattaaaaatatattaaacatgttttcctgtctttagagtcatatcctgttgtgtctgtcctttcaaatggaaaccttgacacagctgcagtacactctgctttaattacttacttaatttgaagaatgttaaaggtaaaattgtaataagaaattgtttcccaacatactttccttaggttccctgctacctctttagttttgtttttttcttttcattccatatctccaatccacacagaatgaattttatttccttccctcgtcagtctttcaacctcccccgcaattctcaaccctgcaattcaacactctgctcccaaaccagccttcttgtcacttccaactcatcttcttatttaagctgcattgcttttccgtgaattagactggatcttaagtgaaggagacacaaaccaactgcaaatgatgaataaataccatcagtggggacttagtgaatggctaggtcattttcacccccagtgccaggaccatcatgggaaagtcgtccttttggctgttccggaagaagtggcagcatagtgactttctcctttccctgtggatagcatgcaacaggaccaaagggagtattctgggctcccaaaacatggggaagagcctatgctctcatgtttggacattcctagcaacgggttccattaaaaagctgtcctaaactctaggcttatcaagacttttacataaaaagactattgcatttttaaaacataaatttcattcctttatgaacttcaaatttgctgctactaaaaacatgattgctcttgtttccatgggacttttcttctagtgagtctttgtggaatgcctgtgatggccaggtactagtatagcggcgcaaatacaacagcaactagtcagacacacctacactcaaggaatttacatttgtgttagtgaaacaggcaataaagaagggaatgacaagcccacctttttgctcttgttcaccactcagtgaaggtccatgggctgaggtgggctgtgggtctctttgtctggtgcaccttgttctgaagcaagggcatcccaacagacaacagctgcccttgtgtggcccaaggctcaatattgtccttgacgtggacatggaaggaaacacagaaatttcaacctctgcttccgagaaatgattgccaattcattcagaggttagtctgcagagctgactgagatcaccaagggaaactggaagcttattgccttccaactttatttctttgagtgcaaagcctatgaagataatctgttctcagtcaaagagaaatttaatatagcactccctgatttcttctatttaattcatagtctcctggcaatccctaaagtacattcactgtgtgttcaagttttgccttgttgtttgcttgcatcaaagagagaattaaattgtacacacacacacacacacacacacacacacacacacacacacacacacaaagtgaacccagatcccggttccctcaaggctggcctaaaagttattgttttcatatcaggtttaatcaacagcttctgtcatattccatatgccacctcgttctattgctaacacttttattttctaatgattaaccttaacacacacaattttgccttagcttagccattttagttatataatcattctgaaggaaaaggtcaaatttatgaatttctagactgttcagcaccctgtagggactgtcaaaaccttttaaaataaaagtgattattttccatgccaagaaatcgctgggtcattgggaacagtgggcgcatcttgcttcccatgccagcatgccctgagtgtccctggccaatgcatttctaggggtttccatgctagatgtcctctttagacataaacagttttcacgcccagcttaatcatttatccgagggttctttaaaatgtgaaagtcattctataaagaaaaatttttttttttgagacaagagttttgctgtttttgcccaggctggagtacagtggcgcgatcttggctcactgcaacctctgcctcccaggttcaagtgattctcctacctcaactgcccaagtagctgggattacatacaggtgccaccacacctggctaattttgtatttttagtagagatgggatttcaccatgttggccaggctggtctcgagctcctgacctcaagggatacacgcccgcctcggcctcccaaagtgctgggattacagacatgacacaccgcagctggccagaattttaaaatttaatttagaattaaatgattaagaaaaataaattttgcagctgaagatggaaattccatgctctaacttccccatgccaccagtgattacactgtaaggtggatcctaaaacatgaggtcattatagggagacaccactctgtgccttggtgtgagtcccccactctctctaccagactttttactgtcttgtctttgcctttccattcagtcagggctgtcctggcaatggaaggcactgctgcgcaccctccttacactctggccattgagagtttggtgtgtaaaggacagcagggatttacaatcccacagacacagagtttgaattggaactttcctctaatgtcagcaggctgagctccattatggacacatcccagagtccttacaagaggaagaatctggaagatgctggaatggcttggacttaaagagccttctaacctgactcactgttaacttcctgtgatggttaattttatacatccacttgacaaaatcatgggatgcccagatatctggctaaacattatttctggttgtgtccgtgagggtgtttctggattagcatttgagttgagaaaagcagatggcctccccagaatggatgggcagcatcccatcactaaggacccgaacagaacaaaaaggcagaggaactctgaattttccctccgcctgacctcttgagctgggacatcaatcctctcctgccctcagcactcctagttcttaggcctcagactctgactggaatgcacaccattggctctccagctcccaggccttcaaacggcatcagcagctttcgtatgactccagcttgcagatggcagattgtgggacttttcagcctccataaacgcaagaaccaatttctcataataaatttctattaatctatctatctgtgtatcgatcgattgaacaatccatccatccatccatccatccatccatccatccatccatccatccaaccatccgtccatccatccgtcctcctttcctttccatccatccatccatccatccatccatccatccacccacccctatcctattcctatctatccatctatccacctattcctcaatccatctatctttcctattggttctgtttctccagagagccttaacatactgctttagaaacctccatctcttccacatactgcagtctaccagttggatcttttgtaggcttcaaccctaacctctcacttcctgagttcagtgcctggaaaaacagcctcttgggtctaatcttttcttccgaagcaaggcccctgcaggcagctctcacccgggtttgccaggcttcatggcaggttcagttctacttttactatatctctaacccataagttctgctttccaagactttttctaaaattggggatcaagaagtgctggggctgaaagcctaacaaatatctaggaaggagaatctacttaacatggggaataggactttctgcatctctgtttttgaatagagattatctggagcctgtctaggttatctgctcatgctgaaaaaggcttctctaacacatgtattttctccacaaggcacatcatagccttcttgcacttaggaatactagacagcactatgcttggggggcattttaaacagtaagatcaccaacaaaaagcacaaaaatgtaaaaaccacggtactaaataggccatgaaaaggacatccttgttcatagcatgagagctgaaacaagaaggcagagcattgctctttcatccacagcagacagcaagagtgttgggtgagtcaaactttgttgctctgcaaatgtcgatgaagatcttaaaggcgtctggaatactgattttggggttacaaataagacttagcgagtgggcaaacagcaaagacagaaactgtgatgacactgtcatcacacactttgaatacaatgttttctgagtttgccgatttgtggactatcctgaatttgtgctcaatttttatctctctccaactgcttatgttttgcctctctctccatgtcaacagattacactctataagggaaaatggaaataaagatgcaggcgaaacttgaatatcggtgtgggttttgcatggcaaacactgacgccaaatttgcctctactctgaatgctcaagttgtgggagcgctactttaagatggaaatatgtgctctaagggaaataataaccagaataactttagttttaaaattatataccaagaggaaaaaaaatagtaaaaacccaactccttcttactaagtttttaaagaaacactcaaaaaagtaaaattaaacccccagagtataattcccattctaatgaccactgagcacgtcattgcttttggttgataaaataagcacatgttcttctctttacctcgaaaacttgaatgatttcaaagacaacaagtaggcagtaatttaaagtctttttttgtgagcttgccattctgctcttcgtggggatctttgtgatgggaaactgtaaatacagttttagaagtaaaagctttcatcttaatgactataggattagaaaaagataagaagctactataggaaaagtgggtgggctgggcacagtggcttacgcctgcaatcccagcactgggaggctgaggggggcggatcatttgaggtcgagaatttgagaccagcctggccaacatgttgaaagtgtgtctgctataaaaacaaacaaaacaaacaaacaaacgaacaaacaaaaccaacccccccacaaaaattagctggcatggtagcgcacacctgtaatcccagctacttgggaggctgaggcatgaggattgcttgaacctgagaggctgaggttgcagtgagcagagatcataccactgcactctaacctgggcaacagagtgagactctgtctcaaaaaaaaaaaaaaaaaagaaaaaagtggatggatattaccacatatttttaaataaaatttagcaatcctggtaattttgggttcttgattttaaacacaatatatttctgattataaaaatatttttctgatcataaaaatagatgtctttagaattaaaaaaacacataaacataaaaaggagataatttaaaaagcttataaaacatagaagaaaaactagccctaaatatttctgaaaaccaatataatgtcattttaaatggcacacagggcaataccaacatagatctctttgttcgaaagatagattttttctgtcttttaatttatctaaaaataaatcatggtgtatttttttccctccattctttacaggagtatgggtgttttatcttatcagatttccttcatggggaaaatgtatgtgacttagtcacccagccaggtgatggttgactacaggtggaccaaggaatgaaagttggcaagtttgggcactttttttatattcaattctcaggaaagagatacccaaaattatgtgtctctgctgaacaatacatacaattatgaccagcaataggagttgtggaggccatagctctggggttcaaaatgatcctgaaataaagtattagaaaccctctcatttctttctaatattggaaaagtcacatgtcttttaaaattaacaaccacattatcatgagcaattctaattttccccaatgtaatcatcacgaaaacatttgtgattgacaggttttctaccccagatgtaaatttttggaaatactaatatacaattacttttcataatgggtgcacagctactaaatgatgtatggccaattcccaaagtttcaaatggataaatattagtctaatgtgctcaatcaatgcagagaaatagctctaagcccttttcctgcaagggaaaatatttaccgtatatcacagatagattggccacaggcactaagcagtgatggagaagcctagaaatccttgtaaatgtccttgtacttcagtgaaggacatcctcaaaagacagaaaggaaaaagaaaagaaaactctgaatggtgttacctcaagcattctctaaaacacagcacttagaatcagacctgcatcagcacgttgctgcttgacacacgaaagcccctttgcatttaacaacaacacaacaaaggttacagagaacttttgatatccttcatttaccagattatttcttccatccatagtttacagcactgaattagagattgttaatagtaataataataagaaaaaaagattttgaccatggactatgatgtaacccatcatagtggatcaactgtatactgagtctgactagaaaaaaatcaaaacagtaaaataccaatcagatgcacttcacataatgttgtccttttaaattttgaattgtggtacaatatacataacgtaaataccctttggggtttttttttaagcaattaggcacacagtgtgcaatttataactgctatgaaataaccctacccctctttatttgggcaaaggtcactatggattttttttttaatttttaactgtagaaaaggatggaatttcccacctttccttaaataagaaattccagacaatcacatcatgtccattacatcccaatactcggttttgactaagaactggatgcacatctatctaactgtccaaatccctttttggattctcaaatagtgaatcttcttggaatcagtggttaaagttcccactttttcacctggaccgtatgggtgacagactccctgtttgctaacatgaggatgacagttacagatttcaatgcaaactaaggaagaattctcagctgagttgtgctgtgtagaaaacagaattggcagctttgtgaagtgggggctcccagtacttagaagtcccgaactgtggcttgacactcactgcgggatcagaatctcctggtgggcattcactaaactcagatgcccagacctcatcattaattgtcctcggtgggacccaggcatcggcatttcttaaaaacctccccaggcaattccaatctacattgaagcctgccaatccctgtgtagtcacaggctacaggctcccaggtcaacccaggtggcctctgacatccctaccagccccaggactgtggactaggacacggttttgcctaatgactgattatatcctgccttggttaagggcaatagaattgagaagattagcactgcccccaactggctacaaaaggaatggaaaagctcaaaggaagaaccatggaggtagaatataccgggagccaagaaaattgttttcaactacctgaaatgagagaggttcctctataatgatgaacaaatgacagagaaagcagttttgatctaataatgtccagtccaggggtaaatggggttcttccgctcctaacacttttgttgctctttgcccacttcttggtgtactagtaaccaccctattgggcactcagtgtcttcccaaatccacatgtgttctcagcaaaggcctgatctcagttatttacaccagcaaagtgaatgcaagtttacctggtaacctcactcaaaagtgttgcattttgagccttaactccacaaaatgaagagtctgaaccattttgaaaggaacctaaagacaactgagaaggcaaggacatctttgtagagcagaagtcttttcctgtaagtctgagatctttccatagaagcggctgctagagggaaagatgagagacagggtgaggattaatggggacaaaaccctggaagagaaagttggaaacggtacagtcaatcatgagagcacaggacatttacagagaaaagagtgaggaggtgtttttcaattccataaaatagaaaataggaagagtgagcttagatcatagcgtgatcaattttaagcaaatagacgatgagaaatacttttctgattacatagtggactgggtggcggacagaggctgaagaagtgtttaaaaacaggccatgcattctcatatctgcatagaacatccaagcattacatacgtctctcattattccaaagcattacatacatctctccttagaagagcgatgaagctataggacacaagacccagtccaggatacagcatgaaagagaagatattaaatagctagcagagagtcagatgacaatcagtagataaaaagggcttggaaatggtaagcattatagaattttggaaaaccatttttttcccatagttaagagaccccattcttcaaggccttgatcctgaataaatgtcctttcagggttgacaccctatttttatgacttaaaatatttggacgggatatttggaagtttctaaactctgctgaactaaaatctgctgaacaaataaagggaagaactctgttttgtaccatgtaatttacttaaatgccccactacagtgtaaaagtagactagaccattcacttcatgccctcaggttttcaacatgccagatgtccagttgaggaacgtatctaaatctaaggatattcctaaattcttctgcaaagtttcaaggctattggtaataacatatatttagtggtcaacttggaggctaacgttggtctttctatttctgtaacagcttgcacagtatcatgcaggcatacatgtgagtctagatgtagatctagacatatataacccaatcagtgcatttcaagtatctaattctaccctcttacaaagttttatttattgttaagattatttcagaagcaccatagataggaatatgtatgttaaatttagctaattcatgctattcacacaaatgcactactactttgtgattttattgtaaaaaatgatatttgcatgctcagtcagcctcagtactaagcatccaacttcccgatttgctgattttttgtaggtagaactgtgcatgactcagaaactaaagagaacatgtaagccctacattctttcattgaaatggtgattgcctggatcacatgcacagagccagtattcattgcacataatgtagcttccctgttctcagtgttccctggatctggcagcacctcagggtcatttaaactacacaaacttttcaaggatcctgcactttctgtctgtgtggctccgtgtgaagtagcctgttagtcccttagcagcaaagtatgagtggatcataatatagtatctgaaataaggaaactataagtgattctccacttgggatgacacctttcttgaaactcatcctctggtaatgtggaatttgaagagctgatatttgtaatctctaacttttaggagagaaggaaagacaatgatatcatggaatgcacacattataatatttgctgtgaattacgtgcttcctatgaaaagctacaaagatgaaggcatctctttctctatgtagcaactgtgctctagcaggctgttgcttcagtaagagcactctttactcacagcccctgtacaacctgggctcctacaataaaatattccaaatgtaagcttgccctctcataaagtccaacaaattcagtctctagtctcaacgttctttatctttgttgttggttaatttgctcctctgaactgatagtatgtaaaacagtattctttctctccccaggactgaatagcagaattagaatgtctccctgcctctcttctctaatcttgtaagccattggtaagttcaatatctgtttcaaacacattgtcattgaccattatccaggaaaactcaattcaccatgacctttaagttgaaaatactctttaattaaacatcaaggagggacaattactgaaaatcaatccctggcattttctaattgtggaacaattttttaaatgtcagggtccatgttcatgtaggccattttacatttttatttttcatttttattagttttccctcaattctgtatttatagattcattactcccaacaattacccttataaaaggttccaagtgtttcttttcatgtcttggattaatgggccataatttcacacctaacactttagtaaagaaacatgcttacttataaaacatacaacatgggtcaaaatccaacaaaagcttctaatatgagactaattaaattaaattgtgattagattgaaggagtgaatcaattaaataacaatggcctaaacttcaagttacacttaaagatctatatatttaaaatgtcaacaacatgcaaaaaaaatcacaccaaatacaaatatgcagacaggctacatgtagccagaaggatatagtaggataatgggccttacagatcaacaaattggagaatttacaatggagaaaataacaccaacacataaaaatactatacaagtcaagcaaaggtaaattattcatccattgaaacaaatatttattcaggataatgcctagagtctaaatttgtctaagaaaccacagtagttagaataaatcctaatttggagaaattgatcaactgattctaaagtttatgtggaagggcaaatgacttagaatatgtaaactgtttttttaaaaggacaaatctgaacaactaacactatctgcttttaagacttattagaaatgtacaattatcagaataatgtggtattggtacaaacagaatagatcaagacaaaaggatagagagttcatagatagaacctcacatatatggacaattgattttttgacagaagtacaaaggcaattctgtcaggagaaaacagtatatttaacaagtaatgctaacataatttgatattcatatgcaaataaactttgattcccactgatttgcacaaaatgaataatagatataaaggtaaaacactaaactataaaagttctagcagaaaacagaagagaaaagcatgatccataaaagaacaaactgacaaactggacttcatcaaagtgaaaagatctgctctttgaaagacactattaaaagactgaaacagcaacctttaccttgggagaaaatattttcatgtatctgataaaggacatgtaactagagtatagaaatcactctaaaaactcaataataaaagtgtaattaagtagtggcaaaagagttgaatggatgcctcacaaaagaagatacaagggtggcaaatgagcacatgaaaagaggctcaacatcgttagtcattaagagaatgcaaattaaaaccacacctattagaataaaaccaaaatttaaaacatgaagcatatcaagtgttgagaatgaggtggaggaaatggaaccctgattcactgctagtgggaaggtacaatggtacaaccactttggaaaatagaaacatacactatccaaatggcccagttattccactcctaagtatttacccaatagaaattaaaccatatgttcataaagttgtaaatagtcataacagttttatttttaatagttccaaagtggaatgacccaaacgtccaccaacaggtaaacggataacaaactgtgaaatgtctccaaaagaatgaataaaaaggaatgaactattccattgataagttacaacatggataaccttaatataatctataatctcaataccgtgtatctcaatataattaggctgagtataaaaagccagacctaataagagtacaggttgtattattctatttatataataaaaatttcaggaaatgcaaagtaatctgcattgacaacaagcacagtggttgcctatggatggggaaagacagggttgtgtcagaggaagggattacaaaggatgaggaaactcttgggggtgatagagaagttcaccgtcctgatggtgagggtggtttcaccgatgtgtacatacaacaacatgtatcagactgtacactttcaacatgtgcagttacttcaactatttccaaattacataatcctttgtttttccctcctgtccattatctacaactttgaattggttggagagctttagaagcctttgttggacactattagtggcctgcagggtctgcagtcatgggtatttctaatcttccttgacctgctttgtcttcctttggttcccacctttgttgctgttataagccctttaatcactgcactactagatgccatctagtaggacaccatgttccccatctttgaacatcttttccatcttcttttccaattgcagtgcctgtttggccctcgtttacctccccagctctccttggctatactaattcctcttaattccttcaacataccctacttcaccttgatttggggtcttcttattagaagttctctatttctggaaaactttccttctaacctctttgatcctggctaattcctacttattctttaggcctcagctgcatgttgttttcttgggaaagtccaattatttctcccaccaaagtttggcttcagtggccctgatagaagaccctgaacttcccatcagcacttctccactcaattacattgccctgtttacttaccagtattcctccagggcacagggtcacctcaattcagatctgattagggacctgatgtatatcaggtaatggggttagctgttggaggctacaacttccccatttcctggagtaaatttaaggatatgtccaactaaaaccaaaccaaacatttgtttcctgcctgtgagcacaacataagaaattcaaactaggtgaccaactgtcttattaaacttccatttgtaccaaaagcaacttcttactgagaggacattttggtcctgagaaattcttccctgtagtgttttaggataaggacatttggaatttgaaattgcagtctactgtgtcattttctcaaacctggtcttattacactctagccaaagaaatatgaaatgaagatctgatccaatttgggacccccaaaaggaattgtaatgaaggttatatttcaaattatgtaggctggttacatggtcagtatgtagcagctgactgcctggtgttttattttgtttgtctgtatagatatagcatatctaagaaagacaacttcattttatagagttagaaaaacaacccttgagatttattaggaaagtcttgtgccagtccatcattcctgtaaatatacacgttgatcactaaatggtaagaaaggtgataggaactgaaataaccaaagtaggaaaatgtcacaacaaactcttcttgatcttctgcctgtccctgtacttggctcactgtgcaggaaagagttcttccttgggttaaacaggagcatgctcagcctgaagcagagatgatatgcctttcaattttgaaacacagtttccattgtgtgtgacccattatgtgtgacctcatttgtgggtgattaaaatgtgagtgattagaatgtgatgtcctcatagttactctctcactccctttgaatttcttggaataagtaaaacaataatgtaaaatgaaagttgctgattttttatacctcagatatgaattgctgataaacattttatttagggcacaaccaattcatataaatttaaaagtaaccataagaaatggatttttcagttacatcatctgtagtttttacatttaacctattacaaaataataaatcattgaaccatattcttttcagtgtcataatcaatgccagacaatcaattaaaaatttaggcatatgtattaactagtatagatcaatgtggcttgaatacacaaaatacgtccaaattctgtccaaggtaaataattatgatgctacatggttgttgtgtatatatttcacataaatttagaaattagtatttcaagagacattacaagtcattatgttcattctacgtctcaaacatattatgggaacagaaatacctttatttataaatagcatgtatcccaaaaaaatctatgggaatttgaatggcgggcatccagaaacttcatgtggtcgccagtgggaagtatatttttgacaagccgcatacacttagggccagccacggaagtagtgccaaaccaatgatgctactgcacttttacttagcttattgtgatttattgcaacagttaattctggctttctgtttcagaatgatctagtcatctatatttataatcattttaaatgaatatgtatttcatgttttcagttattcatgatcccttaaaaaatataaatgccttactgctagacacataagaagattaggttctataatagtaaaaatgccatcggaagatgagagaagagaaattctaccaaaattaggtaaaaagataaatttttaggacttcaaaaataaatgcaaggtggaagcaacaagccaagtgttcactgatgaatgactggatctgcagcagcccatccatacaatggaatactgtccagccttgaaaagagggaaattctgacccagcctatgacacaaatggaccttaaagactatgctaagtgaaataagccagtcaccaaaggtcaaataggtatgattgtatgattccacctatataaggtccttggagtagtcaaatgcatagaggaagaaagtaggatggtgaccatgagagaatggggggagggggaggagaggggaattggtgtctaatgggtactgagtgtcagtctgggaagatggaaaatgttctagagatgggtggtggtgatggttgccaacaatgtgaatttactcagtgccactgaactgtacatttgaagtggttaaaatggtaattttaggctatgtatattttaccacaataaaacaataattagaagatataagtgtaaaatgtaaaacatgtaaaagtgttaaaagaaaacacaggagaaaaatcttcatgacctggagttaggcaaataattctgaggcctgataccaaaagcatgagccatagaaataatttgataaattgtattttattataataaaccaattttgatctgcaagaggcactattaaaagaattaaaagactaactgtaggctggaagaaaatatgtacaaatcatgtacctaccaaagaatttaaatatataaacaatgaaaacctctgaagattcaacagtaaaaaaaaaaaaaaaagaaaacaatttaaaaatggataaaaagcaggaggatagcttgaggacaggagtttgagaccagccttggcaaactagtgagacctattgctacaaaaataatttttaaaaaattagccaggcatggtagcacctgtaattctagttacatgggaggctgaggcaggaggatttcttgagcctaggagtttgaggctacagtgagccatgatcactccagccagggcaatggacagagcaagaccttgtctctaacaaacaaaaaacaaacaaaggataaaacagacattttgccaaaggagatatataaatggcaaataagcccatggaaagacaatcaacatcactagtcattagtgaaacataagttaaagtcctgaccaggtatcactacatgcccattagaatggataaaataaaggccagataacaccagggctggcaaagatgcagagcactaaagactccaaatgacaagattgtatacatagaaaatccaaaatcatacaaagcattagagtgattccctgacagccacacgattcccacctcacctctgccaggcttagctctcatgttgacttttcagggaaatctccaaccaccaccttgtttaataaacattgtaatgcctctccaatccattctctcaatcctaggtactttatctcccctctacaaccttagcatatgaaactaaagtcctatttacataatttgtatgtgtctagtcagtttctaccagctggaatgtaaaccacatgaggacacacatctctctctctctctctctctttttttttttttttttttttttttttttttttttttacagagtcttgctctgtcactcaggctagagtgcagtggcacaatctcagctcactgcaacctccaccttccaggttcaagtgaatctgctgcctcagcctcccacgaatctaggattacaggcatgcaccaccacacctggctaatttttgtgtttttagttaagacagggtttcaccatgttggccaggctggtcttgagctcctggcctcaagtgatccaccagccttggcctcccaaagtgctgggattgcaggtgttagccaccacgcccggccgaggacatgcatctttgtttagttcagggatggaaagcagagcctgtgtggcatctagaagacggaacactcccagtacatacttgctgagtgcatgaaggcagtctcaggttgtattctctccagctgttggactattttccccccatgaatcagactaaaataccccaccactggtttggtcatccgctcagctaactaacctaatttcccctcatactctgactcgtgctgccatctttcgtcagtttacctgtgttctctacttaaacctcaccttagattttatccactccctgaaaattagctttcttggtttttcttctttatctcacccgctgaatctggttactctgggattcgtttcgtgccctttttacagtcttgtcccacaggtctcatctaaatcaagggctttacaaactgtcaaatataagcagaaaatctgcacacccaggtcctccggttccccacctaggttagagctgcctcatggtcatctccctgagcctgtgcagtaccacaccaagcccaaaagtgcctcatccggtcatttctgaccagtcctctggtctgacttcccgactgtatccctttctctgtatccaaatgattcttcccatcacccagggctcaaacgttgcaatgatctatgcttcctcctccatcatacttcacatctgctcagctataaagagggttgttcagggtccctcagcagtaccacgtttctcagttacatatgtgctttagaatctacaggggacttttcaaagaatgtggatgattgggctccatcccaaatatcctgatttaattggtttggggttgagaataggcactggcgtttcttaaaggttctctgggtgatgccagcatgcaacacaggatggaattcactggtgatgactatgagctttggagtcatgcatccccttatccaaattattgtgggcatgactgtttgatatgctggagcctcagatcctcaactatatatagaggctcctcgacttacaatgggattacctcccaataagcccattgtaacttgaaaatatcataagtcaaaaatgcgtttaatacacctaacccaccgaacatcacagcttagcctagcctaccttaaatgtgctcagaacacttactctgccttgaagttgggcaaaacaatctgacatgaaacaagttttataataacgtgttgattatcttatgcaatttattgaatactgtacaaaaagtgaaaaacaaggttggattggtacttgaagtatggtttcaaccattgtgtatcacttttgcaccatcataaagtcaaataatcatatattggggactgtctgtgtagggattctaacatcagcctcaaagggttactatgtagattaatagagataaatatttgaaatttctaatgataaacggtaggtccttgatatataataattctctgtctcttcagttttcccatctgtaaaatgggaataaaagtactaagttcactggctgcattgaatgaaagtaaagttcccagtgaggcacctgtccctaactataccgtaccaagctaaagggacagatggaagacgctttaccaggttagacaaaggtttctttgtaaaccttgcttctttgtccattctcattctctgcatttctgtggttctactggtgcatacccctatgttgttgtaccttcttagcttctactccattgtcagattcacattactaatgcagagctccaaccgtgtcattattaaaactcttcaatggctcttcactgaccaccacactaatcatatgctcctcctgctgtcactggaatggaacaaatcagtccttctagccttgcttccagtagccccactctttcccctgcataccagataatgtggcccttcgctgttccacacattgcagcccactttcattcccctcctttccccccacatcctcaattctacctaacaaatctctacccatttcgattcatcctgtcctaatgcactcaacatcaactggatgctgtcatggctttcacgggatccctgggggatatcatctgaagaagccccacagaccaattcacacctctgtgccctctctcaccagcatagctttgcccatgcaagatcccacccgcttttcaggacctagctcaggagtcacctttctgaaggaaactgtcgctgactggcctcagtgggtcttgtgcccaccaaggtgctcccataacaccccgggttcacgcctctcaaaatgcatctcggacacactgtcaagctttgcttcactgtcatttgcttcttgacagcagcaagggtgccttactcatctgttctaggatgcaactggcacgcaggaaggaatcgataaacgaaagacaaggagagaaaagcagcattggaacctgtgcttgcagtattccaggtgactttttttttacagtctctctctgtcacgcaggctggagtgcggtggcgcaatctcggttgaagcaattctcctgtctcagcctcctgaggagctgggattacaggcgtgtaccaccacacacagctaatttttgtatttttagtagggatggggttttgccatgttggccaggctggtctcgaactcctggcctcaggtgatctaaccgcctcggcctcctaaagtgctgggattacaggcgtgagccaccacacccggactgactcatttattctgttcttaaacattaaagaaatattaaacagccagaaagagaaatttttaatgctgtttaacaataattaggaaaggcaagaaaactgtatttttaggaaaagcgatatcgaaaaactttatagaatttttcatggtccaaattctgatagtcacatatttctcataaagctttcaatttttcctgtctcattgtcggttttatacatgtgtttggtagatttgaagcaatgctagttcagtttaaaaaatattgacttcaacattatagctaatttccaaggggatattataccatctagttaaaaataacccttggaaatgtggttacttgtgttatttacacattttaatgttagcaataaaatggaaggttggttacatttaatgaatctgtacagttataagagaaagacagagattaattctgagtaggtcgttgctgctataatcaatagagtacatcataattgtgcgttgaggaaacgccggtatgctaaggcaaaagaacaatagtcatcaaatgagtggtcccttgggagttaatgaagaatctctttctccaataggaaagaaatgctttctaaaatttataataccatatggacacccacacatatggatggctcataaatgctctacatcaaagtgttatttttacattttcgacacaacaaacacactaaacaggtgttttaaatgtcacactttgaacagcagtaatttaatcagcataaaaaattcttagtagtatcattgaaatattagtgggatagagatgttttatttgggatatgcttcaactatatattcaaaggcagttttcgattttaacaaatttaatttttgtactctaagatcagactttccaattcagtgctctaattcctgtgcaatttgacagcagaccagtcctcatcctacacctccgtcactgcctgctgctttttttatccaggcaaggaagcttcctagggcttcaaacatacaatgaatccaaaaggactctgttggttactggctcttaacatttatagattagaaattctccttaataatgcccttctctgaaagtctaaaaatgatctaaatattcaaaaacaagaaaatgactatctcaaaactcacatttcatttttggagtatgttgccctcatttaatgatataatagttttagtgtctagaatcatacctagcatctggaattaagtgtctgattctaactatgaatatgattcttctcaataatataaaaaattataatgatagaattagtgaatactaagtttagtgagaagaccagaatatgaaattgtgcatacggcattgaaacactatgtttttagaagcttgtgaattttttaaaaaatccttaaaaatgactgtctgatggttgaacttagggaacatttattttataatgtctactctagtgtttcaataattttcttttatggaattataaaactttaatgtgaatttaaacatccaaaatattgtaaatattactactctttctctttgcattttaccactgccccaattacctttttcttttctttaaggttctgtagatttggttgatttcagaaaaaaaaaaaaaaaaaggagaaacattatagaaaattggaggattctgtgtatgggggggaggtatttctggacttagtgacattgcaacaggaacgtcattcacttaaccgttctttcaacagatacttactatattttcaaaataattaaacaagcaacagtaacagctagtatataaagagctccttctatgttctgcattttatgccctagattatctcatatatcattagagcaactttgtgaggaaaatattaattttattataaaagagaaaatcaagcctagaacgatgcagcgacgtgccccaggttgcctgtaagcagtggagctggtttctagagcccacatggctacgaataatgttgcccgatgcaacgagggaagctggaaatcccaggtgaagaaaacccagtctctgtcctcaagaaagtgaagaatctaagcaaagctttgcagcaacacttttagtgaaggaaaggttacacatctgtgctgtacagcatgacagccactagccacctatgacaactgagcacttgaaacgtgaattttaaattgtgtttaattttaattaatttctacttaactttaaagagttaaatatgactagtggataaatgattggacatcttagttttaaaggttgaggaagatataaagaggcatttataaaacactgcaggagctaatatgttttaaaaataaaatagtaatccaaatactcttgggaaaggagatctctgctacaattgcaatgtatatatgctgctttctgagaataatttaaagtttctcacttcaactgaaaatacaattttaattactttaaatgaaaataactggcattcaacttgttagatggcatatatttttatttctactctaacatgaatttatcagactcaattaattttatatgattgtgcatgagagctcttttttcagagaaaaagtagaaacatttcttgcttttctctcataacacatactttgtaaagtaccaaagtctgaacaaataattcacgtggaaattttgatattaatttaacctctaggagtacaattctaacctttgttctaagcatacaaatactacattttgaaagaagaattgtgggccaactgggtatgtatttagtttggttaatagcagatcatgagactcaataatctgaataaagagcagagactgttaaaagccaaacacttcacctgttatttccctttatttattgtatttgatttgctgtctccattaaatctcaaatcccaaataacctcagagtttccatgtattaagctttaagcattatataagaattctatatgtaaaacatctaagacaaagtttaaggatgaataaaattaccccaaaacatacaaattaccaagataccttaaatgtctttggaatatagcacaatataaataaatatttttgtagaaacgcaaatatattagaaaagttattcctcataagcaaaattatcactcttcctcaacagtcagtgcttcatggagatttcagtgagctttctgggtgaacttctaattaaatggcttccatgattaagtgtaactcagctcagaaaattggtatttgcatatatttgacaaccaaaaatgacaagcattggaataattccaattaaaaaaaaaaacctacagaaaagagagggaaaaattccccatgaagctttgtcaattgttcaattccttcatccttaaaaaaaaagaacctagataatcttatgtcatccttaaaacaatagctatatagatggtccctgacttactatggtatgcctcaggatggttcagccttatgatggtgtaatgctttcagcacgctcattcacttcccatggggttacatccacgtaaacccgtcctaagttgaaaataccatttgtgacttaatgatattttcaatttaggatgggtttactggaacatgacaccatcataagtcaaggagtatctgttgtatgttttttcttcttcttcttcttcatatcctcagttttaagctaagaacataggcatggagtgtgtgcatatctgtgtgcatgtgtatatgactgctcactgttctacaggcatttaaacatcataagaatgatttgatgatccagtcttctgttagaggtctagacatattccacttctacacttctagagaactgttctaggccatctgccaacaagccaaagctagctgctcaccaccgggctctgtccgcaggagtcacagcaagaaataagacattttcttgcttcttgaatcttgaatgtgcctgcctgcttaacttccttccttcttttctttcttccttccttccctccctccctctttccttccttccttccccctttccttcttcccttcccttccctttccttccttccttccttctctccctccctttccttcctcctccctttccttccttcctcaccccttccttccttccttccccactccctccctcccttctccctcctaccctcttttcccctttccttcctttcttccatttgattgtagacatggagaaaggatatttcttattcccgttgatctgaaagacaaactagataagaaatctaaaaacctatcttttcagacacttaaaaaaataggcacaaggagaggggtcatatcatctgatcattttcattatgtatcattgtttgggttgaaaaacatgaaaagcattccaaggacaaaagacattacaggtctggttcctgcctttgatagttttactgttagaatggaagaaagggaaatacatataacgatgagaaagcagcacgatggtaatgcaaatggaggaagcattgttactacagtaaaaatacacactgatgcatgtatacattatacatgaattaatacatatagaaaggtacatatatgcattgtatgtctatgactgtgtgtatacagaatgtgtcagaagagaagtcgtcatatgtggaaaagaggtttaactgcttcagaattcaagatttgtctaaatttgaataataataaatacatttagattggcagaaaggagaaatttagaagaacaaagttgagaggagtgatggttaatactgagtgttaatttgattggattgaaggatgcaaagtatttttcctgggtgtttctgtgagggtgttgccaaaggagattaacatttgagtcagtgagctgggagaagcagacaccctcaacctgggtgggcaccatctaatcagctgccagcacagctagaataaggcagcagcagaagatggaaagagcagactggctgagtcttccagccttcatctttctcccatgctggatgccttttgccctcaaacatcaggctcctagttcttcagcttttgactcttggacttaaaccagtggtttgccaggggctattgggccttcagccacagactgaaggttgcactatcggctttcctacttttgaggttttgggacttggcctgatcaccactggcttttttgctcctcaacttgcagaaggcctaccgtgggactttatcttgtgatcatgtgagtcaattatctttaataaactccctttcatatatacaacacctatcctattagttctgtccctctagagaaccctgactaatacatgaggtgaggtaacaactcagttagcattatggtaacagagaccagatattgaaagtgggaaatcacttgggagaatattcaaatgtgggcctcaagtaaatgaatttcacataacaagcagtaatggagtcactactgacacttaaaatggcttaaagttaggttattagcaaataggttattctaatagaaacaatggggtcaactggatgaaatgtgggcaggaagctgggttaggatgttgctatactgactctgtaacacataaggatacattccgtatcttagctcttaatactcctcaaagaacatctatgacacctttccatccagtattagaatccattttacgatacttctgaaactagtccattcagactctcaaaaaaaccttccaatacctgggagcttatgatttctctaggagtctcattccatttttcaatagcactaattctaaaatttgtttttattttgaatataaatctgttccttattaaatttacttccatatggatctaagttcttctgtaagaaacaacacagatgaactctactctctttttcacttgataggactcaaatatctaaaaacatatacgtatataaatgtcatgactatctcacagattctccccaatctccaccatatctgttctggaataaggaaaacaaaaacaaaaacaaaaacaaactgtttttgtccttgcactcagacactcaacacagaacacttctatgaccagatggtggtgggggggacttgccacatataccaagcagttctccagtggacaccaactgggtatcctataattcaactcgattctgattctacctacctggaaatagcatcagatcccacagattgagggctcagccccacaagactagagacctcaatcacaagttggggccacctgtacctcagaccgatgggctacaaaccaaggttcccacaatttcctcaatgggtaagattaatttgctggaacagttcacagaactcacagaactcatgaaaacacttatatttattggtttattctaaggcattataaaggatgctgatgaacaccagacgaagagatgaatagggtgaggtggggggatgcagcttccatgcccttgctggagctgccacccttgcagcatctctacatgttcagtaccccagaagctcatcaaatcttgttgttcaagagtttatagggagcttggtctctagtacccccttcccagaggtcaatgggtggggctgaaagttccagccctctaatcttcaaattacttggtctttctgggccaatctggaggctctctagggggtgcaccctgagtaaatgcattagcataaacataagagttatccaaggggctaattatgaataacaaaatatactactatcactccaaaatttccagaggtttttaggacctctatgacagtaactggggacaaagaccaaatatagttcctattacaccacagctcttcttcagactagactcacacatttttcaactgttccttgtacgacctcactgtccatcactctggctcatactcacttgttcacatttatgctgctctaaaaagggtgctccaggtttgtaacaccgtggtatggtttgactctgtccccacccaaatctcatcttgaattgtagctccataatccccacctgctgtaggaggaacctggcgggaggtaattgaatcatggggccgggtttttgccatgctgttctcgtgggagtgaataagtctcatgagatctgatggttctataaagggcagttcccctgcacacgctctcttgcctgtcaccatgaaagatatgtctttgctcctccttccccttctgccatgattgtgaggcctccccagccatgtggaactgtcagtccattaaacttctttttctttataaattatccagcctcaggtatgtctttattggcaacgtgagaacgacggatacacacggtgattcacagtggcttgatctgagcaaaatacactgtaattcaatattagcaatagatgacaagcaactatggccatggtgaatctcagatgctgaaaagaggggaagaaagagagccccagccctcaccataaggcttagaagggagtgctatggtttgaatgtgtcccctccaaaaatcaggtgttgccaatgcagtattattaagaaatggcttctttaagatgtgattaggccacgagggctcctcccccatgaatgggatttagatacttataaaagaggctttactccgcattaggctctcttgccttttgccatgtgaagacacagcaaggaggtgtcatcgtgcaagcagagagcagccctcaccagacaccagtgctgaagtctttatcttggacttcccggcctccagagctcagggtgataaatttctgttctttataaatgacccagtctgtggcattttgttgtagcagcacaaacagactaagacagggagtgtccatgtactccatgtaaaacactttttttaaatggccatttaagaccgtaaacacagaaaagagaaaaacaaagacaactttctcatttactttcacacttacaaaacagttctcaaatgaacacacagagattagtgaatgcattatgaaagaatgaagatggtaagacacttgttcttattcccaggacagaaccggtgagagatgtgttcgcttttgttccccaccgccaccccacaaagacacatatcagtgtttacttccttgaaattggcattttcaggattggaatatccccacaataaacttccagatgcctgcacatctttcaaatacggcatcttaaggatgccatatttgaacggtattcttaccattatccttcccgcctgcttcctaaaacactttcataaccagagataataacattcctcgtctacaaggcagctgcatgccaaagacacaagcagctgcacctccgctcagtccacattgctgggtttttataacgaaaatgtgcacattagacttttttatggttttgccttcctggaggcggagtagctctgaggtccatcattcactgatattagaaggctgcctgtggtaacacagaacccaatgtagcagataacaaaaggcaaatataatttgaatcagagaatggcaggactggaagactcaacagaaaaaatcccgttgtcttcctgactttcggtgatgatctgaattacctctgaatatctggaacgccatagcagccttttcttggtggtgggattatgcgtatttcttagttctcttatttttgtttatctgtatgttatttttactcagtgaatatgtatccctcttcaagacaaatatatgtgttcattaaaaataaaggagattaggttagtcatgatagttttatgttcatttaaagatgtgtcctcctaacagcttttatagatttagggtggctggctagttctaaataaaaactgacattgttccttcttaaacatgcggtgaaaactagaggttcaccactgttgcccaggccccagtttccatccagttgagttaggatgttgctcagttaaatctcagctgacagaggacgttacatagccagctgtggctgagaggatccagtgtttctagagctgatgcagaaccccagtcactggggggaatgacgggaagcttctcagtcctcacaagctcccctaccatccactaggaccctctgctctgctgtttgccagagcagtagctctcagggactccacaccagcaccatcagcaacatctatgaatttgttagaaactcaaattatgatactccaccctagacagactgggtgagaagcgctggggtggggccctgtgatctatatttaacaagctcttctggggaattggatctggtttagcgacacagccaccatgctgtgctgggcccatcttaccgactcctctcctgaatccccccagagctcctctaagcaccactgtgtctccagttcctggtcaaatagaatacagaggagactgggttaatttgatgctcacagcaaccttgtatctgatgctcttttcatattattgctgttggagtaatattctattgccagatgtcagtgctgataaagaattcagaaatgaggaggaactagaggcattttctgggcctctgctgtttctctttatttccaacatgccactggcatgaaatatagctggctgcattgaaagtagcagtgcttttttccccctaaatgtatagaaatctgttttccttatgcgtgggtggcaatttgctgctggtagcttcaaaaccatggctgcactatgaacaaaaaaaatgctcttaccgtctcagccctgttaacctctttctcccaaacaaacaaataaacctaaacgctatgtctaagcccatctgtcaacaggcatttactgagtacctattgtgtttaagggattttatgtgcaaggtgtctcaagagggggggaaaagaaacaaaggctatgtacttaagatattttcactgaggttgggcagacaaggcttgagaacaattatcaggaaatctattagaccaacaatggtgaaacaaaacagtgccaagtggacgctggaaggcagcggcaatgcagtgggggcagcgtgggaggtgaagtggcccccaaggtggcatggccagagcagaatgtgatgagagaccaggcggctgggaagaggccttcagcttagaaacaataagcaacagggaaccacttggagttcttgagcgagggaaagacaagatgagcctggtaaccataattagagaagcatcacactgaagtgtgggctggttatcggagggtaacacgggcatgtgttctaattgctgtgtgcagagcatgtcatgtaggctgggctggccaacacccagctgtcagaggtcttatgttctactagggacagatgtgaaacaaccatggcaagaaacacacaggatgtgttagtccatttgtggtcctgtaacaggctaactgagatggataatttataaagaacagacatttctttcttacagttctagactgggaagtccaacatcgagaggaggccatccagtgcgggccttcttgctgtaccagcccatgatggaatgcggacgggcaagaggactgagaatggcatgaatcccccttcacctcccaaaggtcccacccacctcccaacactggtgcatttccacacttgaactttgaggagcacattcaaaccatagcacaggataactttacaccataataagtgctgtgaagacactagaacaccatgagagagtcaaagggtgggggtcctgcttcaagacacatctgtgttctgacatcgcaccaagggctggtctgtctacgagactgtggggagcaggaatatgaggaggaagaagcagattgcggagatggtggggcggtagagggaaatgtcttccggtgttcctaattcgtgaatactttgattcttattcatatcttctggtcagcaaatcaatattagtatttgtatcaatcataacatctcacatttgaattatactttgtagtagccatgataactctgtgaagtagacacagaaactctttacacaagaccttctaagagaggaagggggtgcctgtgtgtcacgcccgcgaggggtgggacttggatcctgcctgagagttttggcccaggcccgcttccatcccgctgtgctcatgcaggcagctttccccttccatggtgagtggagcctgctcaggtcctcagtgtcattgtgcatgagagtgaagaggatgcccagagggaaaagcgctcagctgtgtgtgtttccagcaaaacagacgcatggcagaacgtggggagaaacacatcgaccagagctagctactacgtatcactaaaattgagccgttttataaatattttatattcatacaatgtgccttgcgatggttggaagatacatttttcaagatggtcttttttcactgcccttagttgagcctattaataattaaggtaactttcttaaatgagaaaacggatttgaaagccaggcaaagtgttgtgtactgggaagagaggtttcacacattctcaaggagcgtccatagcaatcaccaagaggcacctcaaaccctggcatccagggtgcaactgcaggaagactgagatgggcactaaacatcattcgcctaataattcccatatgactcagtttccctactgagactgatccagtgtggaggacatgggtgctacttctttatatcccacactagagagtgcatgtagaaggtaattgacaaatattctttggaggcatgaatgatggtgccttgggaaccaaggaaactagtcaatgaaaaaaataaatgagtccacccaatttcagggggctagagatgtgctgggcaaaggtgtggccttctcagggtcattctcattccctagggtgggcaccccgagagaaacagcccagtggcctcgggactatccctagcaggcacctgccagtaaggctgcacccataatagacaaaccctctgatggcctgatacctgttgtaaacaggttattagatattgtaaatatcactctttctggaaatgatgggtgcaactggcttttaaatcttcctcccgttcagtgactcaagaggtcttctatccttcaagtgtgttatcctgcagaaaaaaaatttaagaataactgctccagaacatcttctgagtctcatgattagagggccagtgaaggggctttagcggcatctcacaattatagataatctcatggagcaggctaattacattccaatcccttcactcataactaagactgttatcaataagcctgacattattgctgattacaaagactttcttatttgctcgctgtttaattactcagcttttaaatgttccttgaagaaaaactagaaaatggagataaacaaaataagaaaggggaaaaaaatcacccctcatcgcctagcgaagggtacggattgccaacattctcgagtctctccttccagagatttccctgttgtgctgacagtcttcattaatggagttttttttttttaagtatttttaagtatttctcaagagttgcaggagaaataaagaaagtaaagagagaagagaggaaggaaaaaggagaagagagggcaagcaaagtttcagaagactaccttgccaggcatctagtgtagggtgggcaaatgttttctgtgaaggaccagctaaccaacattacaggctttgtggggcttgcagtctctatagcaactacccaacaacacctttgtaccacaaaagctttcttgtctgcaacactgctttcagatatgtgactagggctatcatgtgtgattatggacatcatgatataatttaagtcatctctgtgtgcacatttaaaaatcaggaataaaatgaattgaatataatactatttagcctgtatctttcatagggtgtccctcttatataagtcttttgttctcctatcatgataagagaagctcatgtaatactgcctgatgacccttgctaatccaactcctgcgttcaagccatcctcctgccttagcctgctgagtacctgggactacagacatgcaccaccatgtatggctattttgttttttaaatattttgtagagacggtttctcgctatggtgcccaagctggtcttgaactcctggcctcaagcgatcctccagccttggcctcccaaagtgctgggattataggcataggccactgcacccagcccgctgttctaacccacttcactgagtccgtggctctgcagtctttctcgtgtaactccagttttgcctccccgtttgcactatgctccagttttccgtggttctgcttcctggtcttactaggattacagcacaacaaaccaacagagaaaaccattggattccactggaaagtcgaaaaaaataattaaggctaaagtataagaataatcacaagcctgaagtgctgccacctgataattattaaccatactaacaataataaaaaacattatcaacaattaaaaagttcaaaagagtagcagcagtcattaagagctaatcacccaccaggtatgacgtgaaggtcttcatgtgcattatctcatagcagccctaccacaggtaactactatctccctaccttatgcaggagggtaactcacagctggtacctggagaaatctgaacttatgcatcctgaattgggactcaatgctgtcaatcctcctgtgccccgacactgcagggtctgctctggaagcacatctggaggcaccgcaaactcatctgccccacatttcagagggcactgatgggcacaggtgggggggggcaggtgggcagaagaaagtcaccccctgcagagaggaggcctggcattcatctgagaaggggctctccatcctacagacaatgtgcaactgtcttcatcaataatattgaaggtttaaatgtacagtttcctaaccaggatgattaagaaaaatatctgtcatcaatgaaaatgccctttgctttcaaaatagaaaattctacaagaagttagtatattctcataggtacttttaaaactatttttttttttttaactatttttaagtcctgtatatttcttcattcatcctgcaaataaagatatcttgaccttacaaattagcaaatgttgttctcaatcagttctactccaaaagagtaaagagagattaagtgaaccttatcatttcagaagtatgcattacttcccgttcataatgcagacagactgtttttaattaaagcttttggacttaggctggattttctagaggaatatcatggaaaaactttcccaatggttggtaatcacatttgatatgaataagatgaaggtgcgacataacatccgatccatgggcagaggtccctcaagtttataaagtttgtcgtttgggaaagataaattgttattgttgttatttttaactaaacagaaaagtcaaattaaaatgtgattttgatccaactgtgtatgtataaaatgtataaaagtataaaataaagctgtcccttgaaatatgaccaactgatttgtaaaagtcaatttcattagaatatgcagaatagagagaacatttgagcatttttatttcaaaattcactttgctagtgcatttaggaccgatgtgagggtgggatacatagtttctctagcagggcagcatccctgccttgcccatggctttcctcgtgcctgcatctgctcaagggccagccctcctgactaaaaacggagatgccagatctacatagaggacactagagctttaaggctaagtagtgattatttacttcttgataaaataataaaaagtaataaaaaataaaatttaaaaaggcttctaaggccagttgtttatgcagtcccatcacaccagaaaacataaatggattttatggacgcacctgttcagggccctctttggtgggctctgggtcccccccgtgctggggctgcgtggatggcccgtcagccacgccacccaccgtgatctgctgccttcagagggctgctgcctccctgggtcatggtgtcacccctactcggtgaacagaaaaaagttcaaacacttaaaaatcactgctcccaaacacagttctgcttgggtaagtggcagattccatgtgaatctcagtttttacagattaagtggaactgtttgaccccagctttcaggtccggataaaatgagaagtttttgaaaaggggattagaaaaagaccttagaagcacttggtttggaagctaattttttccactcagactcacagggagggaatccattgaaagcaccaattactccttctttcatagtctgggaaactggcctctaaatctccgcctttactggtaagtcaggctcagcaaccctccttaggcttgagttaaacaccttaacacctgcctctgctcccaacatgcacacaaaccacaaccaaaccaaaaaactattttctgagtatatagaaaattcggggggaaaagcaggaaagcacaaatccccataatgcccccagcatacaaatatcataatatttttgtgtgcattgatttttacgtaactggattcataatgtatacattattttacaatatcattgtacttagtatatttcatattagtaaatacttatctacaagaagggttttggtagcacagagttctcctcctaacactgtattataatttagttagctcagcacctgttgttgaactctgacttgtttccactttgtcacagctataagcaacgctctacagaacaatgaacataaccctggctacatatctggtaattttcttaggataaatttctaacagtctattttctggtccaaacgtgtaaacattttcaatattttgatatatcagcaaatttctgccccacgaagttgatccaatttatactcctgtcagtattttttgtgattccatgaatccagggcaaaatggaacattgaatgcatttaaaaatattttataatgagataaaaatggtgttttattcttcttttaatttgacattaatttgtctatgcctcttatttaaggaattgtttggtcttgcatttttacaatttttctttaaaaattctctaagaagtttttctttttgaggtcattgggttttctctcctgactttaacctttaaagatttccctctacttttagctcttgaaacatctcccttagacctttaagttctcccattctcctaaaaagagtcctcatttaggagttaaacagtgcacgctggctgggcacggtggctcatgcctgtaatcccagcactttgggaggccaaggcgggtggatcacttgaggtcaagagttcgagaccagcttgacctacatagtgaaaccccatctctactaaaatacaaaaattagctgagtgtggaggtgagtgcctgtaatcccagcttcttgagaaggtgaggcaggagaatcgcttgaaccccaggaggcagagtttgcagtgagccgagattgcaccactgcactccagcctgggcaacagagcaagactccctctcaaaaaaaaaaaaaagtgcatgtctacatgattaaagtgacacacaacagatcactgtttattacaaatcctcatgtcttttaaagttcatggtaatatgtttatgttttaacccaaagtctctgttcctctcctattcccaccactacttagagcaaggatctttgcattggaaagcattggtgtgggaggggaaacctacagtttctgctggggtccccatcttgcatattttggctttctggctcctgttgttggcggctgggagaaatgacctatgcagggtccatgggcagccctagaggttgaagttcaaactcagggatgaaagaaagaaagacagacactttctttcacgactgtagacatgatcaatggcctgcacaaaaatgagtctatcactttacacccagggccactagtcaccttggaaactgaatcacacactctctgaaaaaagaaagtggagccacagatctgggcacagtcctccccatgctctgagaatccacgcaggctgcctttgccgctcccttctttctcctctcatgggtgtttcctgtggatgcttccctcaagctggttcagcagacctgttctgccctcacggcctcaacagggaagacagagaacagtagggggctcggtcttcaagacacctgtctccaccaccctctccactgcgcactcacctacagctccttccactgtgagtgcgtggaagcagctccttccattgtgagtgtgttttagaaaatgtgggaaggtagatgtttcagcaacatttctccattcagtgatgctgggggaagtagagcttcttgcctggtgagtctgcaatgtctagatttaagggtccccatctactgtccctgaaaggacgggcacatggaataagagtccttatctgccaagtcctagtaatgctactgcagaggggaacggctgaagagctaatagctccctttcatgttaaatgattcaaagtgatcgtgaatagcatattttgatacaaggatattgcaactttctaaatttgaaaggatatacatgtgctaatgcagaaaagcttatgtatggacatactacaagtgacagtcatattctgcatttgtaaaagagacctggttgaaaaatatggtaagcgttcatactttcaggaattgcttctctctcagggatggtgcctctgatgatagtgtgaattggaaagctgaaaaattatactctcagtactgctggttacatttgcaatttctgctcaaattttgatttgtccaaagcctgatacattttatctagccatctaatatcatttagtttctggatgctgaggctgtaataattttcatagcctctgtactaaaatgctacattttgtttttctttgtattttatcatgcagggtgaaaaatatgaacacatttttataattctgggaccagttatatacccggaggtctggcaattactagaattccccaccaattattagaatgataatatcaataactaaagtttaattgtgggtgatataatttggatatatgtccctaaccaaatctcatgttgaattgtaatccccaatgctggagatggggcctggtaggaggtgtttgggtcataggggtgaaaccctcatggcttggtgctgtcttcacaaatagtgagtgagttctcataagatctggttatttcaaagtgtgtggcacctccccttcgccccactgtcttgctcttgctctcccatgtgagataccacttttgcttttcctcctgccatgagtcaaagttccttgaggcctccgtaggagcctagcagacgctggcgccatgcttcctgtacaacctgcagaaccatgagccaatgaaacctctttcctttataaatgacccagcctcaggtatttctttatagtaatgcaggacggcctaacacggtggataaatgttcaaatgattaaaaattttgtttaatgcaaacatttaaataattcaacaaaccaggtctctggaattataaagacaatgggtagggtaacctcagaccagttcactagatcataaattgattgaaggcagtagactcaggacaaataaaagtaagaactacattacttggtgcctgatgaagtggggaatcatttatcttcaaagatagtaccacctaaatatttcattagattccagaagggttcatggatgatagatgcagaagtgatttgctaaaggcacaggcagggaagagcctgaatcttttaaggtacaaatttcaaagacagcacaggtattcacaaagcatcccttctagtcactggctaaccgcatggctcaccctacccatttccgcagtttgtggcagtcattattgccaacactaaaaagagcctgctgggttttggaggtacctggagccctgagccccaaagtctcaggaagatcaattaactttaatacttagcttcctcatccacaaaataaagaaaattctttgtttgcagggttgaaatgagcattaaatgagatgattttggcaaagatcccagtaccatgcctggcacatgctgtgattctcagggaccagtccctcttctcccatcctcggtcattgctcttgagtttttgatcttccatatactgtcagagcaggaggttaactacagcagctctgagttttgtcccttcaaatgaaatatgtcccacatttatttcagcacattcaatgaccattataccaggagaaggcagtgtcgtatgcagctggaaatgagggcactgacttcacttcacaaatcaaaaggcataaagttagtctgaggctctcgtcaatgtgcaccttgtaaatctgcggccctgctatgagacactcattcctgcagagagggactgaaataaaatttagttcactttctgtagtagaaatgacagtttttctatgtaaaaatagcattccagtggattcaaagatgtgtcatatcattcaatgtgtttctggaaactctgttactgttaagaattctgaggaccacttgctgtagtaaaaatggcatttattctatgtaaacagagtaaatctataacaagacagatcattcagttgttgcacgtggaaaaaaaatctgccaaagtaacctatgtcgtgaaagcacttaatgtgttatccggcacatggcaggtgcttagtaagtgtgggtttccctttcatttccttttcctaaggagtgatccatggagtcatcttgatcttgaatccaagaatgtccctctaggaccatcatttgaatacagttggtaagaagaaaaataaattcatcatttatgagtaattgatttgctaaatgatcctctacttagtagatttacataagtgacatttacaaaatgaaaatatgccaaaactgaaaaaccatgacatacaaatttgatgagagaggcaaaaacaaagataatgataataaacatggaagaaaaaaagagatagatgcctgataggtcagatagagagatgccctagaggaccctataggccctcccaatcaggaatcacaactcattttctgaaactatgaaaataaaatctaggcttgtattctttcaatttaaggaagttcttcttgttctagatctttgtttggctcttccaaaatagtgatactggccagtcacatctgaaagtaggctgcttctgtcctggatgttgtcactaggtcagaaacaggggaaagaccctgacttctcggttcccctcttcccctgcctgtagtgtctggacgaggcggatcttttcattcacaaggatcttgtcatggatcctaagagaacaggagacacacacaggagaaaccaagggtggcgatgggctccataactcccagggagctgctggctagctgtcgtttcttcacaatgggagtcctattttcttgtcctggacaaaggcagtggggaggaacaatctcacacctctcagccgtccaaccaacccctgcagggcaaatgcattagttcccgctgttatcctgaggactgtttctctgcagagggacagaagagggagtgctcagagcacacagtgagccgggtccccaaccttcctcctctcctgcaactcacagtgcaactcagtgatggatccttcccataaataacagggcctaatgtgctcatgagaggggattgcttttagataacaaggatgtaatggaagcagcctcaaatgaagaaacttgcaaatgattaattatggatcaataaaagatgatccaattgattgtagagaaagtctgcagcatgacttcctggattcgctcaatgtatggtctttttaaaatgcttgctgtgatcatcctgtgttgatggatctacttcacagggagggacagtctaagtccccctttaagccttctgtgtctgcctttagcaacttaacacacaggcatcagaacacaggacattgcattagctgttattcctaccagacttcatgatgtcaataaaggaggccagtaaaggctgtcactatgcaacttacaaaaaggttttgcttttttgttctgtttcagtaagactggcttatttattgccgtgtattcctacttacttttctctgaataacaagattaatttaatgaaaagaaaacccaattccataccccagaaaatgatcctgaacatatcatcttattaaaaacagattttaaaaattaataaattaattgagaactggggcctctggtattccagtggaagatgcccgtcatcacccattttcgcttcactgatgggaatttccaagagcgaaaggtttgtctcatcatttcagtgtaaaaattagcgctttgacaatactttgcatgggctaaaagatgctgggaaagtttttgacaatttgaaaagatgtctatctgtttaaagttctctcagttctcagcaggtggagctaggagaatgattgtttttctcctaccaaaatgtgagaaaaaaaaaaacattccacacctatagaaattttaatcacagaaaatgagtgattctcaaaatgaaaccaataatagtgtcttctttagctagcaaatcttgcctctctattttgcttttaattttcaagaacaaccagtcacattagcctacactgccctccaaaaccccgtgtgagggatcccaccagactcgcactgcacctgccaaggttgagaggaagaggggcttgtcaccgccccccacctgattgaaagtagaatatatagcaggagaaccaggctgcacacgtactgtacaaatttggggggaaaatattgttttacacaatcacataatagatgctcatggttaaaaacaaacacaggaaaaaaaggagaggctttcttcaagtgtgtatttatttatcttctgatggaatattctttttgggcttttgaacccagcaatgccctcaggagcgaggggtgaggggcattttgctccccatgatgatggcatgtaggctcctggggcacaaggcaaaaccaccgtatgagttcccagctccactattcttcaaaacataaacaggccaaaccaggcaggagcctaatagcaggaacatattttgtattataaaaatacacagtagcatatacttaacaaatcttcttacgcagtgacccctctcctgcaggaaaagtaatcatggcattctagagtttgcctgcattcaaccaacataaaatcaaactcaaatgtgcctagatgtacatctaaagcctctgaaataattctaacagttgaaaaagatgaatgagataaacagaaggaattaacatacaacaattattcttcctttgttcaactcttcccatgaagtataatttcttttactattgtaattctcaaattcagcttaggcagctgagaatgtgtatcactgctctttaatgaagaaggtttaatattattcacattgactattatactctcctatatgcttagacacttcaactctaataacaccactaggtaacactaaaaggacaccaagctttacataaaacccaaggtcaaaaataattaaggggaaaaaagtcaactttttaagaaattctttggatggaattcttaaaaattaaaaatgacagtttttttttgcgcatgtgtgtaaagtaacagttaagtcaactctatttttaagtgaagatattattacatttgattattataggttggaaaaatgtcttcaggtagaggaataatcaattcaaaaaatgtcttccaactttacatttgtagaccattttacagttcaaggcaatttctcattccttatttcacttaagccagttaaaaaacccagttttacctgactcattgagatgtctgactcagatgtgatgtgtgtcaaaaggagtctgtgattactgagggagcactaaaattggcaaattaaaaatatatagttcaagaatatgttcaagatgaaacttgtgaggacttcattctaaggcttttgctttctgatgtgttacattctgaggtgttgcattctgacatgctgcattcttcctgatatgttgcatattctgacatgttgcattctttctgatgtgctgcattctgacatgttgcattctttctgatgtgttgcatattctggcatgttgcattctttctgatgtgctgcattctgacatgttgcattctttctgatgtgttgcattctgatgtgttgcattcttgctgatgtgttgcattctgatatgttgcattctttctgatgtgttgcattctgatgtgttgtattctttctggtgtgttgcattctgatgtgttgcattctttctgatatgttgcactctgatgtgttgcattctttctgatgtgttgcattctgatgtgttggattctttctgatgtgttgcattctttctgatgtgttgcattctgatgtgttgcattctttctgtgttgcattctgatgtgttgcattctttctgatatgttgcagtctgatgtgttgccctctgatatgttgcattctttcagatatgttgcattctgatgtgttgtattctttctggtgtgttgcattctgaagtgttgcattctttctgatatgttgcattctgatgtgttgcattctttcagatatgttgcattctgacgtgctgcattctttctgatatgttgcattctgatgtgttgcattctttttgatgtgttccattctgatgtgttgcattctttctgatatgttgcagtctgatgtgttgcattctgaagtgttgcattctttctgatgtgttgcattctgatatgttgcattctttctgatgtgttgcattctgatgtgttgcattctttctgatacatcacattctgatgtgttgcattctttctgatgtgttgccctccgatatgttgcattctttcagatatgtggcattctgatgtgttgtattctttctggtgtgttgcattctgaagtgttgcattctttctgatatattgcattctgatgtgttgtattctttctggtgtgttgcattctgaagtgttgcattctttcagatatgttgcattctgatgtgttgcattctttctggtgtgttgcattctgaagtgttgcattctttctgatatgttgcattctggcgtgttgcattctttcagatatgttgcattctgacgtgttgcattctttctgatgtgttgcattctgatgtgttgcattctttctgatatgttgcagcctgatgtgttgcattctgaagtgctgcattcgttctgatatcttgcagtctgatatgttgcattctgaagtgttgcattctttctgatatgttgcattctttctgatgtgttgcattctttctgttatgttgtattctgatgtgttgaatcctgatatgttgcactctgatgtgttgcattctgatatgttttcttgttgagtttaaaagatggagctgtatgcagggttacaggaataaggcacaaacaatggacccatccatgggtgtgaagcacatgtgcggccagaacccacctggtgggtcatgactgaaaaaacactgtgaactattgcctaggcccatctcatggttgatatctttcctgctactctgaactctctgtgactgtctataataactgtaggcatttctacacaaccaatagttttttggaagcaggctaagattttttacatgtatcattaaataaatttacttattttgaatttaacataaagcataaaagatttaaaagtaaaagtatgtattttgagtaggtatttccttacattgtgtacaccgtgtatgcattttgaatgtttgtttatctaataaaagttgtaaaggcttttggaaatataaaactgaatgatcccccacatttctgaagaaatgtgaatggcaaattataggatgaatgggatggattacaagtcagaaattaaactctataaagataaacagagactgaagaagacagagaaatgcaattggaaatgaaggctaattaaacaaaagcactaaatatgtctaagcagcaagctacaattaacatggaagacaaattgtgagcacaactgcattgtgaatatacacacaccaaatataaatattatgttaataactgtgacgacttggtagaaaggtgtatgtttcagtaggtatagccattacatttactttttttggtatttttttttaacttttgttttagattcagaagtacatgtgcaggtttgttacacaggtaaactgcatgtcacgggggtttggtgtacagataatttcatcacccaagtactaagcctaatacccaacaggtactttttcttgttctatttttttttttttgagatggagtcttgctctgtcacccacgctggagtgtaatggtgcaatctcagcacgctggaacctccgcctcctgggttcaagcgattctcctgcctcagctccctgagtagctgggattacaggtgtgtgccaccatgcctggctaatttttgtatgtttagtacagacagggtttcaccatgttggccaggctggtcttaaactcctgacctcaggtgatccatccacctcagcctcctaaactaacaggtactttttctggtcctctccctcatcccaccctccatgctcaggtaggctccagtgtctgctgttcctgtctttgtgtcaatgtgttctcattgttcagcttgcatttcttcagaggttttttttttttgtgtgtgtgtgtgtgtggagataattcacttttatatttccgaaagcctttaaaacttttattagataaacaaacattcaagatgcatacagtgtacacgatgcaaagaaatacctactcaaaatatatactcttattttaaaagtgagaacatgcaacatttggttttctgttgctgtgttagtttgcttaggataatggccgtcacctccatccatgctgctgcaaaggccatgatctcattctttttaatcagccattacattaaagatgtcagagttttatggggctatttgagcttcagttagcatccagggttctttgcattgtctcgatgacctggtctcatgcaaacaatgtctggactcaccctcacttgttagcagtgagcagattgagtttgcctcaggagaattttctagggacaaatggagatctctaatgttgccctcatattccccctttggagcaacagcaccataatgagggcgtaggaacctctcagtaaagattgcctttctacttcagaaaatgctgctaacagaaaaaaacaaaaacaaaaagaaaaacggatttttatcaaattggtaatgaaacacttatttcatgctactgggtatatgaggtattattatcagaaagatatcaaacagttaaacttcacctctactagctacctaggaaaaatatgtccaaattttatctaatttaggacaatatggatttttaagtcttaaaactgatgggaaagtctatggaatctccttatatggaaaagtatgaaaataagccagaattaaaagaactgagtaagataatctcatgaaaccctttgcaggtttataatttaattttttattgttaaaatgcccatggtttatgaaccttaacttagaatcctcctgtaatagccctgttgaataaacaacacccgggtataatcatcttcagatacgaaaggcaactgcattcgcatttcttgggataacagccagaatactacaggtagtaaactttgggagtgattaccaaaccacctaggagataaaactcccttagcttccagctgatgccttattctcaagatttgtcatgacataattgcccagaatataagactcgaggtaattcactttgcttaactgaaacaaagcttgatcccaaagagagaaaattttcagtccttgccaagactgctgaccatttctttccaaaaatagtgacttggggtcagtggatcatttaatatccctgcttagtattgttgaaaattcccagggggtgaaaaaaaaaaaaaatatatatatatatgtatatatatatatatatatatatgtattccaaagtgaatgacacagaatgtgtaagtgcttatatttttaaactacaagtctgtctccaaaaaataactttcatcttttctcttctaataaatactttttaaatgacctctcttttattgaaaattcatttacacacacacacacacacacacacacacacacacacacacacacacatatttgctaatggaaaaaagaacacaacacaacaaagaagtgtatcataaggaaagtttccctaaagttcatctggatgtggttttacatcatccttccagccagtgaacacacagatgtgaagacatgtgcaagccatgtttgttaatttataaagtactgtacctcggttttcctgcaaattttaaagcaactgaaaatgaactgcagcttacattgctaacattttccagcccatacaaagtcataagataaccaaaaatcatgtttcaacccacggtattccatacaatgaatgctttcactccaggcctgcgaattaggctgacatcttccctagctgtaatatctccatcccaaaatacgttcattcaatatgttcatcaaacacagtgagaatttctgttttcatactgagattagtattgtgtggagccacctgtacaggattatgaaaggcagatcgcaaagtcttgtgatggtcaagaccctctctgatcagcagaggaccttggtactcaggcctggacttgtggaaactgaggggtaatacatttgtgttaagtgtgtggtaatttgttgagctgcggcaatagaaaatgaatacagtgactaatttccctaaacatttagaggaaatttcttggcataggtgagtttttaatgctaaaatttaaaacagttgcttttttcacttgatgttttacaaattccagtgaattgaataaatcttccaagccaatgctattgagtgggacctgagtgaataaggtatgtacactctgtactgaactgaatatttttcatagttttaccaagtttcatgtgtccctttcccatttgcctatatcacaatgatgacgcacctaacagaaataaatattaatagtctgaatgtggatatcaccactaataatttccttttaattaaacacatgcttacaaacacaatttccttagaaaaatattttctttttccaacacaagagaattttagggattataaacaagcaaaaaaaaaaaaaaaagcacatgccccctccagtgttagttgctgccttcctgttaggtgtcttctccagcctctgttccccttgtagagagaggctgaggagggtggatcacaaggtcaagagtttgagaccagtctggccaacatggtgaagggtacagttgacccttggatgacacaagtttgagctgtacacacaagtccccctcatgtggattttcttccacctctgccacccctgagacagcaagactaacctctccccttcttcctcctcagcctacccaacataaagacgataaggatgaagacctttatgatgatccacttccacttaatgaagagtaaatatattttctcttccctatgattttcttaacattttcctttctctagcttacttgaggatatttatataatacaaatagcatccacaataggtgttagtcgactattttcgtcatcagtaaggttttcaatgaagaatcaactattagttgttaagttttttggagagtcaaaagttgtacacagatttgcaactgtgcaggggctcagaacacctaacgcctgtgttgctcaaggatcaactgtatttttaaaagtgagactgtaaggccaggcatggtggctcacgcctgtaatcccagcacctcgggagactgaggagggtggatcacgaggtcaggaattcgagaccagtctggccaacatggtgaaactccatctctactaaaaatacaaaaattagctgggtgtgatggagggcgcctgtagtcccagctactcgggaggctgaggcaggagaattgcttgaacccgggaggcagaggttgtggtgagccgagattgctccattgtactccagcctgggcaacagagcgagactctgtctcagaaaaaacaaaaaaaaaagtgagactataaaaatctattttgcatccttcttcttaaaaaattcttccttttacagaaaataagtcccaatcaatacctgttacctgctatgtataacacagcacatccttccctggaatcacgggaagaaaacaaatgtctctgttcattcattctttcactcattcatccattcattcatttgctgttcactgaagtctaagcctgtacaatgtgtaagggacgtacaaaacaccacctgtcaaagaactcaaaatctcatggcaaggctgatgttcacatgaattatcaaagagaaagggcttttgaataacacagacttctgtggagatcctccctgtcctgcttgcagctgtttatactcttggcaaattatgtaacctctctgtactcctttaattgtctgtaaaatgtagaaaatcatatctacctttctgagcagcagtaaaggtgagaagagatcatacatgtagaacacatacttaggactgcagttgttcagtggctaatcggttgtggaagccctggataaacactgtgacaacacatgtctgagaagagggagttgcaaccagcctgccattcactccctccccttaccgggggccatccccagggcaaagaaaaggaggctgagacctggtctaatctccttgtcaaccaggattgttggaaggaagaagccttgtctctgaagtccttagcaggacatccagctaggaataatctgttagtaaacagaacccaagattcctaagacatgacttcccagagaatgtcatgtaagatatacaactttctgggggtacaaattagaaatgttttatattttgaatgttccctgctgtctgagaaaccccaagacctcatctattctgggtcagaagggtaagcccaaagtgggaagaaaggtcctgttctcacagctccaaatttgtgttttgtctgaggcttcaatggcctgagtctctgacatggtttagtgaagctcaacactgtgtaaagtctctggtttgtgtgagtcggagctcacagtctgaccaagcatagctcagcgttctgctcatgcaggaaggagtacagtgaaggggaggcggaggcattcacaggcagaagaaagagatgcagagatgagagagggcatggtgcaatcaggcaatgggatgtgtcaattctgcaagagcatactggaaatgggagacaaaggcccgagtgcaggtgcacaggaagaggaggggctgacggcgaggtccaggcacacctggtgaagtcatctggccttcaccaggaaggcaaggggaatccacttaaaggggaatgaactaaatcaggggactgcttgaccagaacaatgtcccttaagagggaattaggatggagcgatgaggacagcgggcgcccttgcgaaggctgaggttcacatgagggacagaacatgaatgaagagcagaggcagggatggagaggggagaacaatctgaaaactatctaaggatatataagactttaaagcagctttaacaagggaaataaagtgtggatagaaataagtacgaaaagaattataagatctaatatgatcacatttttgagcttcacattatggcattcaatgctgtatgtgcctgaaatatattaactcaataaaaccttacactaaccctttgaagtaggctctgttattattcccatttgaaaactgtggtaagtgaagcccagcaagattacagagctactgagtggcagggccttggactgtaaagcaaaactgcctagaacaaagccatgaccataccagatgactccataaacatggcaggaaacacagaagccagggcgagatggcactcaaaaagcaatcgctgttcagggcaggatgcgatttctggctagttacataaggctgatcaagaagaagtgggctcaagtttcagaacactctgcattacatccagcgtatcacatattacatcccgtttaactcactgaaccactattaccatttggaaagattctatctgcattcctccaaaataatagtttggaaaagttcatttaacgagccctcctatttgaacctggcctgccttgattgataagacttcaatatcaaatgtagcagccttgagttttgactctcgttcaaaagtgagtttcaaaagtagatttttcttaaaaatgcagatgatttcctcttctttattttactatttttctataaatagtaaaatatactttcatttctctgaaaagtaacaccaaagcttcacctataagaataacttattactgaattggtgtctttctcaggaatttaatccaggggaaaacacctttgtcactcgaaggtgtattcaagccaacagacgattctagcatcggatgtcaggaaggaccaggggtgctcccgtcatctttaaaatcttccattctgccctccatcttctgaattcacatttcatgtcctctatcttagtggtgagaggcttagcttttataaacgtgaaaagtcactgaaatggacctaatattgaaggaaaggaagtaacatgacattattgtctttaaggtaacatagcaaagggtaaaatgtgtccctgagtaatcaaagcacaggcaccacaggctccccgtgccaccagctcccacacacgcagatgctggagaggcatggctttgaacctggtaccaagtagggtagatgacaactagtgtgtgtggtcaccaggtgtagaggctgctccccgaaaccctgggtgcagtcaccactgatgggttctacatccgtcttagacctgcaggtgggggtccagcatcaggctggctggagcctgcaaccacctacttaaatcagaagtcaaatgtgagtgctggccacagtgatattctattgaccataaatctgcctgaggttcatcctgctgaggcctacacaggcatctacactagagcatctaataatttcactaagtgttagagaactgacaaaaaataataataaggcaaactgtgggaaacaggtatacagtttttgtgagataagatgatgtgggttactggtcaaagcccctactggaaataagaagatattgatatgccaggatcctcttaacgtgatttaagctaactcatttgacttcactggatccgtattttctccattgtatattaagtggagaggggcagggcggccaggtgcagtggctcacacctgtaatcccagcacttggggaggccaaggtgggaggatcacttgaggtcaggagttcaagaccagtctggccaacatggcaagatcccatctctaccaaaaacataaaaattcaccaggtatggtggcgtatgcatgtaatcccagctaccagggtggctgaggtgggagaatcgctggaacctgggagatggaggttgcggtgagctgaaattgcaccactgcactccagcctgggcgacagcgagactatgcctaaaaataaataaattaattaaattaaaacaagcaggagatgcactattttaagtgccttttattcataaaatttaaaaaacgtatttgcaatataaaaactgaagaggtgtaatagctattcatacttacgtgtataatcggattagtcgggaagagtcggcatgaggtgtttaaattctctcaccatcaacatttcctttcactacttttccaaactgctacacttgaaagatgtttgccaaataaaccgtatttcagcaattttctttttcttccttttttcctttcctttctctctgtacctctgtctttttttaactcaaagacacatgtaacaattttttttcttgtttcttttcttttttttgagacggagtcttgctctgtcctgcaggctggagtgcagtggcacgatttctactcactccaacctccacctcccgggttcaagcgattttcctacctcagcctcctgagtagctgagattacaggtgcacaccaccacgcccagctagtttttgtatttttagtaaagacagggtttctccatgttggcccggctggtctcgaactcctgacctcaggtgatctgcccagctcgtcctcccaaagtgctgggattacaggcctgagccactgcgcccggccaacacatgtaactattaatgaggacttcagatcagcctgagttaaccaatgttatcaaacgagttgatacaatttctgcccaaagcgacttgacatttcaattaaattgtgcagccttttcaaaggaaaagatatactttcctttaagtgcttttgaaatattaaaaatagcacctggatgcccatgattaattttatggatcctcgaatgggagctatgcatacgcactttgtccctttgaacctaaggatgttattgtcctcgtctatatcaactacgtacacaaaggttcacccctgcatttcctgaggcctggaccccatttccacagctcgttactgctacttgccctacctgtttcactgggactgcagggctcttttacctgtgacttcctgcctcagtttaccccaggcagtctctaatcacttgatccagacagatatgcctctgggccagcactgctcccatgtaggtggcctccctcggtcccacgtcctccagtgataattctgaatgggccgtttgcaacattgatgaacacatttagaaaccggatgtggtagttgaatcaagttcgggttttacaactgtaatgaacggctgacacttgggcaggcagctttgccatagacaggtgtggaacaggcagtgagcccaagctttgcagctgattcagtgcagagtctcacatcaagacctttgacttgttggtcattaaggaatttatcagggcaataacttttagtaaaacagtgaagaagaaagtctatcaaaaaacaaacagtaggcccgtgtggtggagaaaccacaagctaggtttcattctgatccaaggaacaggtgggctttccctatgcacaaaattgtctcactccctggactgaattgatggtccagaggctttaaaatactcacggacctagcttaagaataactgggtaaatttacaaataattgacaactactctgtaagggccagaattaacccaaagaaacacatttgctagtgtgtccacagccatacatttgcattcttaattcagcctattctcctgggttcacgctgagtccaacttttgacatcgtccttgcagtcattcatgcaactctgtctatctactctaaaaagctgaagggcatctgtcagctaatgagacaatttctccaacagctggtactcatgtgagggtaattccgtggatttattcagtggtcatgccatctaatagtttctccgaggacctgattcaaagccctcaaaattgaagtgtgggaacagaagcataagagtaacaagacactcgatgagacaaatctcagaggcagggcaaggaaactgaacggagttgacaccaaggccgaaggtggctgccttgtaccggacggggaatccgaggatcaaagtatcttgtggcaaagtctccctggggatagtgtctgtgtgccctagagcatcacatcagggggcctctgtctttccagaaaggcagtcaggttcttcatccttcagacacgatccccactgacctgggagaaatgcttgtcccagtatcagccccatggatgaggcctgggcagtaaacacaccacgagggttcaaactggtctggggtgatcctctgttgaatacacaagcagattgattgcattcaacctctttgtctcgggaaggacgttacttacaccatcccaaattaataagaactatcctccaaataactcccatgtgatatggtttggctgtgtccccacccaaatctcattgtgaattgtaataatccccacatgttaagggcgggcccagtggagataattgaatcatgggggtggtttcccccatactgttctcatggtagtgaataagtctcatgagatctgatgggatttatttatttatttatttatttatttatttatttatttattttgagacggagtcttgctcttgtcaccgaggctggagtgcagtggcacgatcttggcacgctgcaacctccgcctccgaggctcaagtgattctcctgcctcagcctcctgagtacccgggattacaggcgtgcaccaccattcccagctaatttttgtatttttagtagagacgggattttaccatgttggccaggctggtctcgaactcctgacctcaggtgattcacccatctcagcctcccaaagtgctgggattacaggcatgagccactgcgcccagccctgatggttttgggagttcccctgcacaagctctctcttgccagctgtcatgtaagatgcgtcttgcttcccctttgctttctgccatgattgtgaggcttctccagccatgtggaacggtgagtcaattaaacctctttcctttataaataagggaaaatcctgggtatgtctttattagcagcatgagaacagactaatacactggaatatttgagaatcttcatgacgctttcaaaacaatattttagtcatctgccctgaaacacctccagggtcttcccatgtgcattgtggaaagcaagaactggttgctctccttgatgaagctctcacatatgcaaggacatttcaggctcaaagtgtccacagttattgccttgctcatccccttcacttttttgaagagaaaacagaagtgataaagaaagctagtttttatggagcctctctaatcacgccaggcattttcacaagttagctcattggattctcacagccgcgcagagtagcaccatggcattttgacagaggaggaggcaaaacctggaccacacagctggtgaatgcccacagaggggtggcgccccctcatctgacaaccaggcccaccctttctctgaaggccgcagaggttgagagagaagagtccaggtttccaatccaacctggttcctggtctttcctgcttctgatagagaatatttagtttaagattctctaagctatatctgaagactgtaatactctaagaagcatcagtccctcattgccttcataataaaacttgttttccctaagtttcaacttattggctgaaatgaatttttttttccccacagattagatttggaatgaatattttacaatgtggaaattattcttcctgctgttctgccctggcactcccaacctctccttgcctgtctatactggtttctaccttttttttttttttttttttttttttgagacggagtctctctgtcgcccaggctggagtgcagtggtgcaatctcggctcactgcaagctccgcctcccgggttcatgccattctcctgcctcagcctcccgagcagctgggactacaggcgcccgccaccacatccagcttttttatttatttatttatttatttatttatttattttgtatttttagtagagatggggtttcaccacgttagccagaatggtctcgatctcctgaccttgtgatccgcctgcctcggcctcccaaagtgctgggattacaggcacgagccactgcgcctggacttggtttctatcttatctcacaatgatcaccaccctccaacccaacatataattcacgtccatccctttgtcctccgcccccacttgcgtaagtccctgcaaggccgggagtgagctctccctagaacactgccgggcacaccgtgagccccgaggaaggcctcactctgataacttacaacaaagggaacttttgaggggaagtacatgcatatgttaatgagtatagccaacagtatcattctatattgtatacattctgggcaccaattctgacaaaataaatcatcgagaagtctggtcaattctgttggaggcttgccctatggtccctgaatataattcttacgtgcctgtgcttttcagggctgcgtctttgctagaaacaagtgattaccaaactgttccacggagccctggggtttttctcgtgacttcgggggcctctgagagggacagctagggcagcacctgattcatccacttgggtatatgtggtttctgcttcagagatcatagaagagtagagctcatggatttttatatgtatgaatatgttttttaaaagccaactataaatattcactctataactcagcttaacaaaagtctattttgctaattatttactgtttttttttcttttttttttcaaactgggtataatgctcctcaaattgggaaactttcagatctccaaattacagtttccaaataaccatacatgcagcacagatgtgaacagtgggtccaaaataagcaccttagattaagccacacgatgaatcacttcgctttcaaaaacaataaaagccagaggccatgttgcacatggcacagagaagcaacagagtccatttctgtaataagcatgacccctcactgaatgcttgctatgggagatgtgtgcctcctgctgtgcgggctggttcccaacaggccatgaaccagcaccggttgctccatggcccagggcttcgagatccctgccctagagactatattaatgaattaggaataacattaacattcctaataataggagatgatgactaggaggtggattaacatggtcaaggacccaaagctggaagatcccccaggcagcattgactcgtggtctattccttcactgtactgacgctcctagcttcgagaatgatgcatgggcaggcctgttccattaacgttttgtcaagtgactaaatgaaacataagttcaagaaggcaccttccaccagagatgctggctcagagattaacaaaagccacatcaacggcatttggaatcactcatttaattacggtgatagatgccagcagcagctcccattattaccacatgcttaccattgccagacactactcgaagcactcaattgtcttaaatggctctaaaaggtcaatattagcgttatgtccacttggtagatgagaaagcagaggtacagaaaagctttaaaatgtgcctatgttttcacagctgtaagcaatggagcaggattggaacgtaggcagttttactctagagctcagatttttaatgctgagctctgattttaaaacttacaggactatgaagccattacctataatatagaagttacattagatctggttcttcccttaaaagagtttctgatctaatcagggaggcatgaaataataacataaaataaaataagatattactctgtacatgtttccagagggggccctcagtgtggacaggtgaagtcagggcaggcttcctggaggtggtggccttgccagagccttggagtagttctgagcaaggctgaaagcatttcctaacaggggaacccaggagtcatggggtcatggaaagggagtcttttcagaggatgctgacctaaccaggcgacaaggagagatgcaagaagaaaagcaggatacaaagtgttcagctttatggccaagagcaagcatgccacacctgcgaccaggggcaccaagcaacctggggtcaggatgcatgctttctcttgctgttggaacgtgaatatcttgtaggcagtttgtatactctccagttgacccctaaggacagcaaacaattaacaccctatttaaaggctagaatataggaaaaggaggatctgaaatccagtagactttccagataagagaggagaccctgggaaggcagacggcaaggggaggattccaggtgggatcaaagctgagcaaatgtctgatgtctctaacagcccgactggaagaacaagtgaccagtattttccagtcaattagacacaaagcatgattgttgcagcctggtgtgtattcaattaggactgtaatatgatgaagctaagaacagattattttgcagactttcttgtgtctgtgcctgagagcttgctcagaggatcctgggtgacagctctctgtgggggcctgtggccaggaggggagacgaggcctcatcgtggcattttcagggctgaaatgccaaaacaaaatgctcacattcgttaggaacctcctatgatccaggcaggtttgtgggtacagcacaagtctctccatgaattaggcaaaattatcccccttgcactaatgaaataagggcctgggtgcccgagtaatttcctaaagtgaaactaagatgtaaatacaagtctctctgttgccaaaacccaggaccttttcattgtgccacactgccttctgtgtgtgctctgatgaagagcttttgtaggtgttcttcaagatggaactgaaaattgagtaagacttcccagagacccagctgtgggggactatccgcagatggagaccctgggctaaagaggcaaactcttattttataagtaggggctaattggctgggtctaagtccagaatccccccagctgttatccccaagcctaatgctcaaacagacacatacaaaaaaagacaagtcaacaagaacggagaaaaatcaacccagaaaacaaaaaaagctgtaatagttgggtaaggtacatttatctatttttttatatatatatatttatatatatatatatacacacacacattatacacacacatacatagatatatacacatatatgtatatatgtatatatctatatagatatatatgtatatctatagatatatctatataggtatatgtatatatgtatatatagatatatatgtctatatctagattctagatatgcacatatatatctatatagatatatatgtctatatctagaatctagatatgcacagacatatatatctatgtatatgtctatatatgtatatatctatatgtatgtatctatatatctacgtatatatctatatctatatatctatgtatgtatgtataatactgaagctgtcatgtgactaccctagcaaagatcttatccacaaatataattataattataaatgcccaattatctgttgagatatcagctcatgatcatcttattgtagaaacgttttcgattgattttcaagcattcataagcattggctgagagactgcggtctgtaaagcactggcagaatacaaatgcttgttgagtcaacgggcatttattgagcatgtattatgtgctggtctttgaagactgaaaatttaaaaaacaaggcccctgtcctataatataacctattgcttggaatggagttttaaaaaccatgccaaggagaaattgtcatcaatgcctccttcctctctttggagatttctgtgacagggtaatgaaaattataatcactttagatatcaacctacttgcctaaagagaaactaaagagaaattgtcctgaattcacataaaccaaggtaatggaagtgatatgtttctcttttttttttttctcatcagaaaactgattattttaaacaaattgcagagaaagagagagagaggatgagatgaaggaaatgtattgacttcagagttgactcatgaactgtcatagtataagaaactgcatgaaattctgtagtgcagccaaatattaattgaaacaattaactgtagaaaacacgtgggcacgacaatattagcagtgcataatcatttgtagttaagaggtccttaccggattactgcagaaaagctctggagttctaattacttgtggaagtcccacaaggttactgcaaaacatggtaattagacggttgtaatataaggtgttagcaggggattgaggatttgctctaagcaccttggtgttttcgtggctatttactgagcagagtaccagaatttaatggaatttggtagaattctccaatgactcctatgagcacgtagttaacaaacgtatcttaatgtgagttccatggttttcttgaaagtgatgaacatcgccatctttaactactataaggagaaaatataacctaaatgaggtggattatgtggatttatttttgggatttattgctcttgtctttcggtggcatttgagtcaggtgtattacacagctttgagatcttggcttcactaggcataacccagcattagaaaggaagtagcttggtgcttctctgcaactccagctcagacttctgtgtgacagtccttttttacaacagaattgggacatcgctgcatacgtttttctcagctttgaggatgcttctacaacccatgcatgcacaatgaaagaaatattatacatttagtgatgggcacaatgtacttattcaaaaatgtcagtaaatataaaagatttatcaggtgagtgaaggagacacgtcttttttttttctttctcctttttgctgatcccgaatcactctcttacgttttttttttgtctgtgtaccacaaatgtgtacctaaaaatgaaactcagactataaactgccctaagctcccagagtagaaagcatgaaactaatctaaagaaaatattggcagaactcccacccgcgctttgattttggctcagaaaatcacctcctccttctatagggtctggttcgcctccgacagcagaatcaggggcagattccatcagtccatggaaatggggttcctggaagtaacactggctttctcatcttggtccaggcaaggggcacttgtcgggtcactgacaaaggcattcattaagagtcagttattttctgcaggtgcctttagtgagacaacagtgagaaggggcacttgggaagacgcggggagtgtatggagagccataccccactgcttctttggggttccaaacctctaagagaatttcccttatgctttagctgttgagaattgaaagtctcctttcaaacatttaagcagagcaagaggggatagctgctttgctacagttacctgttagtcaaaagcttaaaggagaaattcccttgcctgtcatgtgtattccacaacgcatgaaaagaccagacaaagcgaaacaaaacaaaccaacccgccgccagggggcagctgggaaacatttcgaagggctgggagagatggaaggttggcaaaaccaaggggagggggtccttgtacttggtgaacagatgactctctatagtaaggattcagggccgggaggcgggcaagcaggtacgcctaagcttcttgtgttgctaaccccctccgggtctaccccagttagcaatgtctactgggacctagaggggcgcagcttcgcctatttctctgacaagactgtaacatcttggaagggagaagctgtgtcacatctatctttgtaagccacagagcaacgagcaaagtgctgagtacatatatatacatgcatgcatatatgtgcatatgtacgcacatacacatgtatgtgtataatcgtataccttacatataaatctataattatgcatcatctgtatctgttaagttatacatcattttagtgcttttatggaggaaggaaagtaatttgcaggatcaatttctatgcagaagtgattcctggtacagattttaatgcattaaattttcacaaagtcttcaactccagcaatttaagttttatcaagggccctgggttttgctggctctcttcacctgtacctcttatcattaagagggaaaaagaaaaatatcctttcctgtagccccatggtacactgcaaacccctctgagaagctgtaatgagctggggaagctgtagtggggaggaggggaaaggctctgtaatccctcggcctcggggctgacatggggcacatcaggactcccctggcgaggctctgtcacttgacaaacttgtgtagttggagccataaattctccttgtactccgttgctccccacccacattcaccctgcacctctcacctacaagaagtgacagtcagagtactttaaaaaacaacaaaaactcaacagattttatcctttgtaaaagcctaccatttccacatttgtctaaaatgctgattttatagtcctctgtgtttgcattgcgtttgttatgagaactaactcctttatataggaatagcccagttgaagcaataccacttgactggatattttcaattcataggatattaatggatatagcacacataggacatatatatatatatatatatacacacacacacacacacacacacatatataaattagtacaaaattgttttgcctcctaacttgcaaggcctgtaaacccattcttttttctttttacatagatatgttgagatttttacatcttggcaaaatataggctgtaatttaattgacttagcaacactaccaaataaaacacttattcccaagggaaatttctttccacactttctgctggaacttctaattgacatctatttctgaataattgttgaaactaatgtgttggaagggctggtgatctcaaatagctataaatgaggcatcatggcatgtttttttcttcctgacaaatccataagtgaataaatattttaagtcagtattggccaggtgtggtggctcatacttgtaatcccagcacttggggaggccgaggcgggtggatcacttgagatcaggaggttgagaccggcctgaccaacatggtgaaaacccgtctctactaaaagtacaaaagtagacaggcatggtggcacatgcctgtaatcccagctactagggaggctgaggcaggagaattgcttgaacccaggaggcagaggttgcagtgagccgagatcacaccactgcactccagcctgggcaacaagtgtgaaactcttgtctcaaaaaaaaaaaaaaaagtattaaaaattctgtccacggaattgatttaatagatgaatcaataagtctggtatgaccatcatagagcaagcagataaggctctaggtacaacaaatatataattgtattagtcatcgaaaaggaatgcaatatatttcactagtcagagaaatagcaatgtggaatagaaagaaaatatgtaaaaactgatggacttttatttgaaatttggttgaacattaactgtggttctccctaaatatcatatacattttctttcacttcattggtgatgagccattaatatcataaataatacatactggtagaatgagtaaaaaaaagttcagtagaaccaattaacaaacaatgtaaaacatgtagatttagaatacctgtcatttactcaggtctacctttttgcccaaatttcataattctcctatcttggtcaacatctacaaggacaagatgaataaatctctctctgtgtgtagaacatcgtctgtttggtttcctccaagtagaaagccaggaatgattcttccttcacatttcctatcaatcataattctatcagccagctgaatagcttggtacactcagcgcctatcaaatattaaagccttcccattcttgaaattcacataatagcttggtttgttatcttgcactaaatctgtactacattacacatttatgattacctgtaaatttcacactgatatttaagttgtaaaatatgttgatgcctttaaaagtgtgtgagaacataaaattacacaatcataaagtaagttaaaaattacggcagcataaatactaaagtccaaattcttgtcttacataatccaagtgataattgttgtgctcttactctgtggctgaggacactgtgacaagcatggagaattcagctgtgagccagattacacgatccctgccttctgggagatgataccaaataaactcaccaatgaataagtatcgcaaattattacgtggggtataaagaaaacaaagaggaagctgtgaccaggtaccaggcttatggtatgggacttttcaaagccaagccttgaaggatgagaaggagctatgcacacagcaggtgaaggagaaggggcagtgaactggctggagaagagcaggtgcaaaggccctgcacgggaaggtggttcagcatctgcaggattagcgaggaggcctgtacaactgccacagggcaggcaagggaaggagagatatgaaaggaacctgcggaacattatggagaatattatgaagaatttgtatttttcctaaggaatccgttttgggacagggaactgatttaatttacatttttgaaaaaccctctcaggaggctgaggtgggtggatcacgaggtcaagagatcgagaccatcctggccaacgtggtgaaaccctgtctctactaaaaatacaaaaactagctgggtgtgatagcacgtgcctgtagtcccagctactcgagaggctgaggcaggagaattgcttgaactcagggcagaggctgcagtgagccgagatcgcgccactgcactctagcctggtgacagagcgagactctgtctcaaacaaacaaaaaaacaaaacaaaacaaacaaaaaactcgctcaaggttgggtgcagcagctcatgccagtaatcccagcactttgggaggctgaggctggctaatgacctgagcccaaaagttcaagaccagctgaggcaatatggggaaaccccgtctgcataaaaatataacaattagctgggtgcattggtgcgcacctgtagtcccagatactcaggaggctgaggtgggaggactgctcaagcctggaaggtcaaggctgcagtgagctatgatcatgccactatattccagcctgggtaacacagcaagaccccgtctcaaacaaacaaacaaaaaacatgctggcttttgtgtcgcaaatggattgtagtatatccaagaaaggaagtagagagatcatttagtagacttttacgcaagttcagtaaacagatactagaggcttggactagagtggtggcccaaagacagagggtaatgaaaatattccaggtactttgggagcaggaatcaacagaaattggtgatgggttatcaggggcatcaggaagggagggacagagaatggcatcagtatgggcagtggtaacgcttgtgtgaggaacagtgtcagaggaacaggtgtaaagggtgtgtgggttatggtgcggttagaatcaagaccgacttggaaacaagctaagtttgagatgcctttgagaatccaagtggagttttcaaggagtcagtttaccatgaaattcagaagttctgcagagagttcaggagataagacataaatttagaagtcatgagtaggtaaatgatattaaagtaatgctgatgaagagttgcatgatagttgtctgggagtgagaagtctggttggggaggagaagctaataaaggagacagaaggagccaccaccgagggagaaggaacacagagagggcatggagatctggaagcccatagtaagcacgcagtgaggattagtgttactatcatttggcattaaattgtcttatccagtggaatatcccagtgggatggaggggaaaaaagccaggttggaaagagagaagaaggaatgggaggcaagtcagtggggacaacatatggcaaccactcttagaagcagtacgaagaaggataaaaaattctgcggagggggataagaggtttatgggtggacttttgtttgctgttcagttattgactggctgagcatgggagaggagagcatgtttgtaggatgtaggagatgaagcagggagggagggcccatgaaacctagagtgcagatgactcaagagccaaccccgagtgggggagcccaagcccaatgggggcgggggggctcggcttggagcaaggccaattctctcctggtaatgggaacacaagtgccagagaaggatgcaaatggcaaggaggttgagactgggttgtgaggcaatgagaaaggtcccttctgatagtttctactttatcattttacattttaaaaagatgtgtgcagtgcagccatggagtaagggagggagagcagaggagaggttaggaaaggtcagagggtaagctatgaagagctgcataggagcacgggaaatccagcagccagagaagaggaggacgatcccagacggtgcccagtgtgtatctgcggaggaatttaaagtaaaatgggtgagcccagttgtgtaattatctccagctctgcaaagtggacattcatgtggggttcagattggccactggaatggaggcaggatttctaggggagagaaagcctcaacagcttacagggaaggcctggcagacccaatgttgcatgacaaggaggaagagtaggcgggtgagacaaatgacctgaagctcacagcaggccatgctcaggaggaacgtgctgatctcaaagagaaaagtgtgggctgagaggacaccagcttgactccgagggcctaggagatgtggagagggaggggcaagcagaggaaggggtttccttgagagacgacctggttccggagaagttcctgcagcaaaaacacgcggggcatccagggaagtgcacgggccatggcggaggctgtccgaggggtggggacacgagggccatgaggtgggtgcttgtgggaggctgcggtgcgtgattagcagcaggtgagagtagagaagacagcggaattgaagacaactgggagctaagactggagggtccctgcggcctctcagagggatgggggctgagccctcccatggtcaggtcacaggccctgcaggtgctgggggccaactcacatcccttttcttccctctcccttagggtctcaccacttccgtgcaaagatgacaaatattgtgtaaacgaatattcaatatccctaacattcacaatattcctcatatctagctcacatactttagatcctcaaattcctattttaaacaaaaatgcaactgtcgtggtgccagatgatggcatttagcctctttagtgtgttacagaatcttttcctgagacacttaggaaagcacaaactttttcacccaaacaatgttgaagatggcagagcctggtttgagaatccccactcagggggagaaatagtcccagggtgccagtatccagagagctgacctaccagggaaagtgcttatgtttctttcaggataggcagtatggcaaacaaagtcccaaacacatcaatatgtcattgatcacttgacccaacttaaattttttattcctttgttcattgataacattgcatacccatagcgtgtgacagttttctcaggggctgaggatgcagccacagacaagcccagcttcttgccagtaggggaggtgcatgacagaaagcgttttgattctttttatcatccatactctctgcaatgattctcacagacaacgcactctcccaacatactgcacccacgtgacagtgggagcagcctccctacactatctccataactctgcttggtgacctctcagatgacagtaaacatcatcactcccagatagttctgaaattgtcatgttggaaagtacttgataactgttaacacaaaagggactcagtaatatcgaagggttatggatatatattcctattatgtgaaaaatacatatcttgcattcctagcagacagtagtaggttattgctggtactttcatatgttggggggaaaaacatgtacttaaaacagtgcctcgactacggcaagcagaattgaaattatgatgatgataatgatgaaaataacattactttcattatgaaacagtgcaaaatggatagtagacaaacactatccgtaattcaatgtggataattcaacgtgaagacactggaagtaaaacaatactttgaggatccagaacttcctcatttcacattctgttaatcagggttgacgtgtgctgttggctggctgtcttcatgtcagccagatcatcaagaatgtcttatcaagcaggtgagtgggaaacagactctcccctacaggccagcacaagtggctactgccctctgttgccaatagacagtgggcaataggtgttggaaaaaacgccaaggatattaaaatgtgagccttgaaaaaggactcatgagcaattgacaattagcaatcagctgggttgaaattgatcaatgagggattcaaagtaataaaaaataatgagtccgattaaaggcaaagcagcaaaaaaaagctagtagcttctacttagaacacatagttcatgaaaattactataactaaacattgtatttaagaacactttctcggccagacgcggtggctcatgcctgtaactccagcactttgggaggccaaggcaggcagattacttgatgtcaggagttcgagatcaccgtggccaaaacggtgaaaccctgtctctgctacgagtacaaaaatcagccaggcatggtcgtgcacacccgtaatcccagctatttggaaggctgaggagggagaatcgcttgaacctgggaggtggaggctgcagtgagctgagatcacaccactgcactccagccagggtgacagagtgaaaccttgtctcgaaaaaaaaaaaaaaaaaaaaaaaaaaaacactttctctcagcttttaatttttattgctgtttcccaaattattctttctttagaactgtttatcacatgacaagaccaaaagatttttctttccttttcttctttccttctctctctctctccccctacctcctcttttttctttcttgctgtctttatgtctttcttttttttaaatagagattcatggcctgtgtgggctagtgaaatacccactgggttaggggttgaaagatatggaggcaagtcccagcaacctcacttcaaactctgagtcataagataataacatgaacctagaatagctaagataactttgaaaaggaagaacaaagttaaaggataaatgcttcatgatttcaacactaaatgtaaatctacagaaatcaagacagtacgctattggcatacagatacccagatagatcagtgacacagagcgcagagaacagaaatagaccctccagtacatggccaactgactttcaacaaaggtgcaagatcagttcagtagcaaaaggatactctcttcagtggatgctgtttgaaaaaaataaataccaataatataaaagaaactttgattcctaacttgtatcatacacaaaagataattcaaaatagatcagatatcttaatataaaacataaagcttctagaagaaaacataggggaaaaccttcatgacattttgttaggcaaagatttcttaggtatgctacataaagcacaatccataaaagaacaagctggcaaattggatttaactgaaattaaaaacttctgctctttgaaagacactgttaagaaaatgaaataataagccacacacagagagaaaacatttgcaaatcatacatctgataaaatacttgcatgtagaatatataaagaattcttacatttttatagtaagaatgcaactcatattttaaaatatgagcaaccactgcactccagcctgaacgacagagactccgtgtcaccataaaaataataataaaatatgtgcaaaagattttaacaggcacttcaccaaagaaagtaagagaatggcaaataaacacataaaaagatagtcaggccaggcgcagtggcttatgcctgtaatcccagcactttgggaggctgaggtgggtggatcacctgaggtcaggtgttcaagaccagcctgaccaacatggcaaaatcccatctctactaaaaatacaaaaattagctgggcatggtggcgtgtgcctgtaatcccagctactcggggggctgaggcaagagaatcgcttgaacccgggatgcagaggttgcagtttgctgagatcgcaccattgcactccagcctgggcaatagagcaaaactccatctctctctctctctctctctctctctctctctctctctgtgtatatatatatacacacacacacacacacacacacacacacacacatctctctctctgtatatatatgtatatatatatacagttaaatatatatatatatatttaacatcattagtcattaggaaatgcaacataattccatagtgagacaccactacacacttaatggaatgtgaaaacttaaaagattgatgataccaagtgttgagtaggaactggagcaactagaactctcgtacattctgggtgggcatgtaaaatggaaatggtacaaccaccacggaaagtagtttggcagttccttaaaaagaaactctaaaatatgatttagtcaccccacttctaggtatttacacaagataaaaagaaacatatctacatgtacaaagacttgcataaaatttcatagatgcttgttggtaatgcctggcaactggaaacaagcccagcattcatcagcagtggaaaggataagcaaattgtggttgtatacataaaatatacacaattcagcagtagaaaggagtaaacttttcttatacacaacaatgataaatttcaaaataattttgctgtatcaaagaaatcctacaaaaagagagtacatactctacggtagcatttatatacaattctagaaaatgtaaacaaataaataattgcttggcagggacacatgggaggggtcaatggctatgttccttacattgattgttttactggcatatacgtgtgtaaaacttatcaaatggtacattttaaatatgggcctcttgtatgtcaataaagctgttaaaaacaatataaaccaacattagccatttaattaacacaggcccacttaaagatgatagatcaggaagtcaaagctcagagaaataaaaggactggcctgaagtcacaaagctgaagagacttgaaattcagtctcaggtctgtctgagtatacaacctgtctcttccgtcctataccacacaaacacatcttaacctcttttgttttgaaaatctctcatttcaggccgggcgcagtggctcatgcctgtaatcctagcactttgggaggccgaggcaggtggatcacgaggccaggagttcaagaccagcctggccaagatggtgaaaccccgtctctactaaaaatacacaaattagccaggcgtggtggtgggcacctgtagtcccagctactcaggaggctgaggcaggagaatagcttgaactccagaggcagaggttgcagtgagctgagattgcaccactgcattccagcctggcgacagagtgagactgtttaaaaaaaaaaaaaacaaaattaaaacaagagataatctctcatttcaaagacatcaaaattccttcaagttgtgtaatcaggatggcaagcattttaatgtatgagttcatggcacgcctgcatcttccccctcagtaactaggatctaggggcttcctaggtcagttggtagaatgcattggattggaaaggttggccagtcactgtaaatttaaaggtgtttttctgaatgcttcagaaagtaccaaaaagccattaaaaatgaaagactaatggaacaattatgtcccattttgacttgtaaaaaccaggattctttgtgtcttcagtatttctagtatttctaagatgttaatcattccaataaagctgaatggcatgacagattttcggcacctatcagagtggcagccatttccaacttcttttttattctatatactgtcaatgtcactaacatagattacatttcaattacctttttctattcactgactcacatacatttcacttaattgctagatccttccacgcagttttcccattgtctggcttccacaaccttatttctgtcacaggttgtacagccaatggtcaccacattgcagagtatatatctggtgtttcaagtgggttttagggttccccagatttagaaatatgtacacctgaacataaaactgggttcagttttctgaagtctgaccaatgagctgacatactgatagctcactgaggtaaaagaagctttgtgatacaactgaaggatgtttatactttcagtgaacgaggcatagcagcctaaatgcaaccgattgaaccacaaataatacttctcaatcaaatggccttttatctttcttgtctctaaatatacccttttaccacacagctcgttcttaaaaaaaaaaaaaatccggtggtcacaatgtcaattgctaactttattttctatttatatcgtccactttatgaatacccttttcctcaatttaattagttagtgtcactcacactttaactgggaacattgtaagactgagctgaatttgaaaacaatgccacgatgtcagactgagtcacatcaattttctaactgcccaccacagccacagcgcaactcaacgacacccacacgggtatctgcgtcctggaattggacttttacatttttattttaatgaaaatgatgtattacatataagtaaaacaacacctttaaagatggaaaagaccctttttttcaagcctcaatttcagttctagtgggacagccaggtgggagggggtccctggagaaactccaaccagcctgccctctgcagtggggaggagcctggcccctcctcctcctgtgtggaacccgagattcaggctgagcgccggaagccgtctagcagggactctggcctagcgagagtccctgtttcccccttttcttccttttcacctaataaaaccctgtcttacccaccctttaaattgtcttgcaagcctgaatttttgtggtcgtgggacacagaaccccgtccatggctgaactaaggaaaagtcctgcaacatcagaaccttcagttccgcataattaaagctcaatgcaaaagaatcatgagcataagtcctctaagagcataaataatcaagtgttgctgatgttccctaatatttgtgcgttttcagcctacacccgcacatatctaaactgttatcaatggcatgaatgagtcaagacttcagtgaggcagcacatatttcaatacaatgcaacttcgctggccacaatcaatagagtgtttttcactatgccatgctttgagtattcagcaatcacttcagaatggcagactgccgtaaaatagaggccaaatcctacccagagaaattttatggtttaaacagatgttctagagaattactgaaaattaatgtcccagtcctaaggtattatggccagttaataagtgacatggtgaaccattgtgttgcaacaaaacatagtaggtacttgccttgaataaatcaattctttattgtcatatttttgtgtctttctccagataagacgggctgctctttgaaagtaaaaagtacgtctttttgctttgtatttctatgactagcactgtggccgagctacggtgtgcagtggatggatggatggatgatggatgaatggatggatagacaaatgcatggatcaatatgtgcatgtatgcctttgtgccacatggtacaatgtaacaggagacctcggccaatggttgcaaatgctcacatgacaaatgacaatcatcagatttaccagatgcacaagttacagtcagaaataggtagtatctgataatatcaagatatataatgggacccaagaaatagattaaagactgactttataaaaatacagaactgtaagcatcagcatctgaccagcccaatctcctggcttccaagtaagaaaaccattctgaaatgttaaaggaaaggccaatcatacatagagagctagaagcagagctataatcagaaaacagaggtaccaacttcagtccaaggcttgtatcaccttaggaattctatcaagtacacactcatgaagtgacatttcctgaggaggttggcactgggaaaaacggaatcccaaggaagaacaagatttgaaggtttttcccaaaatggttataatttaagtggatttatcaagaacaatttgtatctggtaattaggtagtgattccagaatggaacaggacatgagcaccttggaggacaggacatttggcctagggaggtctgggttggtggaggacaggacatatctggagctacagagcgagagtgggcaggcagttcaggcattctccagttggcatagacgggacagaattcctacgggtgagggctgaaaaaacaacaggcacacatgaagtcgtgctctgggagttaatgagaggaatttaggtagccaagaaagaaaactaggctgatgtgaggcaacagtaagaaaaaatacgaagccacagtaggctggaccagaacactgttgtggtaaaaatggaatctcaattagcataagacagtgagcgaatggacagcagtgggagaacctgacaatgaggaattttgaggttcttgtagattcaggagtagaataaagtctgaatgctaatagtgaccaagttagaacagaaagcaaaccaaaaagacagatgcactagaaacgtgattgaaaaagacccagaagggttaagtcagggtcttttaatgcagaagttactttcaagctattaatgaacaaattaaagactacttgatgtcaggctgtgcaatggacatttctatgacggtggaaatactctatgcctgaactaatattgtatccactgaacgtatttacattgttttgtaatcatgagaaactgaaatttaatttcatataatctatataaatttagatttaaataactacaaaaaccggtggccacatgtgaagtttggcacacaatgcattcagtgtactatagagctatgaaatgcctaaggaaaaggaataaaattctacacataataagttttatactgttatattcttgatgcataattgctacattctaggccaccattgctctcaaatatactggcaccaagaaattctattgccattttcaagttgaagttttcaattatctttcctttcctgtaacattctagaaaggatctgagacaattatacaaatgtataccaataacatttaagtagacaaaaaatggagagaacatgaaatactgagagactactgaggacaaaagataaagagagcatatagaaataaaacccagaatagatgacagtttcttaagataagtcctgaccttcctagtggcctaaggagagtcaacattgtactctgtaaccgttgtattacctatagcatagaaaacttatgtgtcattcaggagaactaatatttttcctggactgaagtttgaatcacgcaaatgtctttgaatcgcacaaatcatttgcccaaatcgtgcgactctctgtaagcttgtgagccgtgagttggcacgttcctgccggaattggagaagcaaaggctgaaagaagcaggcagattgacaggtgatgtagatgcatggagacaaagaaggggtctttggaccaatggttctgttgcccccgagacccacccctgtccctgggaaacaggagacacccccatccttgatagtaaccccctcctctcttcttatattagctttagttggttctgttcctgtcaaccagatgagccttagtgcagaggggaacatcttgcaggagttgacgaagagcggagcagtgttagtgggtgatttcctcagcgaccacgttgtaagaggagattgtgcatctgtttctgtctctgtttcttgcactgcccgttgctgtgagttgagagtttaaggctgaggcacattcagcaagggtcatttacagaacttcaacagcacactcaccagcccctttcccccccacaacgtgcaaagtgcaatatcacccatattaaattgattgaaagttaaatttttgtcatggattccatgataccactcacgagcatttgtgagctacaagctgaagacctacccgtcctgagctgaatcgagaaacctaagcattaccttcaacgcctgcctgcccttcctccacacgaggcccatcacgagtcccactgaatttggtctttcacctctcctcttgcccctttgcaaccattttcctccctccagcaggagtattcttttaaaaatgcagatctgatcatgccacttctcttatatgaagcttccagcatctgacttccaggactgcatcctccagggtgggcttgctgggccctgcccatttgctggtctctttcactctcctccagccactctggtctctccatgctacagacatgctttgctctctcctgtctcaaggttttacctcaagttgttcctttcttcccctgtcctgcctcacttcctccgtttcttccatctcttatctaatctgtaattatatagctgcatggtttttcataaatatctgaaacccccactgaattgcaagctccttgaggggaagaagcttatctattctgcaaaccgttgcttctccctgtgacgcagagcctgcagtgtagtagatactgcctataaaatggacaggatgcttggatttgctttatctgacattttaaggacacactttataaattgtagaggcctatgcaaccgtctttgtttttacttagaggatacaaattatatcattcaacaggatgccacagttccatatatttctcaaaatgtgaccagatgcaccatttttaatgaaaattaagctctacttccaagttaagggaaaattattttaagctattgatacaagttttaagaattcagtaatttaattgtgcatttctatgtgaaataaaaacaggaaacttattagggtgttttctgtaatatgaataattaatatttgcaatttagaaatctatctccctacaatgtagctgtagtctcagaaggaaagtgtattaaaacaatagctaaatgctttcaattcaaagtacttggtattaaatccctcaggcatcaaaatagctctgtagtcttttctagaatagtatgccaagcagtcttaaacacatattttattggcatcagaaaagcaactgcaaatgttttctcttgtattcaaactcctttaaaaaaaagattccattgctgagctctgacaaatatgcctcctactaccacaccaggttcctttgcaaacacacaattcacaattaaaagcaattttgtaaaatgccttggagtggttaaatatgtaattgggtaattttctgaaatgcttattacttacttcagcctcatttcagtctcactggtaaacagtatattcctgttaagtgttattatccccaaaaacgcttccataatcttcagtgttcctttaacattcctataaacacatcatatattacttggggacgtggatcatgaaacacagaagctacccgtgccagtcccttatttaaatggcaaagtggtcttccttgtctctgaacccgggttttctaaatcattcgcatagtggaaaatgaacaataggacttttaaacctccttatgatttagattatatcttagctggttgcaaatctcattatcagctttacagcttgatttatttttatttttggatcagaaggaagaatggcaaaattacagcctagacgtttgctttggaaaataaagtttgaagttagctgttgttgatttatacccagtatgctatacttagcatgagtgtacagttaagcatactttataggtaattactccttctattgatatgatgatagctacagaagctgtgtacaaccgagaacaacacccaattcttgaaacagtaccttctaaagtggtatattaggcaaataaagtgtgatgatggtggtggtatttcatccaacaagagatattagataaataaattgtgatgatgatggtggcatttcatccaacaagaggtcttactccctctgaaaccaacatcttttactacttgcttagttatatatgaacaataaaaactcaccaagatcactgattttgttgaaatgaagagaaagtaaacagtctctaactgaaacgagcatgttcaaattaaaatagggagtaacaaatcaaaaacaaaataaaacaaaatgctttgaattgtttttgaaggcaaagtgtcccaaatacttttacttctatgctctattattttaggtcctacttttctacaccataacacagtattttaatattaataaactagtttccctctatgttaataacagagatcaattaaaatttggtctttgtcattttgcagttaggttattttaactcacaatacaacatgtacagttcttttattctacaaaaatatatagtattaagaaaccaaaaccattttaatcaaaatttctgctatgacttgaagactacagaagcccctatttttgcctgttgttcccttgataaagtattgatatggaagtctcaattactaaaacagaaaaaacttatgcctgctgtcattgaccacatttttttttttttagacagagtctcgatctgtcaccaggctggagtgcagtggctcaatcttggctcactgcaacctccacctcccgggttcaagtaattcttctgcctcagcctcctgagtagctgggactacaggtgcacgccaccatgcccagctaatttttctgtattttcagtagagacggggtttcaccatgttggccaggatggtctcgatttcttgaccttgtgatcctcccaccttttttgttgtaaaataatccttgatatgctttatggacaacccctccccacggttccacagaacacagtttgataaacatcaatctaaaggtactgcagagaggctgagatgctagtgtgtcttgcagagccattaggaggcactgtctccacgtactgatttgattgtattttttcatgctgagtctgaccaatttcatggattcagtaaatagtaagacttggtttaggggccagcagacaaggatcataacatctttgaggtggaagaagtcctagacatgaaagaggttttgtgaataaaaggtggagagggaaaatgaactttacagtcaggcagacctatgtttacatttagcttctgagagccttagtttcctcatctgcagaaggagattattagtatcaaccacagagaatcactgtgaggcttatatatggtaatgtacgcaaaaggcctgccctagtatccagtagctagaaagtaacgtgaccaaaataaccaggttaagttggggtagagtcaggattagcctcacgacttatagttcagtactatttctaccatagtgatctaatttgaagaacaagttagctaatgagtgcatcttgctgtaggtccaaaaacaacctccaagacaaactcagcatttcccttacaacaatcagcatgggccgggcacggtggctcatgcctgtaatcccagcactttgggaggctgaggcgggcggatcactaggtcaggagatcgagaccatcctggctaacacggtgaaacgccatctctactaaaaatacaaaaacaaaattagtcgggtgtggtggcgggcgcctgtagtcccagctactcaggaggctgaagcaggagaatggcgtgagcccgggaggcggagcttgcagtgagccaagatcaggccactgcactcccgcctgggcgacagagcaaaactccttctcaaaaaaaaaaaaacaaaaaccaatcagcatggcagaaaaaagaacgctccgaagcaaagctgcaagcattaactattgtacttctgatgcccatctaaagacacacaggaaatttgcttagaaattataacacggtggagaagtaaacagttagaagtcactctcaactgaggctgtttaggtatttgtaactatgttaccttaaaggttactgttctaataataaagttgtcctgtcctggctgggggtggggggctgggggtgtggggatgggagtgcagggaggtaggggtcttccggacactgcatcaggggaggtagcagcccctcactcaggtgtgactaggctgggataacatggatactgtggtatccctagagtatccatgttatctggctttagtgatggcattcctgaaaatgaaatgtgtatctgaaatgtgctttctgttaagatgtatcaaaaatttatgttttcctgaattttaaaactgactggtttagaaaaatgaatggatgacttcattttttctactttgttcaaatctagtctaattaagttttttttttttctgcagcgtaagacatgagttatgtcagaaacaagaggttctgatatttgaaatgactaaacacgaagggggctcccaagggaagttagggtattccttctgaaagtccttcaagacagggttgatttttaagtgtttgggatggctcaaatgcatctgaaatagattaaaactgaaaatattagtgcatcacatatagtaggaaagtattattttgtgaaagggttttcaattacatgcgtgtgtacattttatatgtttatagctcttgatgtaaaatgtatctctttccataggtagcagcaacgtaactttgaaatccactggcctagatcagtgctctccaaaattttggtggaaaacccctattagtaaaaataaagaattgattatgaataccaatactgattcaatgcaaatactgcttctattttatatacatttaaacacatggaaaacaaaagatagaaaaacaaaaaaaatttaaaggaggatataaaaagtaaatcaaacacagaaattataaagttttcttcctgtagcccaatgaaccatagtctggagtccacttcttttagtgtagctcccaattccattagaataccgtgaccccaatttcaaactacatatctgtttaatatcatacttgatttcagtccacaagcacataaatgagttttattcattactcatctgcagcctattcagaatacaaaattttctggaaaggacttagaagttatactaacaacccagttaaagcagcctaccaatgctatcagtgagaagagaaaaataatacagagtggtagcctcagtaatgccgctatttatactcctacatatacctctttctgaaaaagattagtttagaaaatctggttttgtgcaatagatctaatataagaattttataaagaactatcaataactttccaagttatttgttttcacaagcacgtatttatggaacgttttacatttcttataatgttaatccctgattcaaaggaattaattattcctatatcaaagtattaatgtagaaaatgtcaaaaagaaaataagatttttacttttcaactatacaacttcaattaaacctacatcgcagcttcaggtttcccgtgtgagtcacgcgtttctagaatgcattctaaaactggtgcataggtttggtggtgactgggtaccaggtactgtgccagtcatttttatataccatctgatttatgacctctgagttcagaattctcttcattttaaaacgaggaaatcagctcgacatccagttgagtgggctggtcaatgaattggcaccatctgagtacagggtcctcactttgcccaaggttcctgaagcatgaacataaccaagcctactccttggaagctgggctcccagtacccctagaggaatatctttttgacagaggctgccagatgtccgcctaaattcctcttttctctggttcctaggcctctactcaagggtccattactgagactccctcgaaggtatatatagccaaatgactaaggcctagcttaaggatcttaggggtgtgtgctatttctgggctgggattatatgaaagatgcatgcctagtttataatttcattcccctctgccagctggatcttggatgtggggattaagcttgaccatggagatatggaccaggcccagtgggataataaaggcaaaagatacaaatgcccctcagaagataaccaccacccacctgaaacgcccaccccaggcaagaattatgctgcggttgtgtgtgagccactgattacattgttggctttactgtaactgttggcagtttagtccacaataactggacgcctcaggtcctgacaatccatcctgggagagccagggactgagacatgaccacaaatgctgtcctagccacctgcacccccaagaagatgcttgaatctttacatttacaaagcacaggaaagttaggaggatccatcctgaaacgtctgctagtgagtctagattttcaaatcagaaaattggcagaaagagccctgcattccccagggacactgcgttgaagctcaggaaaccagcccacatggagcatggggaagggcttttgggaaggctggaggacaaggcgtgtcttaggaacacccagtagcttaaccgcagggagcagaacttacatacagagggctcacgttcaataggccttttctgaacttgggggtgctgagtatttaaaaactatttcagaattgagaaactgattgttataggataaaatgtgtacccccaaattcatacattgaagttctaaccccagttcctcaggatgtgactctatttggcaatagagcctttatttatttatttatttatttattcatttatgagacagagtttcattctgtcacccaggctggagtgcaatggtgccgtctcagctcactgtaacctccgcttcccaggtgcaagtgattctcctgcctcagcctcccgagtagctgggattacaggcgtgcaccaccacgcccaactaatttttgtatttttagtaaagacgggatttcaccatgttggtcagtctggtcttgaactcctgacctcaggagatccacccgcctcagcctcccaaaatggtggcattacaggcgggagtcactgtgcctggccggcaacagggcctttaaagaggtaacatgaggctattggtgtagatcttcacccaatctgactggtgtccttagaagacgaggagatgaggacagaggcacagagggaaaatagaccacaggaggacacaggcaggacgatatctaccagccaaggagagaggcttcaggagaaatcaaccctgctgacaccttcatctcagacttccagcctccagaactgtgggaaaattaattcctgccgtttaagccacccgggctgcggtattttgtaatagaagcctgggcaaactgagacagtagttgatggccgggcgcagtggctcatgcctgtaatcccagcactttgggaggccgaggtgggcggattacgaggtcaggagatcgagaccatcctggctaacacggtgaaaccctgtctctactaaaaatataaaaaattagcctggcatcatggcgggcacctgtggtcccagctactcaggaggctgaggcaggagaatggtgtgaaattgggaggcagagcttgcagtgagccgagatcgcgccactgcgctccagcttgggcgacagaacaagactccacctcaaaaaaaaaaaaaaaataaaataaaataaaataaaataaaataaaagcactgctgtgcttgagccacaagaaagagctgtcacaggtagcagcttgggggagggatcaggagtgatgctgaggaagtaaataagattacttctttgaatgctgttcttattcctccttccttgtgtttcaccactgccttttgtacagtgttttcctctataaatatataattccaagactggtgatgtctagtaatggttcaaaaagcagaaaatataagaaatattattttttccaaacactcgagtagaatcagtgatggaacatgtgagatcacctggagggcattcagactttactgcaaataaataatacaattacttggtttgggtattagatatttatgttcatcttgacattagaatattaagccactcctcctcttgctaacttggtatgcattgaaaacatgaaattctctcagtctcctgctttggaaccaaacagtataaaccctcataaatatgtaaatcaacccctctaagcacattattaattatttcaaagatagtaggaggtcactagctcatagcaatttctatgcatgaagtctcagtaacacaagacatcgcacagggaggaagaataaagttttatcacagttaccgaatgtgtgtgtgtatgtgtgtgtgtgtttgtatgtaagtggccaaagcaacatacagtattgaatgcagcaccactaggctctgaatagacgcctgtgggtgatgatgatggcggtagtgatgaaggaacggaatctacagctagaacagtatttttttttgaacctgtctgcaccaggaataatatttttaaaatccaaagggattccagcctcagatacacttaaattgttcttgacccacatggccctgctttcttctggaataaagttctgactagttgcaaaaatccatagctcaggaagatatagcaggcatctcatttcctgtgacactgcagagatcacagactgtgttgctcaatgtgtctctaatgttgcatattgccgagcggctctctggctgctgtaagtcagcttcgtttaggtgattctcagcaatcgacatgttctgatataggccgtggggctcgctgaggtggaaccacccaaaacaccaaatctgaagcagttgaggacgttggatacaacactgacagatgatggaggatatttaacacaggcaatgaactctgctttttacaattcatcaaacaaatataagacgcactctcaccaaagtgcaataaactgatcttgtcatccaagcaattcttcccagtcactagtccagtttgcttttaaatctctgattgtaagcttaaaatttatctgatgaaaaagataataaactattttcacacccaataacacacatccctcaacccaatgaggaagacagccattatctagtgtaattaacaaaatatatataacaaaaataagaatgaaaaaaccttgaatggaataatttgcacatatattcagaggttcaggactaggagtattactggaatttagatggttctggagagggacatttggcaaaacctttcaagcactactagtttgaaagttaaaagcaggcaaaaacttgcattatttagggttgtatatataggtggtagtgctacaaagaaaagcagggaatgataattattaagatcagatagtagttatatctagacaggcagaggaagcggctatggaggagatcacacggaggcttctgggctgctggctcacattgtgtgatccaggtggtggttacagaggttttctataactatgcaaatctataactatacaagtgctataagcactcttgtgtatgcataatatggctcataataaatttaagaatacatcaaaccatttaaaatgatatatttaaaggtcaattagtattttattgactacgttagaatcctcccagcctcaggaggtgcccactctgatgacaatgcagaatgcatacattcaaaaattgtgccaactgctgacgaggcagggggaaagaattcaggccattctactatctgtttatctatctatcatctatctatctattatcaatcaatcaacccatccatccattcatctatccatttatctatctgcacatacacactacacaaacacacactaaaaagaagaagaaatcctaaagacagctgttttgagcaacttttgtagctaccttaagtactgacagacatctttccacatttctttgcataagtaataaatttatagctaaaaattgtttgtgtttgccctcataaaacaaaggtagaatgtgctttttaagagtttttggcagaaatgggtggaaaaaattatttttattctctctgctattcagaacattcccaccttatttttgctttctcaaatgttattttatctttaaacacttaataagatgcagaaaaagaagaagaagaaggggaaagaagtcagtttggagagtcgaaattcaaggaaagtaagaactgggcaaagttgtcttggcgttcctcccagagaggaagggagtgatgctgctggagctgtttcaaacggacggacggaatcacttcatctgtaatccagacacatgcatgcatcaggcaaacataaaattctgttgtcttctctgaagtagaattctataaaggcagcatttccaaggccaaaaagatgaccgaacagacagtgccctgttgatccagctagaatgagctctgcaacaccatcaattttgtcctacagctctttttctggtccttgtccgtgtaccagtcactccttataatgaagtcacttgattgagtgttgttcctgttgcaagcagggagaggaaagctgagaagccattcaataaatgttatgtttcgccctcctctccaccagcgttagagactgctgtgtgttgacagcccgtttgctttttctccttggcacagggccagatcctgtttcctcccccatcctttctactccctgagcacacacacacacacacacacacacacacacacacacacacacacacacacggcgtggctaggcagggccatgtggctgagttctggtacaaggaacgtggaaataagtgacatgctccatttgcaggcctgggatctaaacctgagtctccagtgtggtgtgctgcttgctcttcctccgccagctggccccatgaagaggatcgagctgagacacaggggctgctgtgggtgacagaaccagaagatggcaggattcgggtctgggtccctggataacggagtggagcagaggccccttggccaacccacactggaccatgacatgaagggaaatcaatcttgaccctgttcagccactgcgattccagtgttgctttggttagagaagttagactattaccctgactttacaccgcctcatgcatccaaatcaaaggaaaactgtcaaaattgctaaatcattcccaaaaataaaacaggaaggagtttaaactccgaagcttaggaagtttgatttaatttcaatcaatttggaggcagaaggaactttgaacttggactacaagcacatcaggagttagtttcaatgtggcttcaatcctggtgccaccattttcacagtggcaattataattatacaaggtccaggagctagaaagagaatggactgtctgtttcagcgaggcaggcaaacagacaggcagacacatggagattgcatgtggataggctctgggtagtttaacattttaaagcttataatacggattgccaaattgctttatggaaatatatgaatttatattcttacctcttttgaatgtgtgtccatcattttatattttatgctttaagttagcaattcttttttttttaagacagggtctcactcagtcactcaggctggagtgaaatggcacaatcatggctcactgcaacctcagcctcccaagctcaagcaatcctcccacctcagcttcccaagtagctgagactgtagatatgccccaacacactgacctaatttttaaattttttgtagaaaaggggtctccctgtgttgcaccaggctagcctcaaattcctaggcttaagtgattcacgtagccctcccaaagtgctaggattacaggcttaagccagggcacccagcctaagttagcaattccgtagcaactaattatgttgaatttttaatatgcgtgttggccatttgcatatattcttttgtaacgcatcttttaatatatttacctagttttccaatgtgttttaggagttatattaacatgattatttgtatttaggagagcaatgttcgaaaaccaaaaaatattccttcatattagattttatgttttgctccctaagtaggtgtctgcaacccaagtttcttgactccctaggcatcgagaatatctctgtatctaaacaggatcagaactgtctgtctcatgctgcactatgactgacaacaaccaagaagcataacggactatagttggtgagctgagataatagatggaaagggaattgcattctaagttaggtgaaaactagaattacatgaaaagtgacctgggagtacaacagtaaaaacaaaaaacaaaaggcaaaaacataaccgatggacttgaatggtactaatggtgaggctgatggcatttcatagggaaggtgggaaactacttcctcagcccctagagcaacagaaaaatctgtgctaccagggcttataaaggacaagaagtaagtgcattttgcatagtagccatcattctacagtagcactctcaacaaatcaacctaaatacatgaagctccaccaagttgggtgagtgctactcagttttaaaaggagatgcagagggtgcttcatcatttcaaaacaattccgagcatagactactagtaatagctggcagcaaacctttcaggataattaaaaagattttaccaaagcccatacctttaggtaagagtttgtcagaggttctggaaataggctgttttggctatgtttgtcaatcttattttcaacttcatcaaaatgtactgaaaaactcatgctagctagcaagtcaaatcactagagattacatagacatgggcagagggagtatttttgcatttatgaatgctacagactcccattgaaaatgccttcttgcttacagactgcccaccccagagtagttcttaaatatttaaacgtgggaactttaacaaaccatgatgcctaacctaaaaggttaccatttaattggtctgaggcatggccttggcattgggatctttaaaaacttccatgtaactgaaaagcatatctggggttgaagaccacagcctagggagaggcagggcagcagagaagcaggagtacggagctctggagccaatcgtatctgggttaaactctcagctttcctcctcctaactctgtgatcctggttgcttaatgatatcgagcctttacttcttcctctgtacaaataagaataataatttctaccttatagttgttttaaatatgaaatagtgctaataaattagaaatgttcttttcttgaccttcttcccatagaactttcaaaggtatgatagtttaactgttgaggcaggcttatctattcacacagtgattaggaacgcaggcgctagagccataactctctggctttgtacaccagcatgtgcaatttaatgaacttctgaggttccattccttcatttataaaaatgagaagaataacaacatccatcctaatagggttttctggagattcaatggaggtttatgagtaagcactaagaatggcaccatatttatagtaagcgctcattaatcattactcgtttttgaattttagggaaataaaatttcatatcctacccttagaaagtataacacaatatctggtcaaagaatgagttcacactaggagagcagggtttctacctggatggtattttaagccagttttaattattcaccatcataattttgtcaatgaaaaagattggttcattgttgcctggccataccttgaagaatgtataaggtgtttagcttaagaagtttgaaagagacacaaaaaactagacgatggaaacagaaaagaacatcttattacacacatcttgatagcaagaggtattagatatttatctagaaatgaatatatacagacactgttaagacgtttggtgcatgagaccagtgtaatttggaaaatggtttgctaactctacggatattctcatatatatatattatatatatgagaatatatatataatatatatatacacaatatataagagatattttatatacatatatatctatatatgtatatatagatatatatgtatatgtatatatgtatatatgtatatgtatatatgatatatgtatatatgtatatatgtgtatatatgtatatgtatacgtatatatgtatatatgtgtatatatgtatatgtatacgtatatatgtatatatatgtatacatatatatgtgtatatatatgtatgtatatctagttaacagtcccaggggtttaaaaattattattatggtcttataacatctgtattcaaattctattacatgatttcctaggctaaggagacactaaataatgaatttgggggaaaggaccatttgtatgggctaggggcagggtggagaggaggtgagggctatagctgcatttatggaaaagcacagaagatcctggaacagtgccatgcatgggacatttgcttcttccacaggttgagtggtgactatgccaccccagcaggaggagtcattccaatttgtggtgatcaaagtcctttggaccacaccaagatagaaatacaaccaccaaacaaattcaaagaacatatttaccaataaatctaccccatttgcagcttcattcacactcctaagttcaggaaaatcaaggaatggattggagctatggattccagtaccagattaatccatcttttatgattagatagaaactttatcattgaaaggaaccgatggctttagggataaaatgtcctttgattgcataaataaatcttgctttaattttcttggaggaattacaatccaaaaatagccagtagtccccacgggggctcaaaacaattcgcacaggcattttaagctgggatggtggagaggttaatggaccactcttcagagaaatcagcaagggccactcccaagattccatacgtcaaagacaacactggggtctgactctggaggtccagccattttatacaattagaattgctgaggaggtcagccaagaacctccagagaaacattccacagcaccaggagtgcacgatcagcaacgtgcccaaagtgcccatcgtgttgtcaggggctgtgctgcatctgaccacagacaggatcaggcatggactctgaagccttcccgtagcagtccagcttccataaagctgtgctttcaatacattatttgtttctttacagaattaactgtcatttctgttttccatacgtattattaatatatgttatttatttatttattttttgagactgagtcttgctctgtcgcccaggctggagtgcaatgatctcggctcactgcaacctccacctctctggttcaagtgattctcctgcctcagcctcccgagtagctgggactacaggcacctgccaccacgcctggctaatttttgtattttcactggacacggggtttcaccacgttggccaggctggtctcgaactgctgacctcaggtgattcgcccaccttggcctcccaaagtgctgggattataggcatgagccactgcgcctagccaacatatgttatttataagattcatagacattgatataacctttagctccaccacagaagaaagctgtgccctgggagtaatatgggttccatcagctcttgttcctgataatctaccattttgatttatagtttgataagctttgatcctattctttcctttcctttcttttcttttttttctctttttcttttcttttcttttttttttttttttttttttgagatggagtctcgctctgtcactcagtctggagtgcagtggtgtgatcgtggctcactgcaacttccatcacctgggttcaagcgattctcctgtctcagcctccccagtagctgggattataggcatgtgccaccacacctagctaatttttgtatttttagtagagacagggtttcatcatgttggcctggctggtctcatgcctagcctcaagtgatctgcctacctcgtcctaccaaagtgttgggattacaggcgtgagtcactgtgcccagactataaactttgattttctatttctattttgttatcattttattttatgtgtcttgttctatgctccacgaatcaaggcaaagccaaataaaccaagaagagagatcaccagatagatgggtaattggctgatttatgcattgaattataggaaatcccaatcccaacctacaatgaaagaatgtccaaatgcatgtttctctgtaaatatacacatacatgcagacatagacacaaacacaatatgtatatgtttactggagtgcatgcttaaatcacaaccaaaataacaaaagccagtgtacattgcgtgcctactgtcttcagcatgtaccctaaaggtacttcataaggcattattttaatgtgtccacataaaatgatgctaatgcattatccccattttacctaagatgaaatcaagtcacactaaggtgaagaaccttgccctgtattatgtatatagtaagattcagagccagcatttgaactaggcttttctgaggtgccgtatataaaccaggatttgtgaaaaatggttcactggtttatgggggtaatattaggacttacacaggtattatgcaaaaaatatgaaaagaattgacctccacaaagacttaatgtacagaatgatatgtgtaccatctcataccctagcctgtatattggatggtcatatgtcatgtattgcaaaggggttatcccaagggaacagggagtcccacaaccaccactggagagtggagccctctcttgtcagtcacctttcagcagaaggtcatctgtgcttggctaaaagaataatgaataacttatctcattttaattaaattaaccctattaaaacagataggtgacttaaaaataatccttcaaagaaactattaattaaagatagaagtaataatctaaacatgaggaaaatgagaaaacggcaacactgacgatgtcggtacatacgtgaacatcaatgtgattataaaataggctccgagacagaagctaacgagagtagggagccattatatttagcaagacatttaaaaactaagcaagtaataaacaaaatgagtgtctctgttgagcaaatattaaagaaaatccagtttgttcttgacaaaataaaatctatgacatctgaaagtttctctttgcataatatagggaaacattgtaattggatatacagtttttaaaaaggctgaaataacacatgctaaacaatcttgtgacaaaccgaactatattttctcatgagtgagtacttacggagatacatactaaaacatggctgaagctatgaagaaacagggatggaaccgaaccatgccatgtggaagactgactacacagttgaatggcagtacagttgtttctagcctgtctcagcttctggttactagttcattttttaaaatagcaaaacacacaaatatgtaactttagcacttgtagttattaaacattaaggaaaagaggtgccagggaatataagttctcaatagcaactggtattttaaaaaataaaagcaaatttctatgagtattatatttaagtaaccagtgatgaggtggccacattcacaaaaaatgtgtagaaggattccaaagaaactttgcaacgcaacatctttccatccattcatccctgcctcactccctattaaaaccaagaagttgaacccaagagtgcataagattctgaggatggcattggcatactgaatttaaaaataaaagtctaaaaggtgtttaaaacacaattaatatttagtagaatccatataatgcattttaacaacatagagcttgaccacgcaaaattcttttcaaggaggttgttagttatctcgtggcaaagaaccaccgaaattaaagttaatttacgcacattctttacaagtgacccaactttgctaatcttttctgtatctacaaggggctgtcaacagtgtgctatacagaaaatatttttgaaaataatatatgtaacctgtccctgaaagaaaaggtgatgttttcaacatgactgagaaaaagaaacaccaaaggatcctaaacacatgaaaagatgctcaactttgtttaaaattaaaaagaaacatacagccaactacatagaataacatttctcaaatatataattagaaacaaagcaaaagccttgcggctcccctgttggggaggaagtggagagcctgatactgcactttgcaattgctgatgggcatggaaagcgcaccactactgggagagaaatttggaaacagtaaaataaatacacattttccctttggtgcagtaacccctcttctagggagcagatcccagtaatactctgacaacaatatgaaaatacgggtgcacacaagtctattagttgtagcaatatttacagtaaaaaaatgaaaacttagtgtttgccagtaaggaaaaagtaagctatacctacacaaaggaattcaataatgctatatatttttatatgtaagaaaatatctatatcggactagggagtgatctttaaaatataataggtactatagagtgaaaaaagcaaggtaaagaaaaatgtgtataatctactttctacttaagaaggtgacacatctataccatttttgatatcatctatagtatgtttacctatttttaaaataggtgattgtttttaataaacgtttacctttgggagagaaaaggaatattatttacctttatttatttattatttacctttgggagagaaagagaacgtagataaagggtgtatttctttgaatatagcatgttttgtagcttttgctttggaataatggaaatattttacatattatgaaaacacaataaatttaaaagcaatgaaaggccaggtgcagtggctcatgcctgtaatcccagcaccttgggaggctgaggtgggcggatcacctgaggtcaggagttagagaccagcctggttaacatggcgaaaccccatctctactaaaaatacaaaaattagcagggcatggtggcatgcacctgtagtcccagctacttgggaggctgaggcaggagaatcacttgaacccgggaggccaaggttgcagtgagccgagatcatgccactgcactccagcctcggcgacagagcaagactccatctcaaaaaaataaattaattaattaaaaaatttaaaaaaaagcaatgagaaatacatattcaattgatgacataactatacattaacttatatgagtttatatccctataaggatataccctaatgacaaaacaaactgcaaaaatcttaacattgttttcaataatcacacttaggtgatggtgtcgatactgtaatactgatactgttgtgggtgcattccaaagtaaggcaaatgagtaattttgttggtatcactcagtaacagaatttttgccaagggtgaaagaaacaacagttgtaatattggtgacttttcaatgaaaatttggtaacactggatttgaactgaaaatgttagtataactaatattgcatttgtacttaaaaaaaaaaaagtctcctagcttattccactaggcctagaaacagtaaccaacatggtgacaatgagcattccaagcaccaagacttttaaatactatttcctacgaaagggagccagaggtcctgagaaaaatggctgcttgcaggtcattcggcgagaattacaagaaaggtcgagagcaccttggtacactgcaaatcctgactaatgggtgcaggaaggttcactgtagtatttttccttacttttgtatgtttgaaatcgtctaaaataaaaagatacacattaaaagaaaatgggttcaaaatgaactgataactaaaaagatagagtgtgaagggaagacttgaaaatgtgtgtttagaaatgtttctattgtttgtggctttgtgaaggcagaaggcttaccaaaacaaaattgtcacattaaaagcattacagagttttccaatctgtaaataataaacttcactagattttggatgcttttgttaaaaagaaaggcacaataactttcaacaagttttccttaacaatatgttaacatatattatgtgaatcttagttttaaaaatcattgcattattggtagatatgcttaaaagtgagtatcataatttacaaagtcaacaaagaaattaatttattccatttggatctttttatcatttggaggtatatttttcagctataattgacattaaaactaaatcttgaaataaattgaacttaaaacctcaccattgagtcaaggtatcccatagtttcaaattaagttttgaagaattaatgaaacatatttagtcacattgcagtcatttatacatagagagagataggaacttttacttcactccaggtacataaattacctcaaactagattaatgacctaaatacaagaggtaagctattggtagaaaatatggaagcaaatcatcatgatctcagatatggcaatgaagtcttttgtttgacacaaaaagtattagcaacaacaacaaaaacagataaattgcatttcatcaaaactagaaacttttgttcaccaaaggacgttatgaagaaagtgaaaagacaacctatagaatgggagaaatatgtgcatatcctatatctggtaaggatccagtatccagaatatataaagaactcttacaactcaacaacaaaaacataactcaatttaaaaatgagcaaagaaaggacttgaaccgacattcttataaggaagagatatgaattaagataatcaacatcacagtcattagagaaatgaaaatcaaatccacaataagacaccacttcacacttactaggatgactagttagaaacagtaacaagtgacgacaagaatgtggagagagagaaacctgggacattgctacactgctggtggcaatataaaacggtacagcagctgtggaacacagtgggcagttctcctaaaggttaaacttcgaattctgcttctcggtatatatccaaggtaaatgaaagcaaatgttcatacagaaacttatatatgaatgtttacaacggcattattcataatagccaaaaagacggaaacaacacaaatgcccatcagcagatgaatggacacacaaattgtggggtatccacacagtggaatattattcagccacaaagaggaaagaaatattcatacacgctacaacttgaataaacctcaaatacactatgctaagtgaaataaggcagacacgaaaggtcacctattgtacgatttcttttataggaaatacctacaataggcaaatccatagagaaagaaagtgattggtggtggccagggctaggacagggggtcacaggcagtgattagctgggtaggaggtgttcagaaagttttgaagccaggcagaggtagtggttgtgcaacattgtgaatgcacaaaatgccactgaattgtacacttgtaaatggttaattggttacatgaatttcacttccattaaaatgtatatatgtaataacagtatagtacaagtaaagggtgctttgtaatgtgaaaagataaaatattaagtagttcaggtttatctcattctgctttctttttcacatatgttattttatatatattgggtatgtgttcaacattttgagtgatagaggtatacgatttaaaaattaggtaatactgctctagttccacggtaacaaatctagaacatggagagtgactctaacccacagaaaaacttagtataccttggctgaataatattgacaaacttattctcaatgcctttatgcaaataatgcattttccagttcaacacaattccttcattccccagaacttttatcttttgcgatccaaacattaatgtttcatatccagcaatgatcaaatttaaattcttctgctagggtttacgtatatctaagccagttttacatcaataattgttcttctgttcttcattagcattagagatggagagaaaacatgctagacttacccacacaaggcagggagtagccaagttgagggtcgtgaacaaactgccgatcattgagtcttgtcacacagtataagtggaaacagtctaagcaaatcacgtggcgggagttgcactggaaaaccaggacggggctcctgcagagagaaaggaagatgtttcctctagtacctgtcagtgtggaaaggcagcacgtgctttagaccaatttctgtaatcctggagggttgtgtagactgtgctctgtgcaaagaccggagctgctaagcattaagctcatgtataccaacacaacatcttaaaaattggaggcactcaatgaactacatagaaaactgattctcctaattttacattttttatgttaacacatttatcaatcttttgattaaacctgagctaaaatataatctctttctggaagtcttccctgactcagaattcccaattaacctatcaaatcatcccatctgcttgtatatatttctattgatccgttattacaccacagtattcatatcttctcctttctcatagactgtgatctcctggaaagtagttcctatgtttattttgctattcccatagtaccaggcattgtaaagttttaaatgaatgttttaaaaatttaaatctttaaaacattttaaatatttttttcctccaaagtattttaagggaatcaaaaaaatttaggacttgtatatagtgatttactagtaatcccataaacataattagagaaaattcaacagtgaaataacagattttcaaaattctgctatcccacttattttaaagcaatatgtaatacaaaacaaagaaaataaaattccttggtaatttaattataactatgttataacaatagaatctgaatttccccactatcaaaagaaaaattactattgcatcaaagtaaaaacgttaaacattttctcacattttattggcaaataaaaaagtagaatttagggataaaaggttatccaacagggattcttctactgcaagattttgtctattgtgccatctcgaaaccatccaaatattcagtttctcagagtatggttatgggattactaattaatcaatatatataaatcctaattttttttatccctttaaaatactctgtagaaaaaaaaatcttaaaagccatgtatttttactggaaaacgaaccacacaagtttatgtcaaacaggagacaagctcaatacatgaatttgaaatcagccccaaggcgattttaatagtaagaaagttattggagtctatttagataagcctatttcctatgtaattgtaacaaaatacaaaataaacatgttcattttatacccaatctttaacgcctataagagctcttcaaaagccctttttctagagaaatgaataatactaataatataaaagataatttcttaacacctaaaagattttcaaaattctgttatcccacttacttcaaagcaatatgtaatacaaacaaagaaaatacaattccttggtattttaatgccatggatgtgtaagtaatcggtcaacttaatctgagcaagggcgcacctaaaggtgcggcttctcctttcccctcttggaacctatccaagtccttcataatgctttcctatttctaaccaaacagtcactcgcatacacatgctcaagcacacacatacttttttcactttgcgaccctatgaagctgctgtattctacctttttctctcacagctgttatgtgaaaaatattctccatcttgctttcagcaacatggtagactaaaacctttatagacctcccaatctgctactaattcatggagaaaatattagaacatttatgaaaatgtgcctgtatataacaaagttaaaaagaaagcttagaggccaggcgtggtggctcacgcctgtaatcccagcactttgggaggctgaggcaggcggatcacgaggtcaggagatggagatcatcctggctaacacagcgaaagcccgtctctaccaaaaatacaaaaaattagcccggcgtggtggcgggcgcctgtaatcccagctactcaggaggctgaggcaggtgaatggcatgaacgcgggagcttgcagtgagccgagatcgcaccactgcactccagcctgggctacagagtgaggctctgcctcaaaaacaaacaaacaaaaaagcttagaaatgaccctgtagaggaaacataaagaaaacttacagagcctaaatggtcagcccacgaactcccgccacagtggcccagaaagccatggctgcgtggtatgcggccatcagtgtagcttctgcaggcttttccattcctgttagaagagttctctctcacatggatggacaacagcacacttctatagttgtctccttcagttttaatatgatcccaaatgactcataccatctagacaacacatggaacatcaattgtcctactctattaatgacatcctgctatttggagaacattaacaagaaacaagcactacgttggcggccatggtgtgaaatcaaccctgtgcagtgacaggagccattagggacattagggaaagtttagaggtccaagtcttggggcctggaagtgcacaccttccaatataaatagtccatcttacccatcctgcaactggcagtgaagcatagacagctgcagatgcggtgggtccagagttttggttcccacagagtgaagtgtatcttcctagggacacaggaagagtcctactgaaaactaagctacagctgcaccaggccacctcaacctccttgaactgaggatgtctaccttgaataaaaaataggagaaattggcaccaggtaacagtgggttaccagagagtgagcagtgaagggactagcattggaagtgaagacagagactcatgtaactcccttgaagaaacgccactgcccagacgcaggtgtggaatgcaaccggggaagctggaatgttgtgtgtgtttctgcatgtcctcttcggaaaagaaagaaatttacaagttacagggagtcaaaaatgataaatgagtcattcaggaattctgattgtctattactatacatacacagtcaacttggatatatacctatatacagatatagataaatgatagatacagatatcaatatatgaatgtatgtgctaagatacacagatgaagatatagaaaagtatatatgctgcctttatacacacacacgcacatacacagataatgttataaagacggtgtatatgtgcatttcacatagaattatcagtcacctggaattcttgatacagctgtgagctaagattgctcctctcctattaagatattccttgtagttttggaaagttaggtgaggaataaacatgacaccaataaaaagttattagattaatcacctaaggaaaggagtaaaaatcttttcatggctagaaggtctacatcattaacttcctaaatgctaaatcaaagaggaggggaaagctagtgtttatgggcacctacttcgggttaggtggcttgctaggaacttcgcagacttcctttcatttcatcctcgtaaaataaactgcccctcccctaccgtccatcctgttctctccgcacctccgtcccctccagctgggaaggtccttgcgtagcctaggattcttctagttcctgtacacctagatgcatgctctttgccatctagtctcacggtaatactcaccttcatattcaaagccaaatcacaaattcctaggtccagttcaagactaaagatctccaaggaactttctctggagcctaacacctcactgcctcttccctttttctttacctttcttcaatagttatttaaaaagttcatctgtaatgtacttcaatactggcctgacttttgtttaaagtgtttcatatactccttccttagctatcaacattaaatgaaaagtcatgaaattgtagagaccctacttgcttaaccctttcatgacccatgcctcatcaaatacaatgctgagcacctgatcgttttgtaatcaagagttattgattattctagtggataaatgaatgggtcactatttttgtagtttctcatacttttataatttctctgctctcatttacatgttgttcactaaatttcttattgaacatctactttgactaaagtaggcacttagtaaatgcatgtggactacagcacccagtgagtggataaataccttatagttatacttggcttacacaatcacagggcgtagttgagagacataagattaccatggaacaagtattacaaggaagtatctgtaatccccaaactctgggagcccgaaagttaggaaaagagaattattgagtcaggatggatccattagggaacttgaattgaatttaaagaaacgggaggattgatgtttggtcactggaaagaaatgttgtttctaagcaggaaggaatcacagacatgcaagtatgcttggaacagaagagaaatcaggtgggctgatcaaaaagatgtatcaggaaaatggtgggggacaagatgaaaagagttgagaacagaggagattctggccagggatcagggttgactctaggagacacacctagcataaggcctctagactgtgggattcactgaaggtttctgctatggtctgaatgtttgtgttccccaaaattcgtatgttaaaatccttatctccaaaatgatggtgttagaacacggggtctttaggaagtgaatggtgtgagagaagagccctcatgaataaaatgagtgcccttttaaagagaccccggaaagctcccacacacgttccaccatatgaggacacagtgagaagccaccgtctatgaaccaggaagtggggatctcaccagacactggatctgccagtgctttgatctaggacttcccagtctccggaaccgtgagaaataaattcctgttgtttataagccaccagtttatgggattttgttatagcagccagaatgtactaagagagtttttaaacatgggaagggaatgatgttttagtaagtttagctccgacagaagtatggagggaaagctggaagtagtgagaactacttgaggtcattttgataatttagacatgagttactaagaactggactatgatgtgcaaatggctctgggagtggaaatgagaagaagaacgggtgacatttcagagcaggacccgccaggacttatcctctcatgggtcttttgttcctcctgacattcctgtgtgccctttgctctaattatctacatataaatgttaattgatcgatccagagatgatttcaccccaatgggccaggttaaagagcggtaaattaaaggttaagtaaagttctcaattatatataaaaagacttataaatgctttccttgacaatgccaaagagttatttgtaaccaatgatttctctgttttgataaaaagcgaccctttgtttgcagaatatttaagcacaattgaaggagtttgagttacaaataatgtggcaagtcattcacatacattaaaaaagtagaatatggttacacagtgttccaaatatttaaattcttgtaaagttagtattctagcatctacaaaaatagcatgcgagtttttatgtttatctagaaaaatgtgcaatttactctgctgtccaccttgtttgttctctctcatttgccctccttcacacactctctggcaaaatctgtctgtttctctttctctccatttgcctgattctttcccatgtgtacatcttcatttatactcattaagagagaggctgtggatgaaatgtgacatatatcgaaagcaatgtgccagatatttcaagctatgcaaagatgaggaagcaaatctaagctctcaaggacatataaatccagtagagtgggcaggagagggaaacaaatacttactatacaggacagaatattttaagtcatgttagagagataggatatattgccacgctcacgctctggggtaagcagccttcaagatgttctccagtgagctccacctcctctgtagttcctctccacattgaatggattgactcacatgcaataggaaaagtgcagaaacggcaatgtgtgacttccaagagtaggtcagaaaagacaccgcagcctctgtctgtgctcttacagatcacttgctctgaggaaagcgagcagccatgttgggaggacactcaagcagtactatggtgaagtccatgtagcaagaaactggggccttctaacaacagctggcatctacttggcagccagttggcaagccctaggatgactgaagccctggctgatattttgactataactgcatgagataccctgagcaagaactatccagctaacttgctcccaaattcctgacctgctgaaactgtgagaggcaatgtttattattttcttcagccactaagttatgggatactttgttattcagcaatatctaactaattcaggttcagaggaggaggaggtcatatataggttgaagaccagaaaagaattcatgaatgtaggggcatttgaaaaacggtcaggattccagtgcataaagatgcagacaacacctgaggtcaagagaaaagaatggagctgtgaaagcacagagcaggaaaagagaatgctcagttatcaagagtggctggtttcttcattctccccagtggaaagcaaagttattacatatgtatgaagagcagcagcatctgaaatgcaatgaaaagcagcacaagttaaaataaaaatattacgtgcaaaatccttgaggaaataaaaactaaatttcctcacttgagggagagagtcttgcaatttagctaacacttgacccttgaaaattcacacattgtttccactgttcttagtttgtgcaatagtaacacagaagtcatgccccagttagcaatctttcaaagctctctgcaaactccacacatggagaactatgactcctgggcatttaacacagtatttgattagataaaagtaattaaaagaggaaagctacaccattaaaaaacatgaatttatcttcttaacgactgtcactttaagccccttttagttagagatggcttataaacaagaaataaatgactgaaatctcagagaccaaatgcattttaatttgatctatatttggcaaaattacatactaattgccaaagtgcacgactgacaaagaagtaaccggcacagcgcctgcccacaacaatgccagagagagcatttcagcccacgtgggtcgtatgagttcattatttgaattagccaagtgagcaacccccctcactggagaggagcctgctccgagatactaattgatagactcaacttttagaaattaacataagcttcaacagttgaatgatcttcaaaattccttccagcagccaagtctaaaatcctgaaatcagttcagttgtccattggcctgcttagaatcacagtcctattaaggcactggcagatcctgaatcagctcactaactaccccttctggtttttcttgcctcctctgctcatgttctccctgttttatccagtccactctgctgcatggaagagggtttactttggttctgtaagcttatttgcagaagtcccaatatttcagcatatacaacgtagccaaggtaaaattcatttatgtctacatttttgaatcacttttattcacccattctgccaacacagtggaccggccactagatgccaggcagtgtcatgtcacatcctataaaagtgaacaagaatgttccatctcctcaggaggtcacagtctatagagttgaagacaaataattaattattcatagtgtggtaagcactaccataaggatgaatttggagacacctagcctatctctggggttggaggaagggctcccaagatagctcatggctcagtgcatccagtctatatagtgagaagaggctgaacaaactaaatggcttttcctgtttataaaggtttttaacaaattactacataaaataatattgtaaatatgttacaaaggattatgaaaatataaattctctatctcctttcctaagagttcccttctcctcttaaattctcatccagtaagtcaacatcccatctggggtattcaatattgttaaattcaagagactttctaacctcggtgtttgtttccaagtttgactctgctgctatctgccctcggcactctgtggaccctcctgtcaggcacgttccctttcactcctgggcaacgacttgattttatgcatctcgtggcattggcttgtgtctacctggaatttttttatttaaaagttccctatcaaattaattatgttcccattgataggttaactcattttatttactgtcatgaaaggaaatagaaaagtttcaagtaacagccactttttctgttgcagacatactcccttcaatatatacctgctgaggttgagagtctgcaacacaggtgctataaaaataattgagtcaagatttaggagtggccacggtgcagtgtgccccagagcaatggattaggtctcatgagtgttggcggagtctgaattctcacgagcgtctgtctggccaagacctacatcagcaccgaggctgtctccatcccctcttccctccctggaccccctgtctgatcccagcagctcaccccagcaacactgttctaaagaggcttccatcctgacagttcttggccccaaaatatgaactagtttcgcagtgcccatgtattaaggcctcaggtttttcttctatcttttggagcctccataagctggattcaccctatggaatgtctttccctctttcccattcacgaatccctctgtttctctcaagtcagtctctttgctgctttcttccttatgctcccatccctacaggcaagactcctcctcttagtccttattccccccaaaactacaaggttcagctgaggcgcaacctcccccataagctttttcaataaaactccagataacatcgatgtgctattcactgtctaatttcttgtaatgtttacatttagaaagtattgcttttatatttaacttagcattttttttttgaggtggagtctcgttctgtcacccaggctggagtgcagtggcgcgatctcagctcactgcaagctccgcctcccgggttcacgccattctcttgcctcagcctcccgagtagctgggactacaggcacccaccaccacacccagctaattttttgtatttttagtagagacggggtttcaccaagctagccaggatggtctcaatctcctgacctcatgatccacccgcctcggcctcccaaagtgctgggattacaggcatgagtcaccgtgcctggcctaacttagtattattacatgttatttgtattactgttttcttttctttttttttttttttcttttctgagacagggtctcactctctagctcaggctggagtgcagtggcgcaatctcggctcactgtagccttcgtctcccaggttcaaatgattctcatgcctcagcctcccaagtagctgggactacagtcacctgccaccatgcctggctaatctttcctatttttggtagagatggggtctcgccatgttggccaggctggtcttgaactcctgacctcaagtgatccgcccgcctcagcctcccagtgctgggattacaggtgtgagccaccgagtccagcctcctttgtattgttttctacctgctttatgaacctgcaccaggtctctccaactcaaattcaacatatactaattggaaggctactatgcaccggtccctgcactagacctgagagggggatgcagctgttgctctcaggaagtctgtctgatgatgagaaaactcagtcagggacaccttggaagatctaataagaggccactcagtccaatgttggtcaggcacaggatatttcctgaaagaaggaaaatacaaactaaggccgaaaaagcaaaaatgagttagcctgaccaagaaactatagggaagtgggaaaaagatgtgaaaacacttcagatggagtaaaattaggtaagatcagggaaccatgctgtatacggtattttcatactgtcttctcaggctttattaaagtcccaaattcttccagaaattaaaaattatattaaaatataatgataatgcttctataagccacatacataaatctgcgttttaggtttatataatatcccaagtgtggttgaattgggttccattgtttacaacattttgagccattgacaataaactggctacgcaaaatagaaatacaaagccacgattacaagatggaattaatgtattattaattttctccagatgatttcagtcctggaagatacccatttgcctttagtctaatttgtgtattgcatttctaaatataattactgttgacaggttgaacccaaacataacccattaacttctcaaagtgctagattgaaaacattacaatgtaacaagagatattagaaataaaaaaattaacttctgttctttttaaaaagtaagttaaaagcaaagatgtcagtcctgttttgtagtaatttgttagaatgatttggtttaccctagctttcttgccgaggcttttatactagaaaacagacactgacatgtaattgtaaatagtggataaatcataatgaaataattgttgcgtgtaaaaagaaaagaaaagaaactaaaaattccaaagggtatttggcccatgggagaaaaacgcagctcataaaaaattatcacgatactttcctatcccccagttaatggagttatgttttttcaaggatgctcaaaattacgtttataatagtccaagttcttcagactctaatttcaggtcacattctattcagactgtcgatatgtataactaaaaaaagctcaagccagatttaacataaaatagtttctgggtcatatcatttgcacagagctgttatgtggcacaactatttagctgttggagatgccatctgtaatacatactaactcatgcacatatcttgtctttgtttttgcctctgtgcaaaacagctagaagcagataatgcccagatccactgcaaaagcattctgctaaattgagaaagatatgaagacagatcttgtttggataagaaccccactgtgaaataaattgttctgatgtatccccaaacctcatgacaggaagaattaatgtgctaagaatcagtccagtggccataaatgttagaagctatttaacataagaaattatttcagacacagagtggttttaaaaagatacatcttttgctgttgactcaccaaaaccctgcacaaacaattgtgtaccggtttttcattcattcttaaaatgaatgaatgtaatcgtatgctgggtcttttcttttctttttattctttctttctttctgtttttttgagacagagtctcactcggtcacccaggctggagtgcagtggcacgatcttggctctacaacctccggctcactgcaacctctgcctcctgggttcaagtgattcttgtgcctcagccccctacgtagctgggactataggcacacaccaccacatctggctaatttgtgtatttttagtagatggggtttcgccatgttggccaggctggtctcaagctcctgacctcaagtgatccacctgcctcagcctcccaaactgctgggatttaaaggcaagagctactgtgcccagtgggccttttatttcttttattagaggaatatttaaaaatcaggttgtctgaagtagagtggtttgaaatgaggagtctgccgaaaagattgtagacatcttaaaacagttcaacaatgaaaatgtctcaacatgagaaggtactgtgaaatttctaaggtatcattagatgagttcagcattaaaatattgacataagaatttctggcatatagtagataaaattattttcccaacttagttgtttttgcttgttttacgtgtatccagaaaaggattgtataccatcccaaagtattttccaaaatataataaaaatcaatatggcataacaatacaaatcaaaatgaattcagagccaggcgcagtggctcatgcctgtaatcccagcactttgggaggccgaggtgggtggatcaccaggtgaggagatcaagaccattctggctaacatggtgaaaccctgtctctactaaaactacaaaaaattaatcgggcgtggtggcacgcacctgtagtcccagctacttgggaggctaaggcgggagaatggcttgaactcaggaggcggaggttgcagtgagctgagatcgcaccactgcactccagcctgggtgacagagggagactccttctcaaaacaaacaagcaaacaaaccaaaccaaacaaacaaaaaaaatgagttcaggtgcaaacccaagataaaggaattcatgcaaagatgtgactgtccacccagcacatgggatgcagctggtggttgagcgaggtttgtaaagagccctaggagggtggtgtgagccggctgcagcattagctggcctcagaatcccatttctgtgaaacgaggacctgtgacatcagcaggttagatgggaccatctccagagactttctggatatagaggtattgccatcttcaatttatatgatcacaacatttcttttttatcgaaagcttgtaggacttaatcctcacttgaaagcacatacaaagcctattcatattttggatttcacctttcttgaattaatgcatatgctgcaagcaagggtgagaaactggagatttctagagattttactccctgggagacttatgagagggagatcttgatccagagtattccaggaagatcagaaaagatgttttggtgttaaaaacaaaaaaggccacaaaatattacatatagcttttagttttaaggctcctttgttcttttttcaactaagtcagctgatcaccagggccaggcacgcttacatggaagaagagcctgtgcagacaggctccctgggtcagcctgggcctccctgggtcaggcgcccctccactgtgctcggggctcccccacacactgccctcacccttttcatcacaggtccccggggtactcacccactggcttcaatgtctatgttctcgccagactagaggccagaaaactgggatttggccctcagactgcttttgccaataaagttttattggaagccagccattttacatattactcgtggctgcttttgtgccataatagcagcattcactagctgtgacaggtcctagatgggccaccaagcctaagttacttcctatttggcccttatcaggacatgtttgcttattcctgttcgaggctgttgactccacaaacacagggctatctttctgtattcccaatgcctggcctgtggctggtgtttggtcaatgtttatgttctcagtgactgacagtttgactcaaggaatgaatgactatcaaggaacagggacaaaagcgaggcaaacaacaatttttgcagtgtccagaggtctgcagtagatgactggttttgagctaagccattcaactgctgtcaaaagctgaaaacaccatctccccccatctgccagagttaggctcatccgttcagagagctgagtccagtttggagagcacccaatacttgcgacttccacataatggaaaggaaaaggcacaagaactttgaagagggcaaataggacaaagaacatattgattcccttattgaacaaaaatgtactgcatgcctactatgggccaggcacttagcattcaggatgtcattgtctcttcagattggaagggataggtattaagcaaacaagtaaaaactagcaatgaaaagtgacagcaaggaaatgccatgggatcatgtgatagtgctggtgcactgcccatgctgggtggcctgggaaggcctggggatgggacatttgcattgccatctcaatgacaagccatgtgcaggtctggcgtaagagggtttgcagggaaggagcaagtggaaaggcacttaggtaggaatgctgggcatttgtgaagaattaatcagggggttagtgttttggggacacagttaccaaggaggcagtggagcaagatgaggtctgaggagatgaaggaagccacatggggcctttaagacatactcaggaattcagcgcttggacaatggcaagtcaggacaaaattttaagtagggatgcaacataataccatttatgttttaaaaaatcactctaacttgaggtaacgaatggactggagcagggctacaaaggaagggagatgcatggacatggtgaaagccatccaagtaagaaaagagagtgccgtggatcaagcagtggagagggagaggcaacgacaggtagacaatatgtttggggcaatcgagtgcttgatgtctcctacctagctttgctttcctactaccatttgcagatttctcgctttttaggaaatctcagaatcatgccccaacatccatgggttcatggttctaaaagtcacacctttcatattactttaaatggaaatgaaccctttctggttctaagcaaatttaaaatctttgcttagagcccagattaaatgataatgagcctggtaacaaaatactatattaatacagttttaaaactatagctccctttaaaaaacatccactggattgactgatcccctctaccatgcccagtgctgggcacagagcagtgggcatgggatgcatgggctctgctcccactgatgacctgttgtgggcagtgtctggcctatgaagccccgtgaggctgttgggggaccatagctgatatcttcaacaggggagtgacggcactgggggacaaaagtgggaggtgtcagatatttaggaactaaaattgtcaagattcagagactcattaaccagagtcagaaaggggattcaggcacaatgtctggtgactcttctcatcatttagtgaatgcttctaatgtgccatgtttcctgctaagtgctttctcggcatcactattttaatctgcagaatgatctgcagaatgattctggagggcagggcccactcctgtgttttctctgcaatctcactgcctaatgctgggcctgtacctaggaggagctccaaaaatagtggcttaatgcatgaatgcatggctcccccacccctcccatgacaacaacagtgaaatccctaccatagagaaggacacgggaggaaacggaggcctagggcgctatcaaacacccactgtccacagcccaccggtgacggagcaggcaccagagccagcgctgcataagttccacccacattcctcaattccgcatgccagggcccggcctctgcggatgctacggacatttgctgacacagtacagtgactggaggagcagcagggctggaaactgagtcttctggttctaggcttgctgagtttgagatggctttgggatgtcccagcgaagatgtgcagaagtcagtttagttcacggttctttcgggagaaagatggggctataaagggcctggggacccatccatggagagatggcaatcacagccatgggagcgggtggggccaccccaaggaaatgctgagattaccgtgtgactgatttgattacggggctttaacttattgagctataaacatcgaacagtgtcacggtttctaagacctgcctctgtgcatctgtcaaacacagtgggcaacaacctagagtccacgactttcagccacttttacctgtggctgcttttcagttatgaaaataatcgaacgggccttagatcagccggttttaaccttccatctcacacctcactggaagctctttcttccccacagtcaagaccaggaccggctccagctgcttcagatgtgaggcgcagggaaggcctgtgcaactgcgtgtgtccaggactgggcaccccaggtttcgggtgaacaatgggatgtaatgaagggacccctctttttcttgtctcccactggaatctgcttgcatacaagcaggtatttctggttttcattccttcattcaactaatggttgtgctgagggttaaacaacaggcaaggcagagaaagtttctcctcaaattgaacttgcagattcacaaggaaggtgacatacacaaacaaggaattcgtgctaaatgaagtgttaccgagagttgcaagaatggagaggagtagagaagactaaggaacaggctgacctaagctagtgtcaatctcagcaaaggctcattggaggaagagtcattattctccaaacagcaaccagaagatgctttcaaaatcaaagttatagcctctcactcctctgctcagtctctgcaatggctccccctggtcattcagaaaaaggtccaagtcctaatggtgactttaatccatcctctaagcctgccacactgccccttctctgtcccttagctccttctcttctcccactcgctgtgatccaggctcagtgaactctgtgaccctccccacacaggccccacatatgacacacacacaccccacacaagccccacatgacccacacacgccccacacacacaccccacatatgacccacacacgccccccacacaccccacatatgacccacacatgccccacacacacctggctcccagcctttctccggctcctcctgtgcgagcgtgcttccccaatggtcacgtggctcacaccctgccctcctgcagctcttccaatgtctcctttgcaacgagcccctctaaccaccacctgctcatgtaaaacggtggtgaccccaccctacattcccacattcccaattcccatggcctgttttagtctttgtctccataacatcaatcacttcctatagtagatttgccttcttactcgcaatgcctcaaccctccctgttccccagccattgacctgactttgtctttcctcagttagaagctgcatatatttccccatccagttgatggtgagctgagccacgtggctttgtagggtggctgaatatgtcaccccaaaatatgccattttggccatataattacttaaagctaaaggcccttgaaaaaaacaggtgatgtgagaagggtgttctgatctccccttttatacctggaaacaggagatgaaaactcccatgtgaaagacaccctccttgcatgaggagaaaaaccactcttcaattgggacttatagcagagtgaattctgcacaaacagccctcattagggtatgtatgccttatcttcccttagcctccaaacacttgagttacttttccacaattgcctctgctggttcaacccaacacaaaagaatgctggttttgccacttctttgggtcttcatttcctaatgagggctcctgtgtcacataacgcttttattaaacttgcatgctttcctcctgttcatctgtttcctgtctatttcattctcaggcccagttgggactctgggtagaagaaaagctttgcctcccctgcagcttcctttgccaataggatagtagtgtatgtgacataatccagtacgtggcatgtgcttgtttggtgaggcctgcccttctgaattcctgcctttcaccacgagaagaactgtccttgggtagccactggcttaaggatgatggactcattgagcagactggaaacatccacattcactgcccgaagcagggccaagctcagcccagccccagctcaactcgggtggagccgagaggtgtgagaaggctggacgtagtgtcaggggccagtgagctgcccggtttcttagtactcagccatagctgaccagtgaccttctgtacagttaccgatttattagatgtgtgacctattgtctgtctcttatcacaagaagggaagctgcattagggccgagagcttttccgcactgctgcctcctaagttcctggcatgtggcgggtctgcgacacagatgcatttcataaaggaagcaaagacctcaagtccgaacccccaccaaagtgagaagcaggagtttgtcaggtactatttcgctaaaaggaatgaaagaagatggaaccaaagaaggaggcggtgttgccgatgtgtagaggtcagaagtgggcctgctgccatcagacacatggggggtggcacagcctccaggtgacctgcagctgccacagcaggagaacactgacggtaacacatagcaagtgcacggacgcctcagggacaggtttcaatgtcaatgaaggtcattattggctgagcagcacaagggttccctaacaatcacgaataatgaagagcgcagagtatccacccatctcccaggacactgagccacctgaatgcaggctcgacacccaagaggagagaggacaatggggcctgaatgaacttggggtgatgcagcagcagaacttgatctatgaggctctggtgatgagcagtgtggacactgataggcaggtgctcagatgctgccagctgtttttaggtttcagaacagaatctttggggcagctccaccaacgtgcctcgatgtaggaggaaggcaaggctggtggccttcagctctggatcctgcaaggacatctgaaatctgcctctgccatctgcctctgaactccctctccatccccttccctcccctccactggtgaggttggacccataaggagaaggagaaggtaacttggaaggattgaagtaaactctggtgtattgaagagatttggagacaaggttgacaattcatagaaaataaatcatatatctattttaataacacttagctatatattaattggcaaactctgttgcatctacacattgtcccaacaatgcgttttagagttctgcaacaataataaccacaaaacactgaaaaagtttcaaacatcttccagcacttggaaacaaattctagattctattttcccaatctattgctgtctatgagcagtgctatggcagaagggcctaatccagtactcaactttctaagcctgacattttccacatatgtaaataggtcttcttgaatttctattaatacttttatagataagaaagttggactattaactgagactaaataacttgccaaaggtgacagagtggtttggcatcattcagactatgagtttcaacatacaagtcatgagaatctaggttatcgtatggccactaaaccacatttccactttgcctcccactacaaaagaatgcaaattgaagaaatttaacagtgggaggcttctgaatacagtcatgaattttctgcctgggctactgtagaaacaatgtgtctcaattcacagctggtatgttaaaaatcatcttccccaagtcaataaatcccctctgtcgcctcaacttgaaactgcctgttcttcgttcttcatgtttactcgatgcttatttccatatcgtgtcacagaagcagtgccttttccaatatccatcctcacagaccttataccctcatcacatctggaagcgttcttctggataagcatctgaggatgccatcgaggtcccgctagggagccctccttctgtggccttcctgagtacacacatgcacacacacacacacacacacacacacatgcatgtacacacacatgtacacatagagctccctgtttgtgctttcatcttctgatgaccagatcctgtctttactatttcctgttgctctagtgagtctcttccagggctccagcgcaggccctccgatggccatcactacccccggctcctctgtgtgcattggtttgcacactcttctgacttcatttgctttacaatgaggcaaggattctgttttctagaacacaggagaattatcatttgatgtgtctgaaggatctttattgcaggagaaacagctgttgatggagagccggggtggttgggggtggaggggagtggtgatggtatccatctcagctccaccttgaatagatgctgtccctcctatttgccccatgggtccacctggcctggaacactctaaatgcagcaagtccacgtacacctgtgctgcttctgcctgtcagcagctctgcttagcaagcttagccaagagaaagtcctgctcctcattagggtcgacgagttcttccccacagagcagcctactccctggcataggccttctgggatgaactggtgcccagaagcaaaatcaaaaaagaaattccatcgtaaatattggagattcattttctgtccacttcaaaatcaaggcctctgatgatcaacgtgattggtcgtccaagcagccatgtcattaccaacctgccccacaacacagttgctcacacatgaccagcgacagctagacaccaaagtagtgaagcagcctgcccatctgcagcagagggtcccacagaggccaccgctcctggaactgacgggccctgatatcgcacacaggaacagcactcacggttgtggcttcccgaacacaggacagaggcagcgcatgatgtttggactcgaaagcacccgcatcatttctcctttcccaactcatactgaactctgcatggacaggttccctccttagcagcaaaacttccccagtcagacttacaagccagacttgcccagtctctcttgtttcttcaacaagagagagttcagaccctatgtggctatgaagcacctcaccaggtcatccctcgaggaggctggagaaggaggcagctctccaccgagctctgattctggaggagcgagcaggctctccacctccacccagctcttattctgtaggacggaacactccaatgcaggatgcaagacaagattcatcactaagctgttgcctaaatgtcaatttagcctttattgaacatccatctggtatttgaatgtgcattggggatctgggggaattttgtttagaaatagaaaacacagacccttcttcaagaggccataatcgagttggagaaatgtttgatattaagctgtaaagagagtcacgcaggatcaattgagaacatgtgaaatttttcgcaaatagtgagaaatcatccgaacaccacctgcataaaaacccacctaactcccactgtaagctccatctgaacctaatgaggatggtagttaccgatttccaaaaaggttgtcttcattcctttgatttgcgctgtaagtgttaaactttaaaaatagtctaaaggtactaaaaatgatttcatgtttttctcagtacaattttgttaggtttatgtttaattagccaagtgttacattgaggatatgagaacgagcaatattctgttgctataaatccttcagttactaaaccatacggagatttcagtaaagagaggtggaggcaacagtcacacgtgtgcacacacacacgaatacacacacatacacacataaacatgcttatacacagatacacgcatgcaaacatatatatacacaaagatacacgcacacatacacatgcatatacacaaacacatgcatacacgcacagagctacatggacacacacaggtgcatacacacataaacagacacatatacacatacatatacacatagattgctagggctgccatgacaaagtaccacaaaccaggcaactaaaaaaacacaaattgattctctcacagctctggaggtagaaagtcaaaaaccaaaggccacgcttcgtctgaaacctgggagaggagcctttcttgcctcttcctggcttctggtgttgccagcaatctttcacattccttgtcttggagatgcctccctccagtctctgcctctgtcccccaggggcagttcccctgtgtctcctcacatcacactgcctctgtacgtcttccctctcctccccttgtctctcgtcctataaggacaccagttagatttgattaaggccctaccctactccagtaaaacctcatcttaacttagatcttcataacatctgcaaggactccatttccaaataaactgccactcacaggtaccagagattagggcccaacatctttttctgggaacacaattcaacccacaggtacacacaccctccacaaacaaataatgttggcttagtttttaattaattgtgctgaagtgatatgtcatttacattttctgtctgagttcctgtattgtgcgatcttgaattttccagagtaattgacttaatctattcatttctaagatacagaataaggtacccctaacttttaccattgcatagctcaggcaggactagtataaatgatgaagacaggaagattattaatattttcatcacagacccctcatattttcattatttaacacataataatcttctaagactactcaatcttctaataatatttaaattttcaatttaaaatattatttttattctgcaaaggacatcattgggtcagctgacaaaattggaaaacagctggtaacttagataaaagcactgtatcaatgttaaattgacttgaataactgtactgtcttaatgtaagagaatataagttgcttaactgaacactaaagtatttattagtaaaagaccatcatatctgcaaatttctcttaaatagtacagaaaattgtaatgaataacgtgtgtgtgttgaaagacacagaaaaggagatatagcaaatagggtgaaatatgaacaatagctcaactgtgacagatgttataaagggtgttcttaatattatttttgtattatctataaatttgaaattttcaaatgaaaacttaaaaagagattaaactgcatttttaattgtattgagagatgagtctaagaaacaacaaaatacactctccaattttcaaaccatgctccttatcttggtgggaggacttcaaaaaggtgccatagtcatatgacaaatgaaaagtaattaaacttagtttactccattatcaagactgcgataaaagtcatattctggtattttgttctgttttgttttgttttgtttttcagacagggtctcactctgttgctgaggctggagcgcggtggtgcgatcacagttcgctgtagcctcaaactcctgagctcaatcgatcctcccacttcagcctcctgagtagttgggaccacaggcatgcaccacaatgcctgggtaatttttgtatattttgtagagatggggtttctacttgttgccaaggctgatctcaaactcctgggctcaggcagtccgcccacctcagcctcccaaagtactgggattataggcataagccacagagcccggtcagatcatattcatttaactttaaagttgaaaggatgacacagatagaaaatattttttagttataaataccatattgggtgtaccccttacccacacatcaacagtcctcaaaggcagggggggaagggggatgactcagaaatcccgagtcctgaggaattaccacttggggctgggtacttgatcatacgagaaggtgaggaggtggattctggacttgcatttatggtgacaatgaatctgaagtacaatgtcaagggtttagataacaatgttaagaaaaaaatgttagggagaaactgggtcaaggtatatgcattttggaattattggttctgtgtgggctctagaaataaagcgacaaaaaaaatagcaaatatcccagttgcttaatagcttattgtcctgcgtagcgaacttttttcttaagggaaatatctattttttggatttaacattatttaacatgtaagtcaccttattcactcatcaatttttgaaaactaaaaatataaatcattccattttggtgataaaattttaatttcctatactgataataaatttttccttgacaaatgcacttagggcacccttcacactgaaaaactacaagagacaagtcccacatcatcaacagaatgtaagaatgtaggtggatgaaggataccacctgagactctacatttctgttaaactggcttcaaattattaagtagctaatctaaacaagtgtgcctgtttctgctctaaagcaatgtggaattctttcaatcccttaggacgtgtttttaataataaacttttaaaaatgtgtttaataaaatataacaaactttataatgagtattcatactcatacatacatagtattacaggttgagctgtgcccccttaaaattcgtgcattgaagtcctaacccctagtgcctcagaatgtgattatagttggagatggggccttcaaagagttaattaaggttaaatgaggtcagatatgtggaacttaattcaacatgactggagtccttacaagaagcagagactatgacacagatatgtacagagggaagcccatctggagatacagggagaagacagccatctgcaagcgaggaagagaggcctcagaagaaaccaaccttttcaacaccttgatcttgggcttctggtctgtgaggaaatacatttctgttatttaagccacctggtctgtagtaggcagcctgagcaaactaatatacatgtatattttagttttgtctaagaaaactcttgaatggattatgacagactggaattctagactgataataaattactgtgtgacctccttaaaatttagagataagaggaggtcctagacaacgtctaacgtttcatcattttatacccatatacaaaagctttttttctgaaacagaaagcatcataccttggttgggaagctgacattcccttggatcaagacatggctgctaactgtaggagtgactacttatgtaacagtcattcaaatgaaaatacctatgctaaaaatgattatttgcaacattcatgtatttacttcttattagacaagtaattattaagcatatggcatataccttatactaggcattggaaaaatcaaaaaataaaatacagtcattatccttaggattctaattcaaattcaacacgatgtatgctatagcagagacataaatacagccaaggtggtgtctagctttacctggggaacttgaggaaggcttcccagaggaggaaagtcttttgagctatatctttaaggatgggcaggggttcgtctgatggggaagaggaagaaagggtactccaagcagagggaagactatctggtaaaatagtaattctcaaaatgatctgtagattcgaaataatcccttttgaaatatcatcaaagtttttaaagaactagacaaactaactctaaaatttatatggaaatataatgatctgtattagccaaagcaattctgaaaaatgaaacaaaatctcaggccttaaacttcctgatttcaggacttgctataatgcagcacacaagccaataaactaggccaatcaattgtcagaaagaaagttttctgggttttactaatgattccaagcagtaattgtcctttagtttctcaaaaaaaaaattgtttaattttctagttcacctggcaaaatgaaagacagttttagacatcatcatatacagttacagaaatcaagccagtgtggtactggcatcaggatggataaatagatcaacagaacagaagagtgagtctaacagaggagccaaggtagctcaacgggagagggctggtcatttcaatatacggggcttggacaagaggagaaacatatgcacgatagcaacagtaacataaccattgtcccttacatcacaccaaacacaaagattaacaagaaattgaccaaggatctaaatgaaagagctattactttaaatcttctagaaggggccgggcacggtggctcacacctgtaatcccagcactttgggaggccgaggcgggtggatcacctgaggtcaggagttcaagaccagcctggccaacatagtgaaactccatctctactaaaaatacaaaaattagccgggtgtggtggcatgcacctgtagtcccgctactcaggaggctgaggcaggggtatcgcttgaacctgggaggtggaggttgcagtgagttgagatcgtgtctttgcactccagcctgggtgacagagcaagactctgtctcaaaaataaataaataaataaataaaaattaaaaaaaaatctagaaggaaaaatataacagacattttctttgtaaccttgagcaagacaacaatttctagataagataaaccaaaaaatgaacagtaaaagcaaaaaatcaatatattggacttcatcaaaattaaaattaaaatgttgttgaagccaggcatggtagttcacacctacaatcccagtgctttgggaagctgagacgggaggactgcttgatcccaggagattgaggccagcctgggcaacacagggagaccctgtctctaaaagaataaaaataaaaataattactcaggtgtggtggtgtttgcctgtagtcccagatactcaggaggctaaggcagggggtgggagtccctttaggccagaagtttgaggctgcagattacggcactgtactccagcttgggcaacagagcaaaagcctgtgtccaaaagggggaaaaaaaactttgaaagtcaccataaagatgaaaaggcaaccttcagactggcagaaaatacatacaaatcatctgtctgagaaaggacctatgttgagagtatacataaaaaaacttacagtttagtattaagaaaacaaccaagcaaccaacaacccaattaaaaatggagaaaaatttgaatagatgccacagtaaagaagatagcagaatgtcaaatgtgcacatgaaaagatggtgcagatcattacacaacagggaaatgcaaattaaaacaatgtaagatattatcatgcacctactaaaatatccaaaattaaaaagactgacaataccaagtgttggcaaggatatagagaaactaaagcccttaaatattattgtggagatactttaaaatgttttaaaaatagtttggcagtttctttaaaactgtaaagtttctttaaaaattgaatatatgctaccacagagtttggcaattccacaaagtctgctcccaagaggagtgaaaacatgtatacacaaaggcgtttacacaaatggtcacagcagcattatttatgatagtcaaaagtgatgaaagaattagaataaaacctgaataggacatggaaccagaagttttcaggcaggaagtaacaaagtgaggcttgtttattcaaaagataaatcagacatggaagttggactgaagcaggtgagagactcgtagcaggaagaccagatgcttaacctccttggatggattctgttttaactgacaggaagacagttggatttcctaaaggagaggcttagcttgtgggaggaagtgcagtggaaaggatatgaacttctcatcatcctggttcagcatcccaggtgcgcacctgagcatgtgagtccccctttgcccaacctccagtctcaggcgcctcacccaccacaggaggggatgtccccagcctcaccgggctgcggcgaggcggtgcagtatctgtggacagcttctggctgatgcctgccacatgggtgggactcggggtagctgagtttccttctccttctcttctaacttcttatccaaggaaaaggaaaagacctgtctggccttccataatcagtaaggtaaattcatccatccacagagaaaataaccgggaagcctacagtgcacattttctctctgcccccaccccctatgcccatgccgcatcaccatgacgactctctgccctgccaggcttgctctgcatcccagaaagttgggcccttggggctgtacccacaaggctcccctgatctctggctgccagctgccacccagctctgggtcacattttctgacagtggcttcatccttccctgctacagatcctcttggccatcctcttcctctcctccatgcctcctggagctgcggcagcactaagcaggccacttacttctgaaagactggggtgctgatggagctggcagtttctgggttcctcactaccactgcccacatctctgcaaattcatctttgtcattaaagcatctagaattatttggattgattctgtttcatactcagaccccaattcaaagggtctaaaacaggtaaaatggacagaggtggggcaaatatatccaaataaaagaggatccttttatcttatgctcagggccttgctgacagaaggtagcatctttggtgatgcgacgttttttcctctccaggagcaaacatccaaggagcacaaactgccagtctctagttgtagtgagcaacactggctacactgctttctactcttattcaagcattgtgctgtgagtgaattaatattgtgctgtttccattcctgttaaaatattcttcatagtgacaaagaatacacaaaaatgtccagactgacataacggtgccacctgaagcataactcttggaagtcaaatgtgctgtgaccaaagaggtttctaaagagacacagtgtattcgtccattctcatgttgctaataaagactcacagtttcacatggctaaggaggcctcacaattatagcagaaggcgaaagaggagcaaaagcatgtcttacatggtggcaggtaagagagtgtgtgcaggggaactgcctttttttcttttttttgagatggagtttcactcttgttgcccaggctggagtgcaatggcccaatcttggctcaccgcaacctccgcctcccgggttcaagcaattctcctgcctcagcctcccaagtagctgagattacaggcatgtgccaccacgcccagctaattttgtatttttagtagagacagggtttctccatgttggtcaggctggtctcgaactcccgacctcaggtgatctgcccacctcagcctcccaaagtgctaggattacaggcatgagtaaccgcgcccagccgggaactgcctttcatagaactatcaggtctcatgaaacttattcattatcaggagagcagcatgggaaagacccgcccccatgattcaattacctcccacagggtccctcccatgacacatgggaattatgggagctcaagatgagattgggtggagacacaaccaaatcatatcacacagtttcttctctgaatttatgggtctttgaggtacttttatgacaatgagaaaaactctctctaggtgtgtgcaaccacataccagggaactaagtctagggaacagaccataagccgcatttcatccccaattcattgctgcagccaggtatgcctgtgcagtatacaacctacacaactgcaagtggcagccgttacttcatatgattctaggacactcgcacttacttcttggactcaattttcatatgtataaaatgaataatgctatacacttttcacctagctttatacaactagaggtattgtactttgaattcaaagaactataacttatctaaaaacattcaggtatacaaagttcaaccatccaaagtgttcacctatacaaagaaaagttaccattcttttgtgggctgattataggttacttagcaggggactttttgttcctggtggttaacgcagatcctaatatccaacttggtcaactttcaaaagtgccttatcagactttcacttctggctacaatggaataacaagcactgaatttatctccctccctgaagcaacctaataattccacaaaatatatgaaacaatggttttcaagacagtgacatgagacaatgtgggacaaaggtccgtgagagacaggaagcaagcgtgctgagtcctgcaatcactccagcctcctgccttcagagagtggccaggccctggttcagggagggagaccccagcgggagctcagcagacttgcggaattgaacccacaggtctgtgtgtagggggaagacggggcagctggagttaacagaactgagcagagagagctgcacagagaagactagaaaactgtacgacgggttcacctgaagcgtctggctgctggtgtaaacctgcgctttggaaaatggtatgcacacgtacactcactatggaaaaatagtttggcaatttcttaaaaaggtgaacatgtatctaacaggagatccagccattcttctccagaatttctaaccaatgcagagaaaacccgtgtgcatgcaaaaacttgtacacaaatgctcctggcagctctgtttgaaatagccccaaacaggaagccacccaaatgttcctcaactgatgagtgaataaactggtggatccctgcagtccatgtggcggcaggctgctcagtaccaacgaggagggagctgggacatatgcagcagcatgcgtgagtcttaaaataatgatgctgtgtgaaagaagacaagcagaaagaaacacacactgggtaactccacttccaaaacctctaaaaaatggtaactaatctatggggacagagaacagatcagtggtctccaggagatgagaaggggaggcagagtggggtgggagggagagaatccaaagaaacctgaggcaattgtgggggtgatgggttcactgactgtgatagtggtcttaccggtgtatacatgtatcatgactaattgaattgcacactttcaatatgtgtgttttatcacacaccacttatacctcagtgaaaaatttcatgcacagaaaaaaggtttaagaatacagtggcttgtttaaccaaagattttcatatgtggctgtcttctcacaatgcagctggagggaggccacaagaagaatgtgttcacaccccaggagttggaggttgcagtgagccgagatcacgccactgcactccagcttgggtgacagagtgagactccatctcaaaaaaaaaaaaaaattgttcatgcgcagtcactttcttaaccccaattttgctattgagcaacgtgtaaaaggattgtcactatgctgcatttgaaagcatgccctgtttcagatgtcccaaatggcaacagggtcactcacaaagagaacagggttcagtatatgccttgattcctgtcctccaaaacggtacccataggtaagttctccctgcaaaagggaactgaaaaaatgaggtcctggctttgggctttcattactttcatacacacacacgcacatgcacacgtactcacacacacataaagtttttgttttgttattctaatttgtgcttcgatttgcccaggagactgggtcctagaatttgatcaattctaccttcccggtccactgctagagaattaatctggaatcacattaaaaactcctggagcccccatcactatagcttctgaaggaaaagaataggaagaaaaatcaatgtgctttgtgtattcacagacttctgataaactctgggcatgaatcctgtctcgattttaagaggctctaaatggtagtgaattgtgagcctcactgcagagctaagaagtagccccctcagaactggagagtaaacagggccacgtgggtttcccatgcccagtccccagggatttagacctagtgtatgtttgtcaccaccaactagtgacaaggacaaattttccaattagaagaaagtcctttatttgaaactatatatttcccagatttcctgttaaaatgattcccttttattaagtgatgttgagactagatacttttgttactgtgtttttaaacatccttacatggtaaaatgaaatattgtaaacctatattgctcagtcctccactttatttttaagaaaagttaacttgttaataaaactgaaaagtcttaaatgtatcaatacttgtcattgcatgtggaaaattttatcgacattttggttttggtttatatagactaagttacaataaaaacaaagaactgtgaacacaatcacacatgatcacgaatgacaacgctactcctacagcgtaagaaatctcatcttaaatttcctcaacccaatattttcaaaaagaacttgacctgccaagcttccagaaaacacaaataaggaggcagaataatcacttcccaccgttgctccaaggagacccccgaagagcctgaagatgtgaagctctgataaggtaactaataattccttggatagtctactggcgtaggagccatggaaacagagaaacagcattggcaccaatgaaggttaatcaaatcataacacagacatgcattttattactctgacggcacacagcaacacagagttatcaggtgcagatgaacctaattagattgggtagggggaaatggacagctgtgaggtgactgctttgagctctcctgaaagataaggtcagatttaccaaagacacataggtggaaactcaaagaccagtttttggtagaggggcaggtccttgtgagactcagtcctactatcctgaggtcaagaagttcaaaacaaagtggaaagactggacatctgattcacttgttttaattttttttttttttaatttttagagatggggtctcactctgtcacccaggctggagtgcagtggtgcgatcacagctcactgctgcctcaacctcccatgcccaagtatctcctgcctcagcctcctaattagctgggactacaggcctatgccaccatgcctggctaagttttgaatttttctgcagagataggatcttgctatgttgcccaggctgatcaccaacacctggactaaagcgatcctcctgcgttggactccctagtgctgggattctgggtgtgagccaccgtgcccagcccctagtcactttcaaacagaatttagcaagtttggaaaggttactagatagcaaggaaaaccattttcacagaaggcagtaagacagtagcaatgatgtaatttttccctcaaaaaaactagaaggcaagagatctccaacaacaagggcctgggaatttgacacacttgtttccacacacttcatagagctacgaactggagaagtctttgaatgtggggtaagatagggaaggtcaagccctgtaggtatacaggtgggcatgggagccagacggagtcagtggacaggtgaagagggccttatccatctaacatgtactgtggttaggcctggagacattcaataagtggcatctgagtgcatgaatgtttcaataccctcaacgcactgcggttatgttcttgaaaatgtacattgcattcaaacattatactccgaacttaggtgcccaaatgaacagtattgataaatggaaatttcatttctcatagagtccttgactgtcctctcatatcataaaaaataaaggggatacataggtagatgaatacagatgtgataccctttaaaaataatagcaggccaggcatgtgggctcatgcctgtaatactttgggaggctaaggtgggcagatcgctagaagtcaggagttcaagccagcctggacaacatggtgaaaccctatctctactaaaaatacaaacattagccaagcatggtggcatgtgcctgtaatcccagctactagggaggctaaggcaggagaatcgcttgaacctgggaggcggaggttgcagtgagctgaggtcacgcactgcactccagcctgggtgacaagagtgagactctgtctcaaaaaaataaaaataaaaataatagcaaataatgagcataaaagtaacaaagatttatgttaaactcctaaatgtttcttgtatctctataggtattacccccaatcaaattcccaaattaaataaattttataaaaatacatgcagagcttctaataacagaaattccactctactctaaggatgtcagtacaatagtgctattaaaaacacatttggtttacattcaaaggctacctttcagagattaaggcacatcacattttaaagcgaatctcaaagaaaaagtagataaatttattttatccaccactgaagtccaatcactaagcatagcagcagatatttaacatgtgcttagaaaatatttttcaaataaaaaatgatttatcaaaactcgtaagagatacttcaaagcataatatccaaaacagcataaaattaactggccaaattaagcctaaaaatattagtaataagtaacactgaaaaaattattatcctcagtatataaagagctcttacaatttagtaaaaacatgctattatcaagccacagaaaataggccagtgacataaacgtacctatcccagtaaatgcttgaaactgtttaacctcattattaatagtaatttaaacttttttaccagaaagagagcattttgctcatcaaatttacaatctttctaaaaattcaataaccaccattgaataaaaattcaatggtagttagctctggcaaaatgggttcactcatacattgctagtgggaatataaattagcaaaacctctctgaaaaacaaactggtaatataattcatatcaagagttttaaaaagtttataactttcaacacagcaactcctagtaataatctctcctgtgacaataaaatatatgggcaaagatggtgtatgaagatgtttattacaaataattttttaaatatttatattttcatttataatgttaaagtttatatgtttataaatatttatataatatatactatgtaatttttcataatttaaaaaataaaaattttattcatttactttataaaaaattacaaataaatataaaatatataaacaaatattacaaatataattacataatatacagtatacaatatgcaaatatttataaaaatatatgaataaaatttttattttataaatggcaatttttataagtataaaattttatgcataaataaaattatataattatatattcatttataggtgtatatatttataagcataaatatataaacaattgtttataaatatatttttaaattgcaaacaacttaaattttcaagaattggaagtggttatgtgtaacatagtatgcgtatgaagaaaatcattaaaataaacctttgaagtataaacgcctttggaaaatacccccaatatgacactatgtaataaaatcaatacaaaaactctctgtacagcgtgattctatctatactatcttatgaatataataattcacagacacagatatacatacacatttatgcatctaaaaaatggacaaaaagcccaccatatggttcatagcagtgaatgactatgtgtattatatgttttcattaaaaatattttcagagaaaataatttttgtaaaaatactaattatataaagcaaaaagtaaaatcccccaattaccaaaaacccccaaacatactcactctttgtcctccaccaacatacccactgatatcagtctgaagcataggatgtatttaaacataaatcttttaaaaatataggcagaattaaatctttttaaaatataggcagaattatcctgtgcatatcgatccatcttggagatctttcctagcccgtacataatcatcattcttattaatgtctggttataattctatggctatataaaaatgtgtttaacccatcccaataaaagggattttttttttaatccagactttcactattacaaataatgttgtatgaaacagcttagtacacttctttctatcctctttaagaaacatatccagaagtgttaactttcaggaaaaagtgatcacacattcattttcacagacaatggcaaattttcctcctaattatccctaccactttatatccccaaaatagtacaggagagaacttacatccctacagccttgactgagtattttctttctgcttcacttttggaaaatatttccactggtgttctttttttttttttttttttttttttttttttttttttttttttttttgagatgcagtctcattctgtcacccaggctggagtgcagtggtgcaatctcggctcactgcaacttctgcgccctgggttgaagtgattctcctgcctcagcctccccagtagctgggactacagatgtgcatcaccatgctcagctgatttttgtatttttagtagagacggggtttcaccatgtggaccaggctggtcttgaactcctgacctcagatgatccacctgcctggcccctggcatctttaaaattactagtgagttcactttttaagttgcttggctattgacatttctattgataatggtttatttatatctggagctcagaccatttgctgttctctaatattcactcactcagtctttcttagcaataacaccccaatatttaatgggacatgcggtcatacaggatgaagactacattgccaagtctcttttaaagttagggatactcatgtgactaaacactgggcaaggggacatgaagaaaagggtttgttataagacttccagaaagtgattttaaaggaaaagtgcacatctttcctagttgttggaatgtagacgcaacagcagaagctgaggcatgcatcttggacgatgaataaaagacacatatggctgggcacggtggctcacgcctgtaatcccagcactttaggaagccaaggcaggcggatcacctgatgttaggagttcaacaccagcctggccaacatggcgaaaccccgtctcaactaaaaatacaaaaatcagccaggcatggtggtgtgtgcctgaaatcccagctacgcgggaggctgaggcaggagaattgcttgaaccttggaggcagaggttgcagtgagccgaggttgcaccactacattctagtctgggcaacagagtgaaacgctgtcaaaaaaaaaagacaaatgttttggatgttacagtaacaaaccagaggggtctcagatcatgataatgtttgagaagccaccttaccagtcattgaccatttacctctggacattgtttatgtgagaattaaatgtttgtcttgttaaaaacccttttatcataaattttctatcatcttcaatttgacctaattgtatcctttgccaattttttaattggcttgtttacttatatccttgccaatttttttaactggtttacttattaattatttattttttgagatagggttttctctgtcactcaggctggagtccagtgacatgaatgtggctctgcagccttgaccgcttgggctcaagtgatgctcccacctcagcttcccaagtagctgggacgagaagcacatgctactatgccaggctaattttttttttttttttttagagatggggtctttctatgttgcccaggctaatctcaaacccctgggctcaagtgatccctctgccttgttcccccaaagtattgggattgcaggtgtgagccactgtgcccatcctggtttttctttttttcctgttggcatgtacttctttatgaaataaatagaatttcttctgtcggcagcaaatcatgaaataaattccattcattcatctattcataaattagcttaataattcattatcatatgcaactttcacccaaaggcaatgcgtgggtgtggctatgggtgtgatgggctgggtacactgcagacactaggaggaatccaaacaaacgaatctttaaaatcctgtccataagtgtatgaaatatttggcattcaagttaccctaggagaagaagatatttttctcattttcagtaaagaaaaacagaaacctaacttcttgcttctttcattggccgaaaggatggtattacagatttgctttaagagaaaataatctcaaaatctcatcttttaaaatgttagggtaacccattaaagccacatttggcaagtcaggtttcatgactgcagatgcaaatatttaggtgcacactcccttggtgtgcaaaccccgtgcactgaggaaggtttttctgcgaactgctgaagctgaagcttcagggctgttcacttgcttgggcctgtcaggaggtctagtgaggactgagcaaggtgatcacatggctatgtattccccaaaatttaagaagatattttcacagctgttgcttaggacaggtgcccctttccactccagcactgcctctggtagaaatccccctgtgtcaggcggccttggagtggtaatgggtatttgggaagctgagctatatatgtgcagtttgtctgccatttagtgagatgtggtatggagtttacagttattccttcactgaagtaacatactcccaggtgtttcagtgtaagcatggcttccaaggatcctcctcgcacagactgtgtccacacacccacccaacgccacgaagtagggaagatcagagttctgatatggcacccagcacctgaaacgtgtggatggagaaaaaggaagcaggtttgaagtttagggagccagaagcctgtctgtggataattctttcaatcattagatgtgccaagtcataagtgcaaggtgcgattctcatcaacaccttgtcaaacagaagttcattttggccaagaatatacttgataaggccttgtgcataaacacaaatgaatcatgtacgctttttgtttattttaatggaaaccacttgagagagaatttaccggtatttccacacttgaagtgcagaaacctgtagaaataaatactacagtgaatatggcagttatgaagttgcgtgatttatacaccctaatgtactagatcatgtcttactgtatcggaaacatctcaaaccaaagaaatctgggctccagatgaaaatagtacacaaattgccacatcctaacaaaatgcctgcagaagcaagtgctatattccagtgactaaattgctacatttatctactaataatgaactgcgtgtagcaatgaacaggccattcaagtatttgctaattaactaagagaaataatcatagggccacattgaaaaaaagatttaaatgttttcctgatttgacatgatatactaacattgactaagataacattcatttcataatatgccaacacaaaaggacatattgaagacatattcattgatgagttttgtcaattgatcaaatatgtaagcagtcactatgcaataagacttgaaatgctctgcaatcttacacaccagaaataatggaaaattattagaagttacctcaaatttgaaaacaagcctcaaagttgtcatatttccaataatttgtaaaactaaaaggtacttttcaaaaccatcaataataaaaataaattgtaatcgactatgcttggaagactaaattattttctattctttttatacaaagcaatacaataaaagtcatatgccaagaggcatatgaccaaaaatcataggaaaaagagtattaaagggaatatcacacagcaagaaaattgaaatatgttatttttctaaaagtatgattttcctggtatctactgaatttttaaaatttataatctgttgtaattttcttattatcaattatagtaatacttttgcattctgtttcttaaagaaggtctcccaaatggtgtaatttaagatccccacaaaatctgaacttgtctctgcttagttaagcacctcctcaggaccccttggcctcgtcaatatttccaaaatccttctggtctgggctgctcatggccatgtccctttccaggaagtgtccttgtcaaactctcaagagatttaactttaaccaagttagtcctgggtttacccggccctcatccccactcaagggacttttcagcatggagcttccgctctactcccaagcttgaatgaaatctcttgatcttctgggcatggggttttgcttcctgggcaagtgcaaggaaatgtgatgtgaactggaaatgcgagggtgtctgctccccccgggacacaccttcatccatagtaatgggagacaggaggattctgggtaaacaaaggcctccttcccttctccttgccttcagagggctggtccaagttgtggtttcttccttgcaaattttcactaagagtcctctgtgtcatacaaacacacctgctaaggaccaactgtggctctttagggcccctgaagctgcggccggcaagaatgcttcgagttgcttctcatgtttccttgcctttattcccctctatttttcaccctagccatcccgggcttccaccttccaaagaaagtgtcagctctcactcttgccccaagctctgctctctagaggaccctggctaaaatgcaaaccatctaacagaaattaaaaagcctggcaatctagcaggtaggagccctcattactgtagctattatcattaccacgaagattcataccaaaacatgtcagtacggatgaccttgggtcactgctctgaaattcaatacaaggaattagagaaatgaatgaaattcatgtaaaaagtagaaaaatcatatttaagacaaattttaaaacaaaagaaaattaaaaataaattattagcttggaaaatgatagcataaaaatgagctttattttgataagctccattttgggttaagcttgataaatacaaaatacaatacatgcatctatttatacacacataggcatatgatgactatagcaaaaatagtatatttctgctcatccttgcagaaaacccattaatgtacaaatgcaaaagtgaaggtttctaaaagttctatttgtggacgtctgcacccgtgttttatccattgccatttttctcctatggaaggaggtgaccaacccatctcagacgcaggacaagcttccttgttccacccagtcagttctagacagatggccacaatacacatttttgaatcatgccaaaacaaagattgaatctggcagaggctttaacccataacttcttttcccaaagacattaaatacatttgcttggtatcctttctgacagcaccaattcaacagagaggcatgtaggaacggacacgctgagtgagttttaggggagaaagtcaggcaaatatgcatgatcgaaatagcctcccaaacaggaagacttatgttcttctctcttctggaaatctaaatcccatagtgtgtaattttgatttgcattggcaggacaagaatatagctcaataagatgacacagcaccacgtccaagtgtacacctcatacctgctcttcacaatggggaggcttaattgtaggtagggaatgagcttggaggactatgacatatataaaatgagccaggaaaattctgtctgcctaacttacatggattcatggccaaactgttctcctttaattaacacatctttccacatctcagataagggggtccttacaacaccacatttcttcccactcacacttaatcacagtgagcacgagctatggaaggggctctgttcatctgaagaccctgaagatgctgtctttttcacatgttgttttcctctcagatcagaggtagtctagggaactgagatttcccaatgggtttgagttttactgcaattaccagaaggctattgaaagatgggtttttagaatctgagcaaattatcactgcaggtaggtattcagaggatacatgtatctatataactgtggcattgaatttttaaaaaatataatcattttagactagaaattagggctctaccttgtattcacctcaattgattttacttttttttttttttttttgagacagagtctcaatctgtcacccaggctggagtgcagtggcgtgatctcggctccctgaaacctctgcctctggttcaagcaattcttgtgcctcagcctcctgagtagctgggactacaggtgtgtgccaccacaccgggctaatttttgtatttttaatagagatgaggtttcactatgttggccagtctgctcttgaactcctgaccttaggtgatccacccaccttggcctcccaaagttctgggattacaagcgtgagccagcacacccggcccttgattttactttttaaattgtagtccacttgctcaaatttggaaactaaaagacaacagaattctatttctaccaagttttattgactatttagttaccagctttactgatcacaaccaagtttactaactgactttgccttttctagagtgccaccgttctgctcatgaatttgaaattatactggttttcatgcacttattacatacataattattctgtgtgatgaacagctcaagaccttaggaataaaggaataaaagacctctgtgttttgaaaataagaatctgaataaatagaaagattccctttcaatcaaatcttatttaccacacaacttgtgagtaacctgcaaaatactgtaggcaataacagaagtaacagaccctgctcctttcctcaaagaattcaaaatttagtcaattaagccaaataaagccttaccagtaactatttagcttaataatttcttgtttttctggcactttcagaaaatgaaccctacataaagcaccaaaatatttttaatcttatttgagtgaatctttgatgtgacatcctgttcccaagagtattacaaatacgactctgtggttcagggtcttcacggcaaacagtgatgcacaacagcacggcagacccttgggagcaatctagtgctggctgcttcctgtgggccccccgacctcacgccactgtgcttctgcccaaaggggctgctggtttgcttttcctgcccctcccacaggcgtcagctctgcttcccgcccctctgtttctcactggctgcctctcactgtgctgtgttgagagagggcactaaagaatatgcagaacaggccaggcactctgtctctcagcactctgggaggctgaggtgggcggatcacctgaggtcaggagttcgaatccagcctgtccaaaatgacaaaaccccatctctactaaaaatacaacaataacaaaaacattagttgggtctggtggcagctgcctgtagtcccagctacttgggacgctgaggcgggagaattgcttaaacctgggagatggaggttgcagtgagctgagatcacgccattgcactctagtctggaaaacaaagtgagactccatctcaaaaaaaaaaaaaagagccggttgcgacggctcacacctgtaatcccagcactttgggaggccaaggtgggtggatcccttgaggtcaggagttcaagaccagcctggccaacatggtgaaacctgtctctagtaaaaatacaaaaattagccaggcatagtggcatgtgcctgtaatcccagctacttgggaggctgaggcaggaaaatcacttgaacctgagaggcggaggttgcagtcagccaagatcacacgattgcactccagtctgggtgacagagccagactcaaaacaacaaaaacaaaaacgaaaacaaaaacaaaaaaaacaataacagcagcatagtaagaagccctggaaagtgcaagtgcttttgcacccatgagctcctttgccaaccacagtctggtctgcagggctttcttccaagtagactgcactggtggcattgtgtttcgtgacagttttgttttgttttttcccttggagacattttgatgaatctaggcttttggcggttttcactgatctttaggctctctgtgctccctgcggtctgaggatcagacaagcgggttatgtcagactgacatgaattgaaacaggtttcctgaggtctctttggcctagagagccctgctggtggtcttgccccctgccaggtggatactaacgctcaggaagccactctcaggatgcagcctctgggtaggccccgcaaaggcctccgcagaaagctttgtggacagacgcccctgcaggatgccccggagagcaaagaaagcaaagggaagctgcagcccagctcctccactcccagagcctggtgaacatgtgctctgaaggcaccagagcttcgggaacctgtgtatgaggaccccaagtctttaaccttcatgccacttagcactaaatgccaaaaaaaaaaaaaaaaaaaatgccaatacaagaaccaaggatgggaatataacatatgtagcaagtgaacaagtttgcagagctagggatctgcctctcgccaagtccgtagcttggccgggagctgggtcatattcatgttggtgccctgcttcggctacactggcccctttgtccctactaccatctctcttattcacctcccacagcaatttgtacaggttacaccttactgtcccacttgtagggcgaggtcagtaaggctcagcaaggtaaaaatcaatttgcccaaaaccatgccccacagttaaggactggggttgcccctctggccctggaaccagagtctctgctgcgtgttcctgtctcctagtgtgtcggggttacctttgttttttttgttttttgttttttttttttgagatggagtctcgctctgttgcccaggctggagtgcggtggcgcgatcttggctcactgcaagctccgcctcctgggttcacgccattctcctgcctcagcctcccgaggagctgggactacaggtgcccgccaccatgccgagctaatttttttctgtttttagtagagacagtgtttcaccgtgttagccaggatggtctcgatctcctgacctcgtgatctgcccgcctcggcctcccaaagtgctgggataacaggcgtgagcccccgcacccggcccgcctttgttttactaataacaaggtgtcactgggtcactgctacttggcgcaaggcattttttacatttattagattttcctttttaaattgaaacataaaaattgtatatattcatggtatacaacatggtgctttgatatatatacccattgtgaaacggctacatcaagctaatttagctaacaaatgcattacctcacatacttatgattttttacttatgattttgtatgattttttaactgaagaataaatacaaactccttagcatgggattctgtttgctttgtccgcaacctccttctaatggcatccagcataccaaggagaagaaagaggtgcagcctggagaggaagatggccaaaagtctccctttcctatgaccctgctccccaaccacagcaagggaccaggtcatcaaaaacacaggctggccaagctccacattctggttcatctcactgttatccagatccctttttatcaacaggaaacatcagctctgcagtaacggttatatggtcctgtaagaaccaagaaagagcagctaactggcccataaaggggattgaactcacatactcagcctcattaggaactactttctaaccaagagatgcaaacaactggagaaacatacaggtggtctgcagtttccacttacagcattagcaaaacaaaacacaatgaaataaaaataaaagccctgtattaagaactgacctctatcccaagaatgatgttgattggatgtgaagctgtaatttgtccagatgtatttctaagtacatgtgacatgtcagctgcttacagatcatcggcttcctcctcacatatccagcacaaaatcaacacgaagtgacagagggaagaaacagcattgtcttgtgttctgcttccaaaaccaccttgacaagtcaactgacagcagaaaaatcccaggctccgtggaggttcccgattttcataacattagccatgcatttcaaggaaatgcatttcaagatgatcaacagtgaacttggcgagggagcactggttctgtgcagaagcagcagaaatgttctttgcctctcttaacattttgtggactcttactgtccagtctcatgagtgggaatttaagtgggaatgaaatgtaatctgggtggattcctttaatcatattgtgcaggtaaatgtcagctggcttggtaccctattcagaatccagaaaaaataagaggttcagggagggaaacagggagaggaggcagaaggaagagggtctgccacagccctttcctactacaacacaagtctgttcctggtccaagtccctgcagagaaggcttccaatagcagcagccactttgggccatgccaaatgactggggagccacaagggcctcttgggactccctcaggaaggcccccacgctccaggatccagcaactgtctggctgtcttgtttctgtccccatgtggaagtttctcccatgtaggattggatacatttaccaactggacacattactagattcacatgttcttccttttcaagtcattagtgccccattatttactcttgacacttttcaattagcaaccatttctgcaaaagagcaacttcaagagaaatgcaaatgtatattagggatgcctgatgttttaaaactcaaaataagcatagctttatggggacccatagaaccacgtattttgaaaatatcttagtactttcttgaatagaagtatggtcatgagaataatagcgttgtttttcagatggtaaacatcaatatcggccgggtggggtggctctcacgcctgtaatctcagcactttgggagtccgaggtgggcagattctgaggtcaggagatcgagaccatcctggccaacatggtgaaacctcgtctctagtaaaaatacaaaaaatagctgggtgtggtggcatgtgcctatagtctcagctactcgggaggctgaggcaggagaatcgcttgaacccaggaggcggtggttgcagtgaggtgagatcatgccgctgcactccagcctgggcaacagagtgagattccatctcaaaaaaaaaaaaaaaaaaaaagatcaatatcagtgtatacccgcggaactgtaatacaggccgatccctaaggcctccatggtgtcttacagccacacagtgtgacacaatgacatgcgccatcctggagcagggcatctcaccctccccattctctacggtctgtctggagaaagctttgtggcggcgcctgtgccctgcagggtctccagcagcatccccgctcctgcccactagatgccagcagccttctcctacttgggacgaccaactatgactccaaccattgccgaatgtctggctgagggtgggaggtgatagtgagtgtccccccatccccggccgattgaggagcagtcctagaggtattactatgatccccaggctgcagtcaataggaagcctcatgagacacacatacttgcccaaggtcacatacaattagttcactgtagacaatgcaacgtctactgtgtgctatggaacaaccgggaggaaggagacggagcccgctctaagagatggtgcccactctaagagcccccttttctgattgagctggtagcacagaaaatgtcttataaagccagggcagcctaagaagccgtgatccctggaatggggcaccgccagatacagtctccgggtggccaaatgacttctcgtcactgaagtgcttgcccggaggcctgagcgatttcctaatcctcttgcttaatgtcttctgaaaggctcattttaataagggaatgaagctgttttaagataagttaggtagcttataatatgaagtgctaatccctagcctagaaaaacgcaaaagaaaaggttttgactaaatgtctctagctataacctgatgctgttctaggaccattagcatttttttttccctgggctgcctcagtcttgacacttccttatctctcttcattggtgcgaacaatacctgagctctccctcacagcagccgtctcccacagactcccctcggatgtccgggtgggcaggtggggatggagtgagcagatcggggttggagtttggttatgcaaccattgagaagtgagatgagtctgcagcttctgcctcactgtatggataagtaagttgttgtgtccgaggctagcacccacgacagtggacacagaggtggagaaagggtatgtgggaagcagcactccagctctgttcctatcccatgggtcctgaaggagcctttcggtttcctactagatcttacctagaactatttagattatacatgtagttttgcagtaaacctagcaacttaaaggaactcatgattcgttttttattttggaagctatgtctcagaatctatgggaaaccaattacttagaaaacatggaactctggactttttaattgatcaaacactaaaagacagtgagcaaaagtcccaacctaagacagcggcacagacatcgtgtaagagcagccgctgggattcagggtctccagcacacagtgaggagaggccatgtctcagcttctccatccactcagtcagatcataaaactgaccagttttatgcactgatctaggagccgagaggtttgctgtataaatgcaaagtagtaatccaaacacttctcccttagtcggtctacacagccaaataatccccctccagaaaggcagtggggaaaagctccttcttcctttgcaggtagaaggcctcacacattctcactcttaaacgggtcaggcttctaaggcttcccatggaccatatctaatttacaggaaaaagactagagtacacagccctggtctccacagtttcaaaatagcctgcggtaactaggcattgttattatttaccagttcttatccataacttgtttgggaaatggtaataaactgatgctccgtttgaataacaccatcaatgaggtaagatactttataattattcttctacctggggaacacgctcattaggaacaagccggctggaagcttcagattgttacattgtagacactgcattctgcaaattgctggaagcactgggtagagggaggttcatgtgtgaaaaatgaggatgatgatatccacaggcagaacagtttgagggtttcagagaatgcaagaaaagctgatgctacacacgccctggctctcagggtggctgcgatgggaggggtccctcccaggccagggcaaccattctgggagacagcaagtttgccttgttgtaccattgcctgcctgggatttaaagaaggtctgtgggatgagccaccccacctagctacgtgatgactgaacatgtagcaaataagcctgtgagcacctccaccccaccccaccccggagcacccccgtcagcaggcagagcttggcctatactcactaggcatcatttctgcccgctgtggccaagtcgctctccagggtaagtccgtctcttactgatttcactaattctttctcccctctggagtttcaggatactgaaaactactcagcaaattctttaaaatctgaaatacgacaggagttaaatatgctctaaggaaaagggggaatcatttttatttagtattttcaaataaattaaagacctggcttatttaacccacaggatgggatgctgtgactgtcaccaatccatggggcaaaagggaactgacttgagcgtatggtgagaaggaaggggggcttcctggggcagggaaaattggaaaacagattcacgcagaacccccactccacaccccctgggaaacgtgcttaccccactcttccgtacccttgtttaatctgtgacattgtgattgaaatttgtcactctgggagttacatctgatgttacagcctgcagcggagctaaaccaaaataaacaatctgctctattctgcttagactaatacgacagtgatgtaaggcccgagacactggcagcggcaaaatgcttttcccacaccgcatgctgcagctgggccccatgcgtttccacgccggggataggcggcaccggcttatccacgcatggggagggttggggaggggctcaggcacaagtgcaaactttgcttgtaggcaactgagttatcctgtttcttctatcagccggcagcacgtgctcttaaggtggacttttaaaagcctttttaattttattttcccgggcatgggtgacccctgtctctctaagcctggagggtttgcaaacacgctaactggtggtggaagtgttcattgcagttcacataaagggtgtgtggctccagcacatatcgatttgaagctgcccacacagacgcattttcagttgtcttaaattaaatacccaatttattttttggtacatatttggttgcttgccagcaaatgactctcagtatattcaatggctttttgccagaaagatgacaggcttttttctttaaaaagggggtggcccctaaatagcttcctttctgaagagctcttggtggccctctggtttgtagcagctaactcggagtgcggcctttttacagccagctttgggggtgctaaatctgtgcatttttcaagcctcagtagttctggtctcaatgcagtagtattcgcttgctttcttttctcttttaaaatttccacacagggtcctgagagccctgccatatgtgggctactcatcccagcagcatgcagaggttctgcgatgccagtggtcacagggagtcccctcatctggtcatccttccatccaagatccctggctctggatgagggggaaattgccgtacatgattcagttaaaattccagcctgagtggcctcgattaaatccagcctcctacatgcaatcaattttcaattttatcacctcatacgaagcaaagcgtgaatgagagttcagggaacttggatagagataaagcagggtcctctttaatacacagatgcttgttaaacctgctcattattctacactgtgattttctacgtgtaaaccagagacgatcataattatcatatgcctctccaggatttctccacggagaaaaacctaagagtaagttcatcaaaatggaaggtagaaaacaggaagaagctaaaatgtcatatccaggtgcaaactagaagcccctcgtccaccctggccatgagctccctcccttcctctactaaagcatcccctgaaccggggagagggactccacttcccagttcttgggccttcactgctcccgagcacaagccgtaaaatgacgggagctgtgtgaggtgccaaggtctcaaatgaatgcgggcagcagcacctgtgaagctgataaaacatcagtttgcatttggctcaccttgcaagagggggttttatgcctctcgttttcgctccgctcccacactcctgtcacccagcagctcacactataaagagcatcccctgcgctctgtcttaaggaatgggcactaaataaaagaggcagcatggtgctgttaatttttcagcataggggacgctctgcctgtgacaccagatggaagaaaatgtcctgtagcctcctcccccctcatcaatgctcagtcacacctctctttaagcatccttcagctttcccgagaaactggtggaaaatggtgttgtctgaaaatctgggaatttttcccttcctcctgctaatggcctgggttgaataaacattgaagaggaaaatttagaaaaatgaaagagagaagagaaacgctctacccctagatggggctactgtccgcaagcagagtgtgtttgttttttaaaattcagttcacttacagtgagactgagattaggtatcaacagagaatttacaatttaaatcaaactttgactcatttaattaagtctttagtcctgtgaacctcattcacagccttagcattgggctgctctaggactccaattgataaacttcttaatttcctgggtgtctgggttttttttcctttaaaaaaaaaaaaaacaacccatacatcaaatccaaactgttgaataaactacaaggaaatagtagccagcagcgaatgtttatatgttccagggtaatagataatgaataataagggactgagggtgagggtagacttaacaaaatgcttggaaaagcccaggtgagcttcaatctgtccacttgggaaataagtctgaagaaggagaactgcattccaattaacatctgtaatttgcattgtatgaaagcactagaaaataatagttttgagagcttttttaatgtttccagaggtaggagtacagataatcttatttaagaagcaagcataataggtctttctgtcatttctgagctgctgaatcataggaaggacaggaaactctacctcaagtcatgagaagaaaaggtctgcatgtgtctccttagccttaacccccttgcctaggacagaaagcggctgaaggagggctctgcctcaagtgtttcttaatcattcccttcagcaatggtgctgcttttgttacatgactgctaaaagagctgacgtgtctgtattgtgtactgggcaccattttacatacattgactcatctgctccttaaaaccatgctatggtttaagtattattacaatatttactagaaaattaaataacttgtagaaactcatgacccaaatttttaaaccttattttagattcttctaagaccagggcaattgtgaaaactcagtgttacccataaataaaacagcggggcactctccttatcaggaggcagtgtgccttaaaatcagctttgaagtcaagccagacttagctgcaagtcccccctccatcactgcaggctgcatgcctttgggcaggtcacttcagccttccgagcctcaggttccaagtctgtaaaatgggttagcatcattcccatctggcaggattgtcatggggcttaaatgagataacacattaaaagtgttcaggcctcagcctggatgttagcccaggtctcgcaaatacaagaccagccaccttcctcttcctcatccttaatgcttcctaatattctctctcacctcccacactagcagcgccattgcaggaactgtccccgtcccactgcactggctggcccagtgccacatactgcagggaggagacacaagcatgcggccctggggagcgctggtctctgcacaaacacggctcttgcagctttcaccctgagctcgccctgcgccagggcagccagtcatcttgacaagagcaaggaccgagttataggtcaaggtaagtggcagaagcaactcactttgatctgtaactagagctcagggagtcccattcgaccctgcaaggggcctgacaagcacaagccccacccaggagccaatgtgtctccgcagtgcttgctctagaggaggagggactgggcgaggtggggggaggagcagcctttggttcagaagcaaaatagggggaaaaaagaggcccagaaagaaacagagaggggagaagaagcgctgttaagtgacagagccacaaacagagctctcttgtctactgaagtgatgtaggggaactgaggtggcattggagatatgcctcccacagtgagaaagattgtactgggaagagatggagagaaaggtgcccctgagggaagaaggtaagccggacactgagacaagaaaccaggaaggctgagggagcgcctggagctgggatgggctcactccaggtatacaatgtgcacgtggggataaggctgcactaagtcgggggtcacggctagtaataataagcaaatcactgggaattactctctgggtaggcacaagtgaggcctctcaaaccaccctgacgttcagggtgagggctggagctctctgctcctgacagggagcacagcactgcatcctcgcagcccaggaaagttctggcccattcgaggaggtagccgggggtcccactgactctggaatgcttggggctctattttagtccttggaaccccaggagagtcagatccctcgtctgcaaagctctagatatccctgtcccttgatttttcttgaatcaggaatgtcctctaatttcagaaattaatttgaacaatttaaagccttctgggattcagaggaggcagcttggatgctacgtggagctacaggaggggcgcagccaatcagccactgatcttcactcctcaggaacacacggaaaaaagtccactgagcaaatcagaaggcacatacccgtgtgcaaatacacaaaatgtatcctattataaaattttattagcagtgacagttttaagggagctttagcaatatttcaagctctggcatcaaaatctgacatattcaattttgcttttatcaggttatctgatgacatttctgcaaaagaggcactcgcccatctcaggctcgcccctcctctgctgggcaacacttgcctacagttggcggagccagcatggacagcatctctcttcttctgctgaggaacaaacaagggttcaaccctcaacacacaaagaccaccagcactgcttgccctttcattttatagcaagctcatgtctaaagaaacccgtaggctcgtgggcaggggaccaaatggcaagtgcagatagtgtcattacagaggactggtgagctctgcagatggcatctggggcatcacaggtgacaggcaggctgttgtggggccctgcgtgtttgtgcattattgcaaagaccgggaatcagcagctaaagtgcatctacctggttagggggcagcctgccctggacagctgagagctgggaaagccatctcgaagattgccacatcacaggagaaaagccccatccattccgctctttctttttaacaagttcaggggtacatgtgcaggatgtgcaggtttgttacataggtaaatgtggtcatgggggtttgttgtacagatgatttcatcaccaggcattaagcctagtacgtgtcagttatgatttctgagcctctccctcctcccaccctccaccttctgccaggccccagtgcctgtttttcccctccagtgtatgtgtccatgtgttctcaccatttagccctcacttataagtgagaaaatgtggtatttggttttctgtccctgttttagtttgctaaggataatggcctccagctccacccatgtccctgcaagggaaatggtctcattcttttttttggctacatggtattccacatggtatatacgtaccacattttagaaatgcaaatcaaaaccacaatgagataccatctcacactggtcagaatggctattattaaaaagtcaaaaaaaaacagatgctggtgagactatggagaaaaaggaatgcttatacactgctgatgggattgtaaaaaaagttcagccactgtggaagacagtgtgatgattcctcaaagacctaaaggcagaaataccatttgacccagcaatcccattactgtgtgtataccaaaaggaatataaatctttctatgacaaagacacatgcatatgtttgttgcaacagtattcacaaagcaaagccatggaatcaatttttcttaataaatgaatccaggaacaaaagagaaggctccatgaaacccattaggtgcacagcaagagggtgaggaggttaagagggaatgagcatatctcctaatgacagagtctctccttgacccaacgttagtcaggctcttctgaatcctcttcctatctgccatgacttttaggctttctttttccttttttttttttttgagacagggtctcactctgttgcccaggctggagtgcactggcgtaatctctgctcacagtaaactccactacccaggttcaagctattcttgtgcctcagcctcctgagtagctgggattacaggcgtgtgccaccacgcccagctaatttttgtatttttattagagatggggtttcaccatgttggccaggctggtctcgaactcctgacctcaggtgatctgcccacctcggcctcccaaagtgctgggattacagatgtgagccaccacgcctggcccacttttagactttcttatccatctttgcatccctcaattttagcaagatctggctaagttggtttaccttcaatatctgatcacccttgatataagattggtttcttcattccctgccatcttccaggtgacatctgatcacctcggcctgcctacagcaagaatcctattggcaaataattactttgccttctgagtaattttctatccaacaacccccaaccactctgtctcatcctgctcttggactacaaatccccaatttttccttattgtatttggagttgagtccaatctccttcccctgctgcaaaaccccattgcagtaatcccctccaaataaagcctgccttactgttctttaacaagtgccaggaataatttttaagcactaacccaaatttctttcctgtactccttacaacaagatgtaaggagcacactcggcttgtcctcaggttgcatttattaaacaaaagctaaaatccccctttcaaatatgagaacataaagcatataagagagaagtgtttcctgggtgatccaaattaaaaataagagccatgggccaggtgtggtggctcactcctgtaatcccagcactttgggaggccaaggcaggcacacttaagttcaggagttcaagaccatagtgaaacctcgtctttactaaaaatacaaaatttagctaggcacctgtaatcccagctacttgggaggctgaggcaggaggatcacttgaatctgggaggcaaaggttgcagtgagtggagatggcaccactgcactccagcctgggcaacagaatgagactctaaaaaaaaaaaaaaaatagccatgggcaagagagacatgtccttgctgatttctccccttgaatctggcccactgaggacacctcttccttctcttttttttctttttctttttttgagacagagtctcgctctgtcacccaggctggagtgcaatggcacgatctcagctcactgcaaccaccacttccagggttcacacgattctcctgcctcagcctcacaagtaggtgggattacaggtgcctgccaccatgcctggctaattgagatgggttttcactatgttggccagactggtctcaaactcctgacctcgtgatctgccctcctcggcctcccaaagtgctgggattacaggcgtgagccactgcaccccgcctcttccttctctttattctgcctgaggatgcacgttctcttttgacagtttcagcggattgaggctgaatgttaagttttctgccaaaatgggttcagtatcttgtcagctatttcctctgctgaaacgaactttcatctttaatctactcaggagtgctatgtatgacaggcgatccttggaggagagaagtctgagggacagcctgctactgtatttaaattggcttcacccagacagataaatacaaagataaggttaataagggttaataatttatagtcagaaaagtttaagaggattgcataatttaagcctcccgtgaaggccccaaaccaaactctatattattatcctgaagccgggtctactccgtgactctccttctgaataacagcccctcatgagtctcccagatacctgacctcaaaaccacagagccactgaagccaccttctgtctccttctccatcttctctgagagacagctggttaatcaggtcaaattattcttatctgattattagtcattagcagttatagttattctctagtaccttccacatttgttcttatttttattctcacttggatacttaagaataaaattcttctgcttattttgtttgaatccgtggattttaagaattattcctggctgggcgcagtggctcacgcctataatcccagcactttgagaggccaaggaggggagattacttaaggtcaggagtttgagaccaatctggccaacatggtgaaaccccatctctactaaaaatacaaaaaggaattagataggcatggtggcgggcacctgtaatcccagctacttaggaggctgaggtagaaaaattgcttgaacctgggaggcggaggttagagtgagctgaaattgtgtcactgcactgcagcctgggcaacagagcaagcctccatctctaaataaattcattcattcattcatgcattcattcattccatagtacagctacgatcatgttggtgccccattcaaactcagtttgcatcgagggtgaatctccctcccctccctaggatccctgttgggatctctggagatggtaacctgcgtggaaggctccaggctctggtcctcaccctctctgtgaattccacttgaaagcctttctgcctacgtgaagatgcagatgaaggacccgaggcttaaggcaacaagaaaatttagaatagttagcagccgagataatgaataagaattttcagtaacttctgggcaacataaaagtggagtgctcagtctgcaatttttgccccatcacctttaataagcatgaagcaaaatgaacaaaaagaatattaaacttttaaagactaaaagatctttcaaaatatattcctcgcttataatggtggcaatgaccctttccctttgttacctagctgaaaaaaaattacaaagtcgcatcaaaagcagaaatgaacattgcagaatgggagtagaatagtttgcctccaaggaaagtgattgaaagttgattatccggtttgttaaacagctaacattgaaccctgtggtcgggttttgggtgaagactctaagcctgaaaggccatggtcagggtctctctacggagctggacggttggactttctgctgtcgtggcaatgttctgtatctactctgtccatatcctggctactggctgcatgtggctgttgaaccacaactgaggaactgagtttttgttttattgaattttaattaatttttaaggctaatttaaagagctacatgctgctagaagctaccacattggacagcacagaataaggcattcatgctgctccacctttccccgattcttgttcacaaggtcagaggttgaggaaatgtcaatgcaaaacagaagggggtataaggcagcaggacagaccctccacccccaccccggaagcagaatcacacgcttcgcttcaggcctgcctgcctcctggtgtgcaatgctgatgtcagccgtggagttggcgtatgtgttctgtggaatatctcataagttaaggagtctataattagtactgggaatctaaataataatcatgataacaagaactaaccttgatagagcgtttactaatagaaagtcctttacacaggtacaaaccagttgggtagctttatgtaaatgagcgggacagaggcctagaaaattcaaacagcttggccaagaccataagattaataagtggtagagtcagaacttgaacctacttctctctgactgaaaatcaatcaactcttaaacagtaaacatttaaagtgggattgtggctcagctgctcaaccagtggaccaaacaactaattctctgagaccctgggccaccagtagatgcccaggacagcaagagcccctggccagtagcctctaggctggtggcgtctgtccagaagcagcagtatctctccaccacagtgtgccctacaaatatcatcactgtcttcacgtggaacgaggaaaaaatgtctaggaagcactgaacgacattctaaggaaaaccatgtgggtcattcccaaagagctggtcatgaacaagaccccaaggatgctagcacaccatttgactgactccaagaacagtattggaggcaggaaaatgtcctcacgtgccacaagattttaaattctaatttgcagtagaaggaattataaataggacaaagtcagaaatcaccccaatttttgcatagccagggtcggttaaattcatgaataatgatgagaaaatgaagaccctaggattaaagtggtagcttagtttccgtaaagacattaaagatatatacatctcagtaaagaagcttcctaacactgtcattctcagacaatggtcaaatcaggtgtttccacatggcttcttagagcaaagtttcttcaggacaatgggacatttgtaaaagagacccaagctttgatctgatccatgacagggaggctgctggtattcactgagtctgtcgccacatcaacctggtgaaggcttgggcagcacctgtcaatccgacacgaagaggtgttccatgagtttaatggacaccgtgtgccaactccattttaggttattaatatcaattggagggaaaagaggaaaacggggagagattgctcaatagtggattttaaaagtcttttgttgcatcttgctgaatttggtcccaacttccctcatctaacaaaagataaaaataggctccaaggctgttatgctgagagttaacatgagggaggacttatccctcattttcttgatatctatcccatgtgaagagaagttttgtaactgtgaaatgatatctaatgcgggttctaatatagaaacatatttcttccaatgtctcacactccctttcattcgagcgaccaagtcctgctcacatataattttattagaacttttctcaagggttactattaatactcagaataccaataacaactataatgtatttaccacataccaggtaataggctattttacatagattatcttagaatttccctaaagcccttgaaagataattattatgctctttatgcaacagatttgttcactcattcattcaacgcatatttattgagcacctgcccaacagcagtgggcatttcttacccgttgctgttgggagcacagggcccaagcaggctccctgtccccagtgaggaaaatacaggtatatccaaaggattacatcatagttcttacataaaattattctgttaccatatgctcacatgacaatactgcttctttacaaaatggtatctgcgtgagtgaaaaacaattcagggtgggtgggtgggagactcgggtcttgtgtctccagatttgggtcccaccttaccaaattccatcatgtagaaaaagaaaattcctcaatgtaattgctcctgtgttgatataattgatatccttccagaggaggaaaacctagtttttaatctattttgcattgttcaccttctcagcaccacatacttagaataagcaggaatgatggctctatcactgtaccatgaggagatgagactatggatgctgtgccagggtctgtaagacttttaaacaagagctttgtttgattccattattaatctcatcagagagaggcccaaaagtcatttaagatttggttactgggccaggcacggtggctcacacctgcaatcccagcactgtgggaggccggggtgggcagatcaagaggtcaagagatcgagatcatcctggccaacatggtgaaaccccgtctctactaaaaatacaaaaattagccgggtgtggtggcgggtgcctgtagtcccagctacttgggaggctgaggcaggagaattgcttgaaccagggagttggaggttgcagtgagcggagatggcgccactgtagtccagcctggtgacagagcaagactctgtctaaaaaaaaaaaaatttgttactgaatgtgggtttgaatgggttaaaaagctggcacagaaatgcaaaaaactaccgattttctctaaggagactatcagaagaaatgcaactttgtcctgccttgcccaagggcagagaaggttgcagacatcctctcccctcctcagctgtctacatcaagtggttgaggggtgggtattttgtggcatgaataagaggattattgtgcagcaaacacttgatttctaagcattttacctgtacttttttagattttagtctttgcctttttttttttcctatttgtttcccacttagtaccttagaatttgcctttttaatgcaaaattagcatagtaaaaaaattgaatccggggtgcatcacttagaaaagttaaagaagattttcaaaattaattgttgacaagactcagcaaatatttgctgaatacctgttatgtgccaggtaatgtcataaaccctaggcataggactgggaaccaggtcctctcttcttggaattcacattctatttcacaagggttgggaaagaggaagaaatacagaatggaaactctgccctgagcacaaaacctgtgcatttggttagaagaaggctggtgctctgcacacaggggcctaagagaggaatatgaggtagtggagctctcagtgacctcgctgttagagctgtagggaagatttaggtcaccgccttatcttacaagtgaggaaactgataccaaaagagactggaattattgtctgaggtcacccaggctgtcccactggatgtcaggtaccgcctcttcaggactattcattagcatttgtgaaagtcaagatataacagcatatttcgccttatttctttcttttcctctttatgttgtatttttctttttgggtcattgttttgcattaatgttcatagacaatttttcaccatttatgtaggattagttctcattgaaatattaattccacattttcaataatttatatgatttgatgtcacaaatatctggataatttgatatagcatcaaaaaaaggctttctctaccttcatgtattatcatataatgcattttcttatcatagggaaatcaaaatgtgtctctctaattccttttggttttttaaattttatgagtttaacatgcgtgatatataaatcacagtcaaacattttcttcttacctcatctgatttcgtttgataaaatcaactccatctatatgtatgtcttttagaaatacgtctcagtttttcccaaatgggtatgtcttacatctaatgcgtgagaaaaaattccagtagcacctccctggggaatctgaactaggccctggttatgctaatagaagccaagaggttttcaaagcaaaagaactataataaattattcataaataggtctctctcttgatggttttggtgtttccgaattttccagaccatagaggatatgtgaaacgatacatgcacgctaagctgaagatgttacagagggaaatgggaattgaaaactaattggaattttaaagcattgcatttttgcatttggtacactttctggagctggtttgggcatggacaagacccaggagcctgcttttctggtggtccttggtgactacggatatttttaacaggcagggactggtttctgaggaaagtgtgtcccagttcccaaaggaaaatgactcctcagtgactgttagccctcgaggcagttccagatgaggtgctagacttaattcaggttgccagtctacagaaatgaagactttacttggcatactgctcgtttgcacttggtttgtcagactctctacctcctcttccttctttttcttaaacttgtttttcagtttgttcctctgggtctctacattgccaaacccaagggcacctcctagtctgcgtgacggacccccacgcctggtccagtccacaggtgccatggttttgttgtacctgccaacatttcaactgttttagaattcttttttgtcttaatgggtgttgacaggttttaaaatgtttcctgcttatttctacttgcaattttctgatctctgtaatttaaactaattgcatctactttgttatttattccattttttgtactcatttaatagaaaaaataataatttcttcaacttcagtcttttgtgtttgccgaaacccaccctggcctcacatgttcaagttaagccctgcccccaccttcctcacactcccatagggtcacagaccatgcactgatttacctgcctttaggagcccccaaactccttccttttgagatttttctttgtaatgaatgtcctcgccatgatcacaacccaaataaaaactcttcagtcgtctgctgtattttgtctttaacagtgaacagaattcaattcgaattttgggttcacatttagtcttataatttaagaaagaataggaaaaaacggagagcaacttgatttgaaaaagacaaatctgaggcgggtgagagattctaagtcctgatgtgcttggaacagtccagacctctgtcaattgtcccagcaaaattattaccagcacccccttttacactcagaagatcctggtctagatgaagaatcatatgtgcgtcagctattttcgctaccgtaaagcccagcccagcacagtcccaaggatagagtaagcagccaatatacatttactgagttaggaataaaaagatgccagcggtcaccctccttccctcatggtgggagccagggaagctgacgctactacaaagctatggcgtcacaggtactggacactggctagtcacatatttatatgactcctggaagacagccatgagtagatggctattatccatattttaataatatctgctaagaaaaataacaattttgagatagcacttgtggaatgagtcctccatatttaatgaaccagggaaacataagggaaaggttaaacaattctatgaagccaggcgcggcagctgacgcctataatcccagcactttggaaggctgaggtgcgtggatcacgaggtcaagagatagagaccatcctggccaacatggtgaaacctcatctctactaaaaatacaaaaattagctgggtgtggtggcgcggctgtagtcccggctacttgggaggctgaggcaggagaatcgcttgaacccgggaggcagaggttgcagtgagctgagattgcaccactgcactccagcctggtgacagagcgagactacgtctcaaaaaaaaaaaaaaaaaaaactctacaaaataggagaaatatctaaaagtttttttcttgtttgtctttatgaagggcttcttcccgttcagtaataatttcccttgcaatggagcaaaacttgagacaataagggactcaggaatgtgttgaaagctcatgaggaatttagtctaattccttcattgtgagttgctggcattctactccatttgcattcagcctcctgttaccaccaatgctccccatcagtaacagtcatactaatgtggggtggaatgagaaactctcagtgcttccaatgctataaccacttgcctatcccagtttccaatctcctttaaatactggggatgttaaaggtaactgagtttatgccttggattgtctgtgaaatcgtaggaaaatacatgtgatcttccaatgccccagtacttacaaataacgatactttattgccatggatttaacgtgtcctccaaagttcctaagttggacacttaatccctgatgcaacaatgttgagagatgggacctttaagaggtgattaggttatgagggctctgctctcatgaatggattaatgtcgttctcatgggagtgagttccttatcaaaggatgcatttggcccatttctctttctctttctctctctctctcagtctcttgcccatgtgatgtcttcaccatgttatgaatcagtaggaagaccctcaccagatgcaggccccatgatcttggacttccagactccagaactatgagccaaataagtttctgttaattataaattgcctagtctgtggtattctattatagcagcacaaaagagaataagccgattactatattatgtttcagaagcttttcaagaatcactcttatattatgcacaaataatgtgttttgtttgttttttttttgagacagagtctcactctgttgtccaggctggaatgcagtggcgtgatctcagctcactgcaatctcggcctgatgggctcaagtgattctcgtacgtgcctcagcctcctgagcagctgggaccacaggctcccaccaccatgcctggctaatttttgtatttttggtagagacagggtttcaccctgttggccagtctggtctcgaactcctgacctcaggtgatccacccgctgaagtcctgggattacaggtgtgagtcaccgcacctggcccaaataacgtgtttttaatagttactgtgggccaggtgcagtggctcacgcctgtaatcccagcacttttggaggccgaggcgggcggatcacctgaggtcaggagtttgagaccagcctggccaacatggcgaaaacatatctctaccaaaaatacaaaaattagccgggcgtggtagcacacacctgtggtcccagctgctcaagaggctgaggcaggagaatctcttgaacctgggagacagaggttgcagtgagctgagattgtgccactgcactccagcctgggtgacagagcaggactccgtctcaaaaaaaaaaaaaaaattaattgttactgtgaggaagatgatagccacagagggaattttttaaataaacaacctttcaacaggaagacagagaagaaatataaaacacaatcacatgggaggctgagatgggaggatcccttgaggccaggagtttgagaccagcctggacaacatagtgagactccatctctacaaaaaacaaacaaagaaacaaaatgagccaggtggtggtgcaagcctatagtcttagctactcgggagttggaggcgggaggatcacttgaacccaagagtttgaggctgcaatgagctatgatcacatcactgcactccagcgcgggtgacaaagcaaggctctgtctctaaaccacacactcagacacatatgccatcacacacacacaatcacaaagcatcagtcaggaaggccagcaagagcagaacacagaatgttaggatttcaaggtagaagctcaacactcaattcaaggtaaacttgataagaatttgcaacaagaccaatgatctgctaggtattataatgaatagaaaagcaatatggggttctggctgtaaagcaactgagcttttttgaagaaacattaaatgcacacataaaacccctgaatgtatgtcagcagatgacgaatggctctaaagtggtatggaataaaaaggaaaaatcatgaaaaaagaaggcccaccaaattggaacatctacttggaaaacttgagaaagaacagttttggttgggagtcaagtgcagttaacaggattcagagtgagcaccgcgtgggcctctgaggtcagaaaccagagggaggccagagaaatgagatgagctacaaagtgcctcaggaaagagacagctgggaccagatgacacacacaccatggcctgtttttatgttttatgtcagttttaagagacactgggattttcctaaaacaatatatatttgatggaaaagtgctgtccatttcagtagcaaaatcactttattatattgctgggaaaacttgagaactgaaagttggaagacagcaggtggaggttataaatttgatattaatatggcaatatggagtgagatttatgggctctgatagaatgtgatcttttactgaaaactgtttttactttcttatatgtatctcagtgatttgaccctggttttatgtgaatattgttttaggggatgtagttttctgaatacaatttattttattcaaatgactgcttacggatagatagctatggactagtgcggctacagtttcaataaacagtccaataacattggaagataagttttgaaagactgtaagaagccaaagaataagtttagacaattacatatttggatataattgcttttgaagtcaatattcaattttaaactgtttaagataatatgtttttgcttttatctaaagtatatgagagacttacaccaagcactaaactgaaattgtggtatgcaacatgactctacttaacagagctaggaatactgtcagtttgcaaaggtaaaattacttcgactttttctctggaaaactgaaatgaattcctttggaaattaaagtcctcgttgctttacaaacatcatttcattatgcaggagatctttactcacaaacattcatatcacacaatgtcagaaacacgacaaggagagaaggcatggggctgtggtcaacccacaaaagacaggcttttatccccagctctaagaatttcccacagacattactaacccatcatgcccattcagtgcacacagagtgacaaggtttcaagtggcgctgcagtgagagactactatgacaacgaacacaaaagaacagacattttaaaacactaaaaattggcccggtatggtggctcatgcctgtaatcccaacacttcgggagaccaaggcaggtggatcacttgaggtcaggagttcgaaaccagcctggccatcatggtgaaaccctgtttctacataaaaaaaaaaaaaaaaaaaaattagccaggcatagtggcaggcacctgtaatcccagctacccaggaagccaaggcaggagaatcgcttgaacctgagaggtggaagttgcagtgagccgagatcacgctgttgcattctagcctgggtgacagagcaagattccatatcaaaaacaaacatacaaacaaacaaaaaacaaaccactaaaaattaaatgaaaattaagattaaaaaatattaaaaataaaaaataacagaaaaaaattaactgaaaattcgaaatgcatatgtgatgaaatgttaggcaggaagaatcagcaggagggacaaccgccaaaaatgaaagctgcaaaaagtaattttttctgtctattcaacccacaatcatcacaggctatatttgaaaagtaggtaggtgtacttacctacatatagctgtttgtaggttatatttgaaaagtaggtaaggtgtacttacctacatataactgcacttacatacagttatacatatacctacatctaatgtagttatggttttttaagagagtaaagaataaaatggaagactaccattactgacagtcttctaaaaggcagtcaccatagcatgattaatttattcctggtgttctcttggtcctcacatacttgattctcttgaaaccagtgaaaaactcgcatgtcttactgctagatctagaaaagtggttctcggccgggcgcggtggctcatgcctgtaatcccagcagtctgggaggccgaggcgggtggatcatgaggttaggagttcaagacaagcctggccaacacagtgaaacactgtctctaccaaaaatataaaaattcgctgggcagggtggtgtgtgcctgtagtcccagctactgaggaggctgaggcaggagaattccttgaacccaggaggtggaggttgcagtgagccgagatcatgccactgcactccagcttgggcaacagagtgagacttcatctcaaaaaaaaaaaaaaaagaaaaaaaaaaagaaaaagaaaagtggttctcacaatgcacaccttgcaccagaaccacctggagaactttgtaaaaatgcagctgcttgctcaccacccccagaacctctttctgcgatgatcagggtggggttttgggcactgatatttgtaagatctgcatcaagtgattctaacatgctgccagttaagaaacactggttaacaaggagacacatatgaaacctcatatatcagacatctaacctacccttatttcttttattctcaaatctccatctcagctttcttcttcatttagaatttggatataaaccgtaactattaaaattgactgaatatatctaaaaatcattgattcatttacttattgcacacatacataatccaccattcatctgatgagatcacagcatttagaagagtactccaaacacaggctgctaaatcctcatctgttgattgggtctttaaaacattactattgttcactttcatactgacaacaatgttatgctatagggtaagctcaaatttaattttctttctttacgctgttctttattgtattttttccattaaaataatatttgacagataatccttatacctgttgcttcaaataataaaaataacctaacttattttatgagactaatatcttgttacccaactggataagaacaatgtaagaaaagaaaattacaggccaattttacataaggctatagatataaaaatccttcgtaaatattatctaacataagaaagtgtacagttaaaaaagcagaatcaagcagggttcatcccaaggatttaagaatagtttaacatcagaaaatctatgtatgtagttcatcaggttaacagactagaggagaaacttttcatgctacttagatgctaggaaagcatgagtccaagcacagggtctctgtctctctgcctcaataattctccagattacgatcaaagatctgctaggtgcggtggctcacgcctgtaaacccagcactttgggaggccgaggtgggcagatcacctgaggtcaggagttcaagaccagcctggtcaacacggtgaaacccagtctctactaaaaatacaaaaattagccaggcatgagggcgggcacctgtaatcccagctgctcgggaagctgaggcaggagaatcatttgaacccgggaggcggaggttgcagcgagccgagattgcgccactgcactccagcctggtcaatgagagtgaaatgccatctcaaaataaataaataaataaataaataagattgaaaatgaactgcttcttctacagagcttctgtaggatgaaaaaaaggcgctgatatatgctttctgtaatttgactcaatgggtttttgaatccttcatataaatttataacatcatatttcatttattagaaggtacatatactgtttttttagtagcacatttttaccataaatggtgactgtaatcgataaaacagagtattcaatatatttctacaaatgtgtattcccttctccccagagaacatcatagtataaggtgatctccagttttcttctgattctatgatttaaaaatcatccctgttctgaagctcttaagtattttgtttcttttaggtgcattggaacaccaaaatcactcatctgtttctttattcttgcttcccgctactcaagaacataaaataaaagctctcaagtactaaaatactgggctttatataaactagagtttatataaatactgaaaaatatttcttcctagaggtcagactgtcttcagggtcatggctaacataagcatttgcttagataaaaagttgacatttttttctgtaaagaatcagagagtagtcctggcacagtactttgggaggctgaggcaggtggatcacctgaggtcaggagttcaagaccagcctggccaacgtggtaaaaccccatctctacaaaaatacaaaaattagctgggcatgatggtgggtgcctgtaatcccagctactcgggaggctgaggcaggtgaatcgcttgagcccgggaggcagaagttgcagtgagccaagatcgaaccacggaactccagcctgggcgacagagtgagactccgcctcaaaaaataagaagaatcagagagtaagtgttttggctttgtaaaccatacatcctctatcagaacggctcaactctaccactgcggtgtgaaagcagccacagacaatgcatatgagtagggttgcatttcaatacaactttacttacaaaacaggtggtgggctgcatttggtgcatggatcctagtttgctgacacctggcttagatgcagtgcacccactgaggaacaggtgtgtcctactctgaaagcagcatgagctagtctgactacttatttcaaatcaatactatattttttaaatggcccacattttcaatctagcaaatctacattggggtatgtgtatgggtgtgcccatatgtctgtatctgttaaatgtatcagtttgcttttaaaatgttgagacacagctcacataagcagaatatcagttcaaagcagttctggccaactcagtttaaaaaataacaacattggtgtgttactaatactaccatttctatacgtagcatgatttctcctctctggtttaataacagtcatccaagtgtgacttcaagtaatgatcacttccagtgagctcgagtttactgctaaggtgtgaggttggaaagaggaagacacaacttcatggagatcaaatcactcatgaccttaacagccaaataagtattaaatggctgcaaggtaacaggtaggcaaggtttgttgtagcatccaattatcacgttggtgcaaagacactcagtagacaacaagtatctaatggccaaggagctgaaacttatgaattggctgtttaaaaaatatatttgccataattccttctcacacctaagtttcccaaaaggaatgcataaagcaggtactaataatggaacaaaaataataaagtgcttgccagggtagttgattccttttgaaaactgatcacaagtaagagattttagttacagctttcttttgcttcaatgatttgctaagaatccataaggataacctattcagatactattatcacatgagacatgatatgtgaagcaaaaactgttacgggaatttctgcttgcatgtacactggctgttaggttacagaatagaaataggattcctctgcatatttaacattggttctccatttgtagccggacaaccagatagtactgatttcaaagtcactgttaaaaactctaaaaacttagatttcggtaacatgtcatcacattgcacgaaaactggacctgccactaggcttggagaagctctgatgtgctataaacagccctaaccatcaagatggtaaaggctagtgtgacccagagacttctgctctctgaatacccacccccaccttcacctattccctttataaatgctaacagagcccgggaactttctgttccagagtgagcctgcaacagcattctcttgggtgaaatgctcttcccgttggcggtgagaatccttcctccttattctaacccatgctccccacagaggaggaggaaccctgagcttctcttagggaccatggcagagggttggaggcatggaggcagctctgcatggccttttaatgcttagtatgctcagggtgccgcctttcaattaactagcacagctgtacttttttttttttttttttttgagacagaggctcgctcttgttgcctaggctggagcacagtggcgtgatcttggctcactgcaacctccgtctcctgggttcaagcgattctcctattctcctgcctcggcctcccgagtagctgggattacaggtgcccaccaacatacccagctaatttttgtatttttattagagatggggtttcaccatgttggccaggctggtctcgaactcctgacctcaagtgatccaccacctcggccttccaaagtgctgggattacaggcataagccaccacacaaggccacagcgatactttttgactaagtaaggcttccgtaagagttttcacacacatgccccaaatcctggattatatgagacaaaaataaataggccacgtgtgctaattgcgtacctctctcttctcacatttcggttttctagaaatgagaacgcaggccagacgcggtgactgacgcctgtaatcccagcactttgggaggccaaggcgggtggatcacaaggtcaggagatcgagaccatcctggccaacatgctgaaactccatctctactaaaaatacaaaaataagctgggcatggtggcgcatgcctgtatgcctgtaatctcagctactcgggaggatgtggcagaagaattgcttgaatcagggagttggaggtttcagtgagttgagatcatgccagtgtactccagcctgggtgacagagtgagactctctctcaaaaaaaaaaaaaaaaaaagagaaagagcatttcttgtatgtcttgtgacaagagttaacaaaaacagtcctgcttcttaactgttggtgacatttgtaaaggtcccatggttatgcttattcagtgggattccgtcttcttgcatgtctaatggtgttagaaggcctgaaactatgcctaaaactatggttttatcccagagagaaaaataaattcatatcaagaaaaatactaagatttatatataaagcaacaataatggcaataataattctatggtgtaattcccctgagaaaaactgaacggaacaatggttaatcttaaaatattctacagtagagctcaggacttagtataattgcctgctactagtctcgtgataacagtcgaagctagttttgtggagggtttttttgacacttcaaaattatcatgttgtcttcaaggtcacaaatcaaagtctcatctattagtgtataatagtaagtttacagttttaaaatattttatcattaagaaaatattaactgcaaatttaaaaaaagtactaagtggaagtaagcgaaaagacagatattgtgatgaaaagaaagaccttctttccctgcctttttgagtgtattgattcattcatttaactgatacttgttgagtgtctcctttgttgtggtccttctgtgaagcacctccattcaacagaccctttctttgggtaagtgtgtataagtttcaacaagggaaatccatgtatgcatgcaattgtagagactaggacacttggtgataaaggacttgaaaaggaaattaatatcccacttaaatcttctttttcaacatcagattttacaatatttgcgatctcgcactcactttttctaaaacaactcattggacaccgttgcctcatcacagccctaaaacagaactccctctttcggtcagtaacaccatcatcttcctagttttaaaaccttggagtctgttttttttcttgtaaatttgttgaagttccttgtagattctggatattagacttttgtcaggtgggtagattgcaaaaattatctcccattctgtaggttgcctgttcactctgattatagtttcttgtgctgtgcagaagctctttagttcaaccccatcaaaagaggacaaaggatatgaagagacacttctcaaaagaagacatttatgtgaccaacaaacgtataaacaaaagctcatcatcactggtcattagagaaatgcaaatcaaaaccacaatgagataccatcttacaccagtcagaatggcgattattaaaaagtcaggaaacaacagatgctggcaaagctgtggagaaaaaggaatgctcttacactgttggtgggagtgtaaattagttcagccattgtggaagacagtgtggcgattcctcaatcatctagaaccagaaataccatttgacctggtaatcccattactgggtatatgcccaaaggattataaatcattctactataaagacacatgcacacgtacgtttattgcagcagtatttacaatagcaaagaaccatcccaaatgcccatcaatgatagactggttaaagaaaatgtggcacatatacaccatggaatactatgcagccataaaaaaggatgagtttgtgtcctttgcagggacatggatgaaactggaaagccatcattctcagcaaactaacacaggaacagaaaaccaaacaatgcatgttctcactcataaatgggagttgaacaatgagaacacatggacacagggaggggaacttcacacaccagggcctgttgggcaatggggggtaaaggcagggagagcattagaacaaatacgtaatgcatgtggggcttataacctagatgatgggttgaggggtgcagcaaaccaccatggcaaatgtatacctatgtaacaaacctgcacgttctgcacatgtatcccagaacttaaaagtaaaatttttttaaaaagtataaacattcaaaaaaaaaaaaaaaaaccttagagtcgtcagttgcacccctttttcttctccctcatatgcagataatccccaaatcctaccaactgtcccttgaaatgtctcacaatctgttttttccattcaactaagatataaatgtgaggtatctttcaaaaacctgatagtaattgaaaaatattctaagaacttccacttgagctgatattgaagctgggtgactagatttgtttcctgtcacttcctcaactaatgatcacaaacttgctgccttaatataacagaaatttatctcctatcaaggggaggccagaagtctaacacgactgtgcttgctctgaagagtctatgggagaatatattctttgcctctttcagtttctggtggctgccctggcattcctggatttgggccacatcactgcaatctttgcctctgtcttcatatcttctcttctaaggacatttgttattggatttagggcccacccagataatccaggatgactgactcaaatcaagagccttaatttatctgcaaagacgctttttccacatatggtcatattcacaggttccaaggatgcagacacatgattttggaagccactattcaacccactacagtgaattagttcctccctttccctgaaatgaatgcacaagtctcctagccttttttgagtcaggcttgtcggggattactcgaataggaaattccctaaattgttctagccttggcaactctaagtgggagcagagagagtaaggctggtggtgaaagcagttttccttcctactgcaactttattcacctctgcattggctgagcttaacataatggaaggttaaatacagaaataaatgaatgaataagtgaataggcacaggaatgaaggagtaattaatgaatggactaaagaccaaagggatctcaagagtataaattcccatgagctcccctactgtgaccccagcctggagtaacggggtaaaaaaaaaagattccttttggtctactgagcctgtggaagagagaggaatgaaccaccatggctgtgaggtccagctacaaatgggaggtttgtcccttagaatcaaaggctggtggcagcttcccttccattcagaggcgagaaggagtccaagccattcagaggtaagaaggagtccaagtcacacagaagcaacgaagacccgtctatctctgaagtggtcagaagtaaaagctatttcctgtttggtttgtttttttaagagaaagactatgatgtcagaggtacaagacaccatgatcatattgcaacagtcctaagatggtgacacatgtcagacaatcagatcttctcaaattcttaaaattattatccaggatgaactgattttcacctaaacataaagatcaagaagaatcaagctgcttttgtgttcatatgaacaacaaaatgtctcaaaataagcaaaacctcaattgaaagagaggcttgagattacaacgtgaaaactgtttcttgccattattctgttttgggatattcttctctataatgcatttatcactaaagaacattcaatttttgagacagaagaataacataaaagattattccacaagataaagaaaatgccactttgacacagacctctccttttctgtttgtcattcccttgactttgtaaaaaaggaaaaccatgttccttggatttattaaaaaaaaaaagggaaaaaacattctgtgttgttgtgtatacgtttttaaattatcaatctgctcaggactgacaaacatgaaaagaattaatttaatgccaaaaaatctgagaaataatttatgtttaacaagtatgcccccttattcctgtgtgtgtactgtacaacagtgtcctactcttaagaaaagtgagtttagaaagatatttgctcatgtggtttttcaaaattgagtatgacatttcctggaagtgatggtgaaggtaatctctgtatgacaattaacccagtcatcagcaccatacacctgggcaaggggctcaagaatgaaaatctctacacttcccgcctctactccaggtggaaagtcacagggtgggagggcaggcttgagatccaagagaagacttttaacactttaaggtatataggcatagctcatagctgtcatgggcttggttccagaccaccataataaagggaatactgcaataaagtgagtcccatgaatgttttggtttcccagtgcatataaaagccatgtttatactatgccatagtcatattaagtgtacaagagcattatgtctcaaaaaagtacataccttaatttaaaactattttattgctaaaaatgctaatgatcatctgagcattcagcagcttttaattttttgctggtagagggtcttgcctcaacgctgatggctgctgactgaccagggcagtggttgctgaagattggggtgactatagtggttccatacaataaaacgaagacaaagttggccccatcatttgactcctcctttcatgaaagatttctctgtagcatatggtgctatttgattatattttactcacggtagaattttttcaaaattggagtcaatcctctcaaaccctgctgctgcctcatcaactaagtgtatgtaatattctaaatcctttgttgtcatctcaacaatgttcacaccatcttcaccaggagtagattccatctcaagaagccactttctttgttcacccataagatgcgattcctcacctgttcaagtttgattatgagattacagcaattcagtcacatcttcaggctccacttctcatgctatttctcttgctatttccaccatatctgcagtcacttcctccactgaagtcttgaagctctgaaagtcatccatgagggttgaaaccaactttttcaaagctcctgttaatgttgatattttgtctttcacccatgaatcatgaatcgttttaatgacatctagaatggtgaattctttccaaaaggtgtttttgtttgtttgtttgtttttgttttagtttgttttgtttttttgagacagaatctcgcactgttgcctgggctggagtgcagtggcatgatctcaactcactgcaacctccacgtcccaagttcaagtgattctcctgccctagcctcctgagtagctgggattacagtcgcccaccacacctggctaattttttcgtatttttagtagagacggggtttcactatgttggccagagtggtctcaaactcctgaccttgtgatccgcctgccctggcctcacaaagtgctgggattacaggcgtgaaccatcgtgcccggcctccaaaaggttttcaatgtattttgcccagatccgtcagaggaatcactttgaaaatgtgtttttaaattgcaattcttagaagtcaaaaaaacttcttgatccatgggctgcagaatgggtgttgtgtcagcagggatgaaaacaacattcatgtccttgtacatctccatcagagcgcttgggtgaccaggtacattctcagtgagtagttatattttgaaaggaacccttctttctgagcagtagttttcaacaatgggcttaaaacattgagtaaaccatggtgtaaacagatgtactgtaatcccgactttgttgttccctttatagagcacaggcagagtcaacgtggcctaattcttaagggtcttaggattttaatggtaaatgagcatttgctcccacttaaagtcaccagctgcattagcccctaacaagggagtcagcctatccttggaagctttgaagccaggaatcgatttttttttatccaactatgaaagtcctagatggcatctttttacaacagaaggctgtttcatctgcactgacaatctattgtttaatgtagccagatacatcaaacatttaagctagatcttctggataacttgctgcttcaccttgaactttcatacgatgtagacggcttctttccttaaatctcatgaaccaacctctgctaacttcaaacttttctcatgcaactttctcacctctctcagccttcacagaattgaagagagttagggccttgctctggattaggttttggcttaagggagtgttgtggctggtttgatctatccagaccagagtttttccatatcagcgataaggctgtttcactttcttaacattcacgtgttcactggagtagcacttttaatttccttcaagagctttcactttgcattcacaacttggataacttattggagcaagaggcctagtttttggcctatctcagctttcaacgtcttcctcactaagcttaatcatctctaacttctgatttgaagtaagatgcaattttcctttcacttaaacactttgagcccattgtaaggttattattaataattggtcttatttcaatattgttgtatctctgggattagggaggcccaagggtggggagagagatgtggtgatgggcggtcactggagcagttggaacacacacatttatcaagtacgttcacaatcttatttgggcatggtttttggtactgcaaacaattgcaacagtaacctcaaagatcactgatcacaggtcaccataacagatataataataatgaaaaagttaaatattgtgaaaattaccaaaatgttggccaggcgcagtgactcacacctgtaatcccagcactttgggaggccaaggcgggtggatcacgaggtcaggagattgagaccatcctggccaacacagtgaaaccctgtctctactaaaaatacaaaaaattagccgggcgtggtggcgcatgcctgtagtcccagctacttgggaggctgaggcaggagaatgacatgaacccgggaggcggagcttgcagtgagctgagatcgcaccactgcactctagcctgggcgacagagtaatactctgtttaaaaaaagaaaagaaaagaaaagaaaattaccaaaatgtaacagagacacacaaatgagcacaggctgctggagaaatggcactgatggagtggctcagggcagggttgccacaaaccttcaatctgtaaaaatcacaatatctgccaagtgcgatacgatagacggcaataaaaccaggtgtgcctggacaatttttatagtgattgctgtgagtaggtgtgggaggatgtggggtaaggacagggaggagctggtggaaacaaaccttttaaagtagctcaggctctgggaaaggcctcagtttgttttctctctagagttggctctggctgaagaggatggatggggtgatgaggaaagcttaatttaaatagagtcccacctggactgggatcactgctggcctgagttctctattagctggtgactcaagcataattagtgaggggcccacatgatgagcctcgattttgatccaggtctgaaccatgcattattttagtatctggacaaggaatacatgtttttttcatcagtctttattttatttggatctgttctatattgcgagttgattttgtctttccaactgagattggaaacccttagaattaactgttttttaccttaatgtggtattatcattttttctgtaaaacatgtagaaagggccagatagtaaataatttagcatgtgaggtccatatattcccttctgcaactactcaacttcatgctgttgtgacaacattttatttataggcactggaaattgaatttcatataattttcatgtatcacaaaatattattctttaaacaaagaattgcaaccttgtaaaaatgtaaaatacattcttagctcatgccctgtacaacagcagactgctggccacatttagtcagagggcctcagtgtgctgacctctcaccttgttttattctaaattatggaaaagcagatatataaaaacatgaaaagatgatgatgaaaatagaaaaaaggtggtaatgatgatgtctgtttagattaattacataagcagataaatacttgccatagtaaagagctatttggcatcataatgagtgacacaaaagcaagagaactgggttttattctaactttatctgtcaactattagcaatcatgggaaaaatctttcatttatttatttatttatttatttatttatttatttttgagacagagtctcactctgtcacccaggctggagtgcagcggcacaatcttggctcagtgaaacctccacctcccaggttcaagcgattctcctgcctcagcctcccgagtagctgggattacaggcatgcaccaccatgcctggctaatttttgtatttttagtagagacgaggtttctccatgttggccattctggtcttgaactcctgacctcaggtgatccaccaccctcggcctcccaaagtgctgggattacaggggtgagccattgcgcctggccaaatcttttaatttctttaatcccaatcttttacttctaagataatggaaatggattataatgtttctaagatcattttcactattgagattattccatccttgtttacaactgctatcttctcccgtgtataactagctaccaatttactattgttttacgtatagtatacacaattataagacgcaagatcctaaaataagaggtgattgttacaattgaaaatgaatactttgggcccggcgcagtggctcacacctgtaatcccagcactttgggaggccgaggctggtggatcactcgaagctaggagttcaagaccagcctggctaacgtggcaaaaccccgtctctactaaaaatacaaaaaaattagctgggcatggtggtgcatgcttgtaatcccagttacccaggaggctgaggcaggagaatcacttaaacccaggaggcagaggttgcagtgagctgagatcacaccactgcactccaacctaggtgagagagtgagactctgtctctaaaacaaaacaaaacaaacaaaaggaaattaatactttgctcttaatttgtccttaaagcacaggctgtttgtggagaagcacaatctttaggcctcttaatgatttgtagcatatcatcactaagcagacattttgaaaaggctaagaaagatgaaatcaaagtagaatataaattatacatcagataagtcccattatgaggagggaaaaaaatatttggatgcacatggcctacctcttgctgtcatcaaaagcacttgtcaggatgaggcccttgcagcaggtactagagttctactgatttagacttcaatggctggtgtgttgtattttatagtgtaaaataattacaattactttaaaaattgttatggtccagcacaggccctataaatggcataataaatagtctataaataataatgtgaacctcactggaactaaaccacattttcccatttttctaaagcagaacatgctaagaaatagaagttattaaaaattaaaggggatagctgggcgcgatggcttatgcctgttatcccagcactttgggaggccgaggcgggtggatcacctgaggtcaggagttaaagaccagcctggccaacatgacgaaaccccatgtctgctaaaagtacaaaaatcagttgagcgtggtggcgtgcacctgtaatcccagctactcatgagtctgaggcaggagaattgctggaactcaggaggcagtggctgcagtgagccaagatcacaccactgcactccagcctgagcgacagagcaagactccatctcaaataaaaaataaaaataaaataaaataaaataaaagaaaggcgatggtcaacccatacacatgcttttaagagccctgtgctatgttttgagctgataaatacgaggccaagaagaaattaacctcacaatgattatattttttagtataatggtttctatttaacttgagcatacttaaaacgaatgcatcacctagaagccacatcaccccgcttcaactcagactctgctgtttctgtcaagagaatcacatttcttccactcacaacacaaacatgctgtccttgacccaccctctgcgtcgtcttaatcaccaagccttgtggatccctcctttgaaagagctcttcagctgtcttctcccttttgttttcctgccaacttattcattgtcttcttcccagggcagaccacagttctgccacatacaggagacccaaaattgtctatgaaagggagaagtgaaggtagtcctcagatagtttatgtaccaggacaaactagctacatgtgggaagataatctacacaggtttaattcagctgatgggttgatttcagaagatttcagcccattttattattttgtttcttccttttttacttaaaaaacaaacatatattgagcatttattatgtaccaacaaaacaaaataaaataccaatcatctatgtattgagggtagaggatagaaaagtacattttctcccattcaagtactaaccagggccgaccttgcttagcttccaagatcagaggagatcaggcacgttcagggtggtatggtcatagacagagaagtacgtttcctaatattaagatattgggctgttctcagagtgcctacaattgggaagaaaagtggtacaaagaaaatgacaaaatcagaagcccccccacagctcagcacatactctattaccaaattagtgatacggatgtcaagtgctgtgggtcatgaagaaaaggggatggctgtgtttcaatgtcctttaacttttcatgcactcagacttggtctaattcaggccacacagaacaaagctagctgaatcttgctgtctcccacattctcaaatcaaacacaccttacataattatctcatgttcttctttttagaattatgtatgccactgtttccttttgttggcatgagtcagagtacatttaacacgacttatttacttctctactaaaaaaaatttttaatgtttcatgatcagaaggctatcaatattttatattaatcactgagtaaatatatcagtagagctatttaaaaatcctgctggcctgtgaaggaaaggcaatacgagagaaatgattaattattaactgataaggattaattactgaccatatattatgtgccagcgacagtgccaactgttttcatggacctcctcttctttaattcttgcaatggacattggtgataggtaggtctccttgttatgaagaatgtttttagaggtaactagagaactctggggagttaggctgggaatcatggaatagttcttttgcctaaatgagacatggggaaaaatactgaagagagattttcttgggggatgaaattagagatagggtaatcatctactcttcagagtcagaagatagatgcagaagacagagaaggggagaggagagaggaggaggaggatgaggagagagagagagaaaataagagagagaaaataagaataagagggaaaataagatagatactttgtagcaatttaaacgtatagagattatttctagagttttcagtaagctatgagttttcctgggagctgttttaatcatttcttttttggaaaatacaccatcacagaatgtttcttattttacatcattagacgtatgatggtatctcttccagagacatggcccccaaaagtctgtgatagagaaaaaccatatggtacttttggtgcagtcatttaaggaacatgaagaaagagccctactttgtattaatttggggtctacctggaaaggcccttcagagagaaacttgtgttactattgcctcagccaccctaaagccatgcacacacttagaactcagggtgcagtttttagacattattccaaatgaggatgttgcactctactttaaaaagtataataaaaagtgttatattttacaatcctagactctacaaagaatgataggatattctcagggatcgctttgcagcagagggaactggaccagccagagccctcttccttgcagttggacagcacaaagctccctgtacacactttttaaaacataagttgtacatgtgaaggtatttggtggctatcatatgaagtttaagatgtgtggctatttttcccttccatggatatggataggaaatcaaacatgggttttaagcatgtatttctcagctggtgtagtctgtgttcagaatacttaacatatctgtgctataaaactcccgtgtatatttgcatatgggacacaccacaggcacgaggacgtgaacggctccagcattcactgaccgtcttctgtgtgccaaacctcagtggggcactttaataatcctctcatttaattttcacagaaacctataaaataggtatctgaatcattacatattcaaatatttcagtgactcttcactgagcagcgacttttgccaggtgttcttgcagggctcacagcagacgcatttcagccctatttagcttacattctagtgggagagagaataaatagacaaacaagtgcgataagatgctatggaagggtaagtgcatgaggaactacacagcaggattggggacagagaacgtcagtgggaggacgcagcagctgagtgggggtcctatttttcagaataaggtcaggagatgtctcctgcacagattcgaaaaggtgagaagatgagccataagccattgagtaacttgactaaaatcaccctgagaatgcatttatatatttaaacagggcagcatttaatacctctagggattatgtaggacacttgtattgctttatctttctcaaatcttctccattgcatcaagtatccaatctgttcataaatttgtcttaattaatgccctcatatcagacatacctcatagccagcatcaggcgctcctgtcctcaactccatgtgggccctgatcaaccctggcgctttgcctcctgttctgggctttcctggtcacacagagggcatttactgatacccacaatgcttaatccatggtccctcatattaaagccatctgctgggcttagcagcagccagctccataaagtgtcctagtttccctgcttcactccccggccctcccgcctctgtcctgggactaggactgtaacggagtaagagcacctgagccctctgcctcaggctctgcttcctggagagcccaggctcttatattatatttcaaaatcccagaggagaaggagacctgtcttcatttttcatctctcccagtgtcacaaatagagttattctcctgagggttaaccagaagttattccaattttgggtccaattgtgaactgatggctgtaagacatacagtaatgactttttttttttttccaaaaaacctagatgcgagctagtgtgtggctggttgtcaagcagaaaactggctgataataagggagggagctgggagcttggaacaggggatcgatgaaataaatcggctgaaaatgcagaatgaaataaaggcccgttctcaatgaatctgtgctgagtcccccaaacctccactcacaccccagttgcagtcagtgtgtgtctcttccttcgaagcacgcgtcagtctcagggactccatctctggagcctttcccgggcctgcctctcccggtccttccctgtagaaacggtctctcctaccccagacactcattctcgctccatgtttggaacatgcttactctgaagttagatatcctggggcataagttatactgtggcgtgtttggaaactatgcaagcatgaaatatacacagtcacgagacagaagaggaggcacgaaaaaccaccccgacacccagcttttcctgacgggaactaaatacaatgcgtatcggactcgagaaattccgaggaatggaaaggaaaatcgccggtagcatccaccgcgcatcagacacgagtcacactgacagccagaaaaaaatggaaatccccttcctagaaagaaaagaactattttatatcccaaactacaaaattaaaacaacaacaacaacaaaacaagtctgccagttgaggcgtttgattgtagaaggcaggccactgtgataagcatttgactctcgtcaaaaaaaattcctgtttcccttgaaatctttgccctatttcccctactattaacttggccatagtcactttcctctaagctttcaaaatttcctagaggcttgcgattattttatatatctaaacaatatatttaagacttttaaaagacctgttttttgtttatatataaataaaaattatatactatatataaaatatataaatatataaaatatataatatatataaaagaaatatatattatatgtaaaatataatatataaaatatatatgtaaaatataatatataaaatatatattatatgtaaaatatatataaaatatatattatatgtaaaatataatatataatatatattatatgtaaaatataatatataatatatattatatgtaaaatataatatataatatatattatatgtaaaatataatatatattatatataatatataatatatattatatataatatataatatatattatatgtaaaatataatatatattatatataatatataatatataatatatattatatgtaaaatatataatatatattatatattatatattacatgtaaaatattatatataaaatatatattacatgtaaaatattatatataaaatatatattatatgtaaaatattatatataaaatatatattatatgtaaaatattatatataaaatatatattatatgtaaaatattatatataaaatatatattatatgtaaaatatattatatgtaaaatatatattatatgtaaaatatattatatgtaaaatatatattatatgtaaaatatatattatgtaaaatatatattatatataaaatatatattatgtaaaatatatattgtatgtaaaatatatattacatataatatgtgtaatatataaatatatattacatataaaatgtataataaaatatataatatataaaatgtacaatatatataaaatatataatatataaaatgtacaatatataaaatgtactatatataaaatatataatatatataaaatatataatatataaaatgtataataaataaaatgtataagatatataaaatgtataatatataaaatgtataatatataaaatatataaaatatatataaaatgtaaaatataaaatatataatatataatatataatatatattataaaatataaaatataaaatataatataatatattataggtactttatatataatatataatttattatattatatactttatatataatatattatatattatatataaagtatataatataataaattatatattatatataaagtatatacattatatataaagtatatatgatatattatatataaagtatatatattatatataaagtatatattatatataatatatataaaaatatacaatacatatataatataaaatatatgtgtgtgtgtatatatgtatacatttttttctgagacagagtctcactctgtttcccaggctagagtggagtggcttgatctctgctgactgcaacctcctcctcctgggttcaagttattctcatgcctcagcctcccagtagctgggattacatgtgcgagccatcacacctggctaatttttgtattttttgtagagacggggtttcatcatgttgggcaggctggtcacaactcctgaccccacgttatctgcctgcctcggcctcccaaagtgctgggattacaggcgtgagccactgtgcctggcctgtttatgaatatattctcatcagcacctgtcaactgctgaaactatggaaaatgggctaggagctctgctcaacactgcggctatggcaataagaggtatcatggcagtcctcacaaatctccctcttgttgaatggggatctgatgagagactaacatttagaagaggctctgtccgttttgacacaggaggaacttttagtatttcacgtgggaccccaaggccacaatggcatggaaatgactgtcagcattcacctaactgctctgaggaaatgtgcccgtggtgacataattagtaaagtgagacacaggatcttgacctcgaactcatgtcctatgatcctcccctcactggcatcccactcataagtactggggccatgcaggatgttaccagatgttccatgggtgccgttatgtaacccatgactttgaccttcactcaacactgtaggacctgagacttacattcccaggtagtgaaagactctcagaaggcaggagtatcagaggatgtgctgaaacctacatatcttcagccattgcttttcctgttcattagctaccaaatataaatggtttaatatttttgtgctgaaagacacatatcttatgtcattgcttttcctgtctcattagttaccaaacaaatataaatgttttaacatttttgctttcttttaagccatattgattattacactgcttcttctgggtacttaaactatattactgaatatctcccatcatccttgattttgagattattgtctttccattttttgttttttggatgccaataattttttactcatcgttacttttctgtttttgacacagagtcttgctatgttgtccagacggaagtacagtggcacaatgacagctcactgaagcctcgaccttctgggcttaagcaatcccttcaccccagccacccaagtagttgtgactacaggcgcatgccgtcacacccagctaattttttaaatgttttgtagagacaaagcctcactatgttgcccaggctggtctcaaactcctgagctcaagtgatcctttctccttcgcatttcaaagtgttaggattacaggcgtgagccaccatgcccggctttattttcacttttcttatgaaaaagtgtgtagtgtcatccaagattaatatatccctacattaagatcctattattttcaacatgtatgtgattttgaaaatattcttttattttctactattattttttctattctcctatcacagttggatgtttagaagccagtatctgtagaatattttaagttttatagactaattgatctcctcaaacactgataaagatccctccctccttcttaaaaaatacccactggaaaccattgaaatctttcatattcaattcaaaatgtcaagtctattaaaatttaattcttattgaaatatttgatttgccatttttcagaagtattcatacttcttgactagaactgctcatttgcaatctagagacctattctgagcatcaggtccttttgataaaggatatattgaccatcacaatggacgcaaatgattcaatgcctgaatcctatatgtagtcccgaccttccctcttgcacagagactctttttcaagccacgtagttgcctgaaccttcatttctgatgcaggtgtgcacagtggtagtcatagaggaggaaactgtgaagcagcccaaatcccactggtgtcccccactccagccacggcggccccattcctcctgtctggaccctgctaggtgaggacagcctcaggctcctgtgaagggctcatgttcctgaccatcccagagctctcaccactgccctccatggcccctccagggaaacacctctccaaattttgccatttcatggcctacatcatgactattttaagcaagactaaaggctgataatgcaaatatggaaacatatttgcattttttttttttttttgagacagagcctcgttgtgtcacccaggctggagtgcagtggcgcgatctcagctcactgcaagctcagcctcctgggttcacgctgttctcctgcctcggcctcttgagtaactgagactacaggtgcccgccaccaagcctggctaattttttttttcttttgtatttttagtagagacagggttacaccgtgttagccaggatggtcttgatctactgacctcatgatctgcccgcctcagcctcccaaagtgctgggattacaggcgggagccaccacgcccggcccatatttgcattttaaaaagagctttagttaagagtgaccgaagagagaatgtgaagccccctggcagttgctaggatggcatgtggggtggacaggccttgtaaggtcccctaaattcccccgtgtagacagtgacacactcccatatatgcagtatggcgctcaatgagggagtgggtgggctcattttatgcaaaagggatgtgataacagctaagccatcccatggccgacacttggaggtgttctcttgaagggtgggtcagcctcttcctctctgctggccagtttcttgtgtcaaagagccatggattctctacacagtcggctggagggagctatgaagctagtggctcggaatggggaaagagtaaatgctccaaatcaaaatgaaacgtatttgctgattacaaccgatgagttgctccagtcggctcgatgtcaaaagtagaaagaaataaatttttaaaatgtaatcttctattgaagtataatgtatatacagaaacatttgtaaaccatgtttcctgttaataaaatttcaaaatggaaactcactcatataaccaggaactgaatcaagaaataaaatgctttaagcgccccagaaacctttcttagtggcccctcccaatcaccatcccctttcatcccagagccgaccactgtcctgattttcaacactaaggatttattttttcttccttttgaaatcgcacagtacgaattattttgtgtttgaattttctcatgcaacactgagtgagatttactttatagtaggatcagctactaatttgcaggggccattacgaaatgaaaatgcaaggccattgttgaaaaatcaagaattccaagatagtgacagcagcacattaaaccaagcccagggtccttttagtgcagggccctctgcaactcaaaggtggcagaccccaaagccagccttgtagagaatcccaaagcatgactatactatatttgtccatcttactactgatgaacatatttgtgagatttccattctttggtgctcctacaaacattcttgcacctctttggtgaagatatggatgcatttctaataggtatatagttgtgaatggaattgaaaggtcctaggcagacagatgttcggctttggtagatgcaagcacaaatttgttgtatcaatttacacttctacagtcagtctttgagagttccagtggctcctcatccttaccaccatttcatgtcttatctttttcagcctaggcaggaatttaaagtgccgattcctaccctctgctccaaaccttatatcattagcatttctctccagattctatattttcacagctccccaagcgattctccgttaagttaggaagcactgctaattaactgagctaggaagctatgagaacatcacatgcaatgttctcattgcaccagagtcaaatatgggttgaaggactaagaatattgagctcacacttttaccctctaggtaaatcagcaaatgattaccaagtgtatgggaagtggccaggacagggacattctgtatggtcattatgacatttctgccttttttttttttttttttttgagatggagtcttgctctgttgcccaggctgggtggagtacagtggtgcaatcttggctcactgcaacctccgccttccaggttcaagcaattctcctgcctcagtctcccgagtagctgggactataggcgtgagccaccacaccagctaactttttgtattttgagtagagacgaggtttcaccgtgttaaccaggatggtctcgatctcctgacctcatgatctgcccacctcagactcccaaagtgctgggattacatgtgtgagccaccatgcccagcccattatgatatttctatgaaattgaagggagtagtgtcaaagggtttataaaagagcattatggacttttttaatgttagaaacttgatactctgaaaacacactgaaacttatcgttatagagtctttttcattttcaaccttctaatttttattttagataatcaaagtaaaatcacaccattttacataattacagtgtattttaaagcttttcttttttgtttcagatctgtaggacatccacttagcaacagcatgccattttcttctattttctacactttaggcatatgcacattagaagtagatgaaaatgcacagaataaaggaaattctgtcaaaatatatggttcctcagcaaagaagcttggagtctgatactatgtgaaatataaacagtaacttggggattcagatgtatcatatttatgctcttttcatgtttaattttagaaaaacacattcatggcaatggtatatgtagatactgctatttctaaaatatcttattaaaatgataatagacaatgaatttcaatattttatattttcagagcaaaaatcattcacaaaacaaaaattccttatgccacatggcatatgtgtatggtgcatgtgttccatgttcgataacatgtgctaagatatataataaaaatttctatttctggtcatcctcacataattatattttgaacatgcatatttagagcgtaaatgtaaagctctatggcactgagagatatgatcatatttatcttcattttaggaaatgtaagtatatgggtaatttatataacctcagctatctacatctctgcatcgttatttttcccccacagtattagggtattcttctccgcaagtgggatatgagggcattaccttatacatgtccccggaaagacagtgcggtcacagccaccctgcctggggaggagcaccggcccacgaggtggggtgggaggtttggctgctcctggcttggtctccaccggccatgggaagccagcttttcctacaaggaggcccacttatattcctcaagcccagtgcatcatgagaagaacgcacttcctgggcactacctccccttcccctgcttttcatttccattgaagagtcggtggtgacccgggaaaaggcaagaaacttaatctgtgcttccaagacagccggaaagagcagcggcccttgttctgaaaaagcacccaagaacccctttagattccgccagcacgttcagggttataaggacgtgggagattgtttccccaacacctgattagttaactcaaacagtacctccagaaaactagttatgtggggtttgcttttttcagtttctaagctttcatagttaaagacatattttcatgtaaaaatgaaacctttaaactgcacttgtagaacctacaaagggtagaaaggagggcctcaccaatgcctctgcacatcttcagccctctaccccatactcagggttcccacagaattcgaagaccttgaaacaagtttccctggaaaacagatgttggagggacacatgtcatcctaatgccccctgtgtggagacgcatcagcagccagggaactgctgaaaacagatgtggaagttggaatccaatccgggtttgccaggggagtaggaagttccgccctgccaccctttttctttgcgggagaggtggtacacagagtgggaattatgtgtaaactacaagcgtcggaaaaatgagaggctaatgcaagaatatggacctgtccggtgagtgcagtgtgtttcctgagtggggctgagtggtttagggctgcgaccaccacagtcctcctcacacacgaccagattccatgaatcccactgcaaatatgcattccctcctgcactcggtaaggggccaggacaaatgggaagagcgttgcaaatacgtacaatccccatgggtctgatggtcagcaactcagagcaatggaaatgatacttaatcgtctctaagaaaactggaattcaacaataaggttacatttcacagactatacacctacagcaactcattagagcctcctgacactggggtgggtggaaaggactaagcatgattgtcccgctttacaaaaacattggactcagaaagggcaactgaaaacggacaacacagaagtcgtggctcctttgctcccgatggcaaacccactagtgtccagaggttctggagcatcttctaggcctttctcttttctgatgctgatagggaatgcagtggccagctaggacaggcaccatggcagagtgggaaactgaaactgccaccactgcccatccccccacctgagttttaaaatttaaaactgttggtgggcaaatgatgaaccacccggatagctagcagattattcagaatagctatatagagccttggtaatcacctcaattctagaatagaaacagcaaatataaaattaaacacaatacaaaatccaaacaaaacatgtccattcctgtgctttggaacttcagctcaacagctcaccttgaattatgtaaataacagcatcacctgttattcctgacttcctttttgtttgtactttttattctattttattatgttgtcattttcccacaggtgaaagggcatcgtttctgatgtcaaagcagtaaacactttgatcacagcaacggcatgggggcggggcgggggcgtgcggtgcaagaatcaggcaggtggtgcggccctccagggaggggaggctgcggcaggcagtgagccgcctccccagcccaggcggcagcttccctccgggccttcctgcaggaaagcagcactcccacaatgagctcatcctctgaccattctagtcagcttctcatcaattatcccagttttgggggctctgagtttgggagttaaactgcataaagatcaaactcaggcttctcaagtttcacttactgtgggagagagtacagtcactggagtcaaatatgttttaactgtttcctctcatttccatatcaaagcaaaatgatgtgaagatggatgaagaaggttgaattaagatacaactccacggctgggcgcggtggctcacgcttgtaatcccagcactttgggaggccgaggtgggtggatcacttgaggtcaggagttcgagaccagcctggccaacatggtaaaaccccatctctactaaaaaatacaaaaattagctgggtgtggtggcgggtgcttgtaatcctagctactcaggaggctgaggcatgataatcgcttgaatccgggaggtggaggttgcagtgagccaagatcatgccacagcactccagcctgggcgacaaagtgagactctgactcaaagaaaacaaaaaacaacaacaacaacaaaaaaaaaccaaaaaaactccaggtaggtattttttctttaaaacttacctttacatatagataaagataaagaaaggcagaaatagaggtaagagagataataacatttttgttagagaatagaattgaataaaataaatttcctaaactttggtttaatcatgttttagaaaggaaacatctgaggccaggcatggtggctcatgcctgtcatcctagcactttgggaggccaaggtgggcacatcacttgaggtcaggagtttgagactagcctggccaacatggtgataccccatctctactaaaaatacaaaaattagccaggcaaggtggtgtctgtaatcccagctactcaggaggcagaggcttgagcccaggaggctgaggttgcagtgagctgagatagcgccactgcactccagcctgggtgacagagcaagactctgacaaagggaagggaagggaagggaaggtggggaggggaggggagggcagaaacatctgaaacacaacactgcagactggttacctatatctacctgtgagtagtaactagaaaacacagacacagcatgcagcaaatcataaaatgattttttattaatttatttttatttttattttttttattaagacagagtctcactctgtcgcccaggccagagcgcagtggtgagaactcagctcgctgctgaaacttccaccccttggattcaagcaattttcctgcctcagcctcccaagtagctgggattacagccgcgcgccaccacgcccagccaatttttgtatttttggtagagacggggtttcactatgtcggccaggctggtctcaaactcctgacctcaagtgatccgcccatcttggcctcccaaggtgctgggattacaggcatgagccactgcgcccagcctaaaatgattttctttttgttactcttgaaaatttatgtgattttctttttgttactcttgaaaatgaagtggggtgggcggtaaaatataacattaaacataacatgaaactaactgtcaactaacatgaaactaactaacttacttggttggttatttctggttgtacagccttctagggtttatttaccacgtggacacagtgcccctatatatcactaatgtattttagagtttcatgaaaacacactgatgaaagaaacagctcatgtttttatgtacattagcatgtttctaatgcagtaaatttttgtgaagatgtgtcgtgtcaactaattcaaccatttaagtaggtctatcagtttatatagaatgaaaatgaagtttcaaggcctatgacaatacacagcagaccactgctatgagctgaatttcattttgcagcttagtttcattttaagattctactatgacatatttagctagagaaagatattaaatccaactcttatgtatttaatataattcgactcaagtgcttcaggccttcacctcactttatgtaaccttaaaatgatggatatgcaacttttgatgtagggctctattttaactgtgagattacgatacgaatggtgattcttttatcaagtaatttatttttaaattctgctttctgtcatttctaattttgttgaaatagtaaatccacttagcagagagtactcatgatttagctcataatttgattcaatgaaattagttcttgtacctcttctgaatctgtagtagtcaatgagtctagacgggttatccatgtgtagatctatatatgaaatgtacatttattgtctacacaaagggtcagcaaacattttatatgagaatcaaataatgaatatatttaaattttgcaggtcatgaggtctctgtcacaaccacccaactctaccattgcagcaaagaatagcactagacacataaatgaatgggctgactgtgttccaataaaactttatttacaaaaaaaaaaaaaatgctatctgtagtttatagacccctggtctaaacttttgctattcatgaacgtagttctagacctactgcatcttcattaactagaagcttattataaatgcatttaaccatgagaaagctgatttgaaagaaagaagaaaaactaaaaaaaaaaaaaaaaagaaatgcatattctcaggcttcaccccggacctactgaatctgaacctgcttcttcaagatgcccaaggcattcaatctgcttcttcactgcccagggcatctgagtgaacatcagcgtatgggaagtgctagtttaaaccacagtgactggcttctatctgggttcacagagcagataagggaggtttcatttgtcattttagctgtctattcaacaataagaatgtctgggccgggtgcggtggctcagcctgtaatcccagcactttgggaggccgaggcgggcagatcacgaggtcaggagatagagaccatcctggctaacacagtgaaaccccgtctctactaaaaatacaaaaaaattagccaggcgtggtggcgggcccctgtagtcccagctgctcgggaggctgaggcaggagaatggcgtgaacccgggaggcggagcttgcagtgggccaagattgcaccactgcactccagcctgggtgacagagcgagactctgtctcaaaaaaaaaaaaaaaaaaagaatgtctgagccctcctgtagaacaacattctctgaattaagtcattgggatatcataagaaaaaatgaggataactgttcatataatttttaaaaattttgaaaatataaactgaagttaagaattactgatattcactgtgcaggtggacactggctccatcattcagactctatgtcccaagtttgaggagggaagaaaggagttttcatcacacaaggaggtggcaatggtacctccatcaatgctaacctgtttcctctccaaatgtggggatataaaataatggtttgcatttgcaaaactgagtgaaatgctctaggtttaacaaatgaatcttctccaaacaagtgctttaaagtatttcctgcaaagaagctgcgaaaataaaatgatactaataatataagcacaactgaacagcaagaaaataagacagctatgctctaattcatgtatattctattcacatatcacattatgtaaaaaataagaattaaatttttaacttaaaatgataaatgatgtgatacacaaatagaacatgcatgaattcgacgaaatacagatttactgataaatctcaatctgatagaattctttgaggtttttcattaataatttcttgaaaccataattaaaatctaagcattgaaaacatgaaaacaaacttctccaaagtttgtgatgttggccttggtgctttaaaatcatcaagaatatttaataggctgggtgcagtggctcacgcctgtaatcccagcactataggaggccgaggcgggcggatcatctgaggtcaggagtttgagaccagcctgaccaacacagagaaaccccgtctctactaacaatacaaaattagccaggcatggtggcacgtgcctataatcccagctactcaggaaggctgaggcaggagaatcacttgaacccgggaggtggaggttgcggtgagccgagatcgcgccactgcactctagcctgggcaacaagagcgaaacttgttctcaaaaataaaataaaataacataaaataacataaaataaaataaaataataaaataaaaaaaaataaaataaaatgaatatttaataataaaattctagaagtctcttttgagtttttcttgtttcatttatttagtttcttaatcgtgaaagaagaaaagctatatactttagggaaattttctccgtattgcaacaaaatgactgaaatcatacaaagaaaatactgtggcaataaattgggatatgtttgcttgtcaaaaacttctgaagaaagatgtgtagaaattattactgatgaagcaaagaagcaaatgttagaacaaatacattccaggtttgacacacgtgtcagctgatggtattttatatattctctcccaataatgaagtacctgaaaaacttatttttcataaagcattaagttgtactgtaagagatgtggtctcaacatagtttcttgcattaaaaactattatttgatggttgtgttggattactgtagcactgatggagtaactatcttgatttgagaaaaagactcaagctgaatggttacagaggtagtactggaagagtattcactcaatgtatgacttacaaaaaagatgctgagcaaagaaattaaagccagaagtaaaaagtgctacaagtgttactgatgtagttaatttgataaaaacaaaccttcaacaatgcagtaggctttcctctgctagttggaataaaatagggagggactataaatcctatttgtaccacagaatttcactccttaattcacagtataaacgttgaaagtactgtgaaagagttactcatttttcctttcagcaagttagtgaaacttttcaaggtcgtcatgtatgattgtataagagatgcattcaacaatgttaggggtcaccacttatattattcctaatgtattaatacaaatatctttactctgaaaacattttccagcagatagcaatgtgtcttgaaagaagtttttaaaaatttgcataaaagtgctacttggacttgtgtagagctttgatatcaaatgactgccggtagaaatgcaatctagcagatattttagaaaagtaacaaaaacagttattttgtcccattaaggtcgatgcgatttttaccagatatagaaatatcttttttataaaaggaagttgaactctggagcaaacactttgaagacagatgtttagaatatttccactgttttatgaatttgttttaaaaaataattgtgtcagttatgaaaatgtatatcctcaccctttaaggagcttggaaatagaagtgcatattctgtttaaaaatctttcaaataaaatgtcttagttttgaacatatggtttaaaaatgcaataatggcccaccttctaaaactgcttgacatcaatggagaaatttattaaatttcaagaaaaatttgaccatttgcctaattatcagatgtgatttgaacattaatatcatgttccagtaggcagtagacaatgtgtccttccatttgggggtattatttttgctcattaactccctccaatatcagcatatgacagctgaatgtcagcgcttaccttctacccattcatgttaacagcttctgcagccctcctagctagcatcgaggtcattttcttactttccaacacttctgttgtaatgcggtacaacctcaatgttctcacaacacattcattcatccaaactggcctcaatctttttctcctcacaccatacggtcttgccatcctctcaactttgcccacctctcctggggttgcaccatgtaccagtagttttcaatctctgggagttgctcttgcatccaaaaccaactgaattagcctttctaggagtggggcatggggaactatatttacattttttccggttgattttcacacattgtgacagttgagaaccactggtgtaggcctgtcattatcaataactgcccataatcttcataatcctccagcatcctttgatcatcacttcataccctcagctcaatccctttagtaaccccacttgaataatttttcaactctactagaaccttcaatccattaaccctcctaacttttcattattcattactccctcctgtccttagctccctccttgcccagcttagacttcatgcttcctcaatcccattgctggatttcttttttagagtacttactgacaaagtctctcccaaacatgggaaaataaagttcattaccctattctgtgcctgcctcaagaagctgactttgggcagacaaaaatttacatccttactaatttaaatgtaatttaaacataagaacctaaacttcaagtttatttccataaaaactgtacttggatatatgatcggcaagaaaataaaattaaaagaaataagagaactacggaaataaaaaagatatattccaaggtaaaaagacgaagaacccaacaaagtaaccacgaagtcagagacgcagagatgtggggtatctgagggtcaccgaagaaaagttttaagaatgaagaatggacaaaacaactcaattttgaaaacagagagaaatggagaccgatgatcacacaaacactgtatatgaatgtacacagcagctccaatcgcaactgccaaaaacgagagcccagatgtcccttattgagtaaatgctcaaatacactgtggtgccagccacacaacagtcaccactgagcaacagagagggatgaacaacgggcgcacagcatctcaaaggcattgccctgaataaagggagcgccttaaaggttacctactgcatggttccattcatccagcattctcagacagacagactggagggatggaggccaggtcaggtggtgctgggagatgacgacacagccacagctgcagggatttgcagtgagggaagagttttgaatcctggttatgccggtagccacagtaatttctacaggtgttaacattcaagtgtacatcaaaaggaaagaagtcaacacaactgtaagacaatttaaaagttttaaaaaatagtgttggttgagagaatgcattcaataaatgtaaacttccctcttgagagttttgttaaagaaactgcagaactcttcagagaatatagggctaatgaaaatgacagcttccaattatctgtaatttttttaatgttttcaaagcacttattattatttattgctaagaagcttaaaataaaatgtagtaagaatagaaaccaaaagaagccccatacatttagtaatcagtatatatttgaaagtacacgcattcgaggagcagctggggtctgaggcctctcacttagactcatggggtcagaacaggtctcgtatcagctctccagctcccaacttctattattctgccgtctcccttgtgtgactaaagcaatgagatgatttattcattcaaatcctatgaaaatcagttcttattttacagtattctgagaatgttatcttacttcctagctttttaaaaggctttcttcctgagatgctatttttcaaaatcagatttatttctgaaagagtccctgttctctttgccaacctccttgtagctggcaaacttcccttttttccttcaggatgaaagaggccttaatccatcttacacaatattcagtgtacagcagccctggtcttggcatcgcatcacactcagtaaatgacacagagcttcccaagatttcagactctggggttccacaacggagacgagagcaaaaggatgtagtcatttaatctatgctatgcgttcagaaaagctcactgagtttgggactcatgggctgaagacgaagaggagccatgcggccggatttaagccttgggggaatgctggagaaaaggtggatgctgtctcagatctaatgtggtcctaacagagttgggaagacagatgtctgtctgtgccgtgaacataacactctgtcagggatttaccctgggaaaagtctgtctttctctattcaaggcactgttgattcatttggggaacagaattctacattccagtcaatgaatctacaagacaattgggaaaggatcacattagtttttaaatagaatttattttccatagtgttatttcacagcaaactctgttccatttcccgcgctctgcctccggggtcttagaacaatcacttcttcagaggaggaccttgccaaccagtacactagatgccaggcggaacttgcctttacagcagaaaatgaagtgggctactgtgatctatcgtcagagtttctcaatccattctcaagataccccgagggagatttcactcttgctacaaagcgggaaataacaacaataacaatcaccgctgtaatagaacacattatgagggggcattcttttaaaagcctttaaaatgctaccaggagagttttatggctgctccaagtcagaacttggccgtgtttaaaagcacggggagagggtgttccggaggcggaccccaggggggccacagcgcctccccttcccctgggggctctgctagttttttggctgataggatcacagccaagttcatgggcgccccgaggaaacactaggcacagcttgtgctgttcaaaacaatcttaccataaaagtgacttttctttttaatctaaaaagcactttttgtaatgagaggttgaagctgagatgccagtgagttctgctagtttctgtttacttccttcaatttcgtattgttcggtgtgtgactgaaaattgggtatcaaaggtaagtattagggtcttctcctgggtccctaaacatgaggcttcgaggtcttacaggcttgaataattcttcagaaactacagcaagtttgtttttagagtgtcttccaagtaccagccctttgtctaacatctctacaccctaaacattcctcccaacctttgaaggactccaaattgtggccagactacaggggatttgtgaagtgcatgcatatctacagggggtaagacaaatacatcttcattctgacatcatctaggtttttcagaggtaaaagatgtagagtgtctgagccacctatggagaaagcagttagatctaattatagctcttgggatagaggagctgctgtctcaagaaaagcaaatatgtaggttaagagccctgttcgaccttcagagatcatgctgttgcacgcttgttagagtgatgcccttgtttagtccttacctagacatctcacaaatattcctgtgaagttttcttggaagtggatggtttacgaaattcccaatacatttcctttgcatcctgatggactctctgggtgacctcttaactataacctttcaagaagcaaattttttgaagtttgcaatcaggcaaacaatcctcactcttcttataaattctcatcttccctaagtgcttatatttgaatattcttaaaataatgggctgggtacaggggctcatgcctataatcccagtgctttgggaggttgaggtgggaggatctcttgaaccccagaagttagaggtcagtctaggcaatgtggtaaaaccctgcctctacaaaaaatctttggaccagccacagtggttcacacctggtatcccagcacttagagagaccaaagcaagaggatcgcttgaggccaggtgtttgaaatcagcctgggtaacacagctagactccacctcaaccaaaaaaaaaaataaataagattagttgggcatggtggtgtgtttacttcctccaattccttttgttcggtgtatgactgaaaattgggtatcacaggtaagaactaggggcattttgctgggtccctaaacatgaggctttgaggtcttacaggcttgaataattcttcagaaactacagcaagtttgttttcagaaaccaaagaggctgaggtgggaggatctactcaagaggctgaggcaggaggatctcctgagcgcatgagttagaggatgcagtgagctatgactgtgccactgcactccagccttggtgacagagcaatatcctatctctaaacaataaaaaaaattaaaaattttaagttaaaaattaatggtcattttgtgaaattggtcagagtttaaggttttagagaatgtacctggtggcagaaaccaatatttagttgttttatgagacggagtctcactctatcacccaggctggagtgcagtggtgcaatcttgcctcactgcaacctctgccacccaggtttaaccaattctcctgccttggcctcccgagtagctgggataacaggcacctgccaccacgcccggctaatttttgtatttttagtagagatggggtttcaccatcttggccaggctgatcttgaactcctgacctcgtgatccacctgtctcagtctcccaaagtgctgggattacaggcgtgagccaccgcacccagcccatcaatattttgttttaaaggtgcttaaaaaagacatatttatacattccccttttatagttaaatcaaaagcggcttttggtatgctctttcaaggcaaaggtatagataatcccagccatcaggattttactgagtgattgaaagtagaggggtaccatagaatactaacatatcagtaattagcttagccagttaaagcacagaattgaggagggctggttatctgttcacacgccatgaagttgagttagctttgttctcatcaggaaacaaagtatcctatagatgcctaatgttagaaacaacaataatatagtttaaatagacactgggctcaaaccttaaacactgtctgtgccttcactatgttatcactacgttactgttgcaggaacagagacagactagaggagcgaccttgggcaagttcttcatcttttctgagcctcagtttctacatgtaaaatatggaccagtcagtagtatccacctcagaaagtgtctctgaaaactaaataataggttctttacacacactgcttggtgcctggcaaataataactcaacaaatataagatgataacaatgatcccatccagtcccagccacaaagtgagcaagaaataatgattcagagttttaaaggagctgtgtctttcttattctgttactctgtggattctgagacttgctcaagatgcttcatgcctttctccttaaacctatctgtgttctcctcgacggatctgggtaagtcatctctccactgccaaacattttggcacacgatttgtcacaaagaagaacacaaaattatttttgaatgaacaaacatatgaagtaaaaagccacattcattatcgatcctattcctatccccagctaagttctatgtgctataaatagtgagttctgtttgcattaaatggtgtgaccttctcctgtgtcctcagatggaaagttctcaccattggagacttttctgacactactctctcttcattagctccactacccacctgccaaccccttcgacctaccaaccccaccatgaactactgacaatctttctgtggccactgccttcaatgactttcccatgaattcctttccttttctactgtggtcactgatttcatgcgagtctcattatttccttcctagaccactatggtattcttataacatctctcttcaccccagttcagactataaatgactgacatattaaccttcctcaatcatagctgtaaaaacattcctactttttccaaacttttcagcagttttccattcccttctaaactacaaccaaactcatcaggatgggattccaatcaatcctcaccacagcacctgcctttccaagcctcatttcccatttagtgctttgcttggaccttaatgtatcttaaatacttcctgttttcaaatcgtgcgttactcatgcatttctccatgtctggaatatgctccttgcgatatacttatctttgaaattcttcccgtgtttgtgtcctaagtgaaattagcctttctctatgggaacgttttcacatgcccttccaggtggtcacagatcctagtgatctcttttgtatgcgcttctagacacattgttgatatctggcttgccatattggcagaattattacttacaaacattaaaatgatatgcatgttggacaaatgtggtccatcatttataactgtatttatttaatgaggatatgatttggtcctgttctaaagtctaattatgtgcttattccaccaatgcttaagatggaaaatttgaagcacctccaaaatctgaggtgggaatagatgttatttctgaagatctgacctcactctgttataacaatattttatagaccgcttatttgttgctatttttaaaactttgtattgactttccttacatttggttgctttcatgaccagtgaaaaaactttcaagttaaaatatagctgagaagaatgaaagagaaatggtaatgtaaagcttcacatttaactgccacagcaggaaaactcaaaattgaattccaaccctagctactaaacaccctggtaaagctttgctccagcttcactgagccaggaaatttctctcttttcccctctgacactagagtcggcaagaggagacctgaacgattggcataagaaaataaataccccttccatggagggctcacagaactagagcctgctaaccgtggctggacttgcttgcaccctgaaggtgctgacaaggtgtgcaggtggccaggaatctaaaacacaacactgcctgggtccccctggggagccaaaccccagtgaggcttctgagattcaggagtacgcccaccccacctgccgttatgccccccagtgaggcttctgagattcaggagcacgcccaccccacctgccgttatacaccccagtgaggcttctgagattcaggagcacgcccaccccacctgctgttatgctccccagtgaggcttctgagattcaggagcacgcccacccctcctgctgttatgccccccagtgaggcttctgagattcaggagcacgcccaccccacctgccgttatgctctttttcacccgtagttagctggggtgcctatgagtgcctcagtaaatatctgttgaacaaacaattgaatggacacatgaatgaatggatgagggcacagtgggggtaaggggcagggttggagggaagaattcttagagaagctgagcagtgaaggaaaaataggaattacccagacgaagggagctggaaaggactgaggggcacagaatcagctgagctggtgggaagtgaacaagtaaagctaaggggctagagaccaccttgttatcagtaagaagggaaaatcccctcagcagtgttggaggagagactaaagtgcgggtgaagcagggcaggtgtgacgggtgatgaataaattatgtgagagaaaatatagctgtcaggtatgcttatgagacactacatttatgtgtagaaaggactatggaagaattgaaggtggccatgaattcttttgccctcctcctattgtaaggtggggtctccccttgaacctgggcagactctgtgactactctgctgaatagaagacagtggaagtgctgctctgtcagttttggggctcatgcctaaaaatgggcagcttccattccctgtcttttagatcactctctctgggtgccctgagctctgacactgcccatttagcagaggccatgtgtctatctcccatcaacaaccatagtggaatccattcttccagccacacctaccaagatgcctgacatgtgagcccctccaccagctgagcaccaccaagcaacctcagtcaacgccatatagagtagaaacatcccctgacctagccctgcccaaacccataacccacacaatgataaggcaatagataaggaaaacacggcatgtaagaactaatggcgacgggaggagctgggggagcaggggaggtgatgtatgcttattttcacaggaccaagcttcgtaagtgtttacaagatggtgttgtcactgttgggggccttttccaatattatactcttgcctgtggttccaggttcatttcctttttctatatctcaattcctgatgctgaaattaaatttggaacaatgaaaaaaaaattccactggatctattttctggtcatgttctattcctagataatataatattcagaggacagaagaaaacccgtcattgttgtagaaaggcgtgttcagcacgcacagtcacgtacagcacattgtggtgtaatctcttgggcatgatagaattggaggacaggaagaaatgattccagtaactcaatcaatgaccgatgatatagttttctgagtattcctagtatcttctaactttctcttctacatgttggacactatcactgtctctatcccttggcctagatagcagctaaacagccgatagctgagccaacagtgttcaatactcatatcctcttctttgttcgagctcaagtgaacacgtggcattcattcctaactgcagcctcctcaagcccagaagcctgaatctgttttttaatttagcagtgaagaatgcagctacatcacatgctatgagagcagctggtgtttcatgcttcttctctcctatcatccctctcattcaacttctcttctttttcagatatgcggtcaccttatttatgtatgtgttgaggctccctttcaagactccaaaaggtctaatccaaaaaatagctgctaaagtattatctcttttttaggcccattttccttctgtaagagaagaatgcttcattgggattagggaacatagtggtttgattgattagactgcttaccaaagcaatacaatttcaaatgataaataacagatgtgggtactctatacagcaattgtttaaaaataattttgcttctatagtacattttggcttagaattgtgtgcttctaccctctgtgataatttatgttgttcatggcatataaaatgtctcccagttgcggccgggcgcggtggctcacgcctgtaatcccagcactttgggaggctgaggcgggtggatcacgaggtcaggagatcgagaccaaggtgaaaccccgtctctactgaaaatacaaaaagttccgggcgtagtggcgggcgcctgtagtcccagctactcgggaggctgaggcaggagaatggcgtgaacccgggaggcggagcttgcagtgagctgagatcgcgccactgcactccagcctgggtgacagagcgagactccgtctcaaaaaaaaaaaaaaaaaagtctcccagttgcatagaaaaggtttttctcatctgctacatcttcaattaaatcaagaacaaatctctgattattgagttttaagaaggatgactataacagaacttgtagcaaattttccatagtaaagcaaaatcactataattgatacttgtaattgatactttaagctgccttgtatttgccaattttccagttaaaacgaatctgtaaaactaagatattacaaatgaatttcaatcagcaatcagatcaatttggcacagtgaaccctttgaattacggaagtattttacttaaagtttcatgaggagtcctgatgcatataaggtagaagggaaatgagctacaggttctagggaatcacgaaggtcccacgagcaataatatttacgcattacatctgtatattgctttacactgttcacaatatcctttcatctacataatttttatgtacacttcacaacagttctccaaatggatataattatcttcatcgtgcagctgaggaaacggaggcacatacaatttgtgctcctcacagccatcgtttatgggaaaacgctgtggctgaagtgggtcatgcagatgattactaaatggatgttttcaaagctaaagttgcgggcatctttgctgacagtggaatgtcattttggtactgggcgaagctatctgggtagacagaacttccagagtgataggtggcaagtttcataaaatgtctgagtttcttagcaatagttaaaacatggtttaatcagatgataattttggtgattccccctccctaggctgcaacagctttaattttaagagaactgaggtagtggtctaattcctattgcaaatgtacgcttgtggcttcttcgtaatttgcagtgaagaatctagaaaagtgatggggaataatgtctaaaaggcccggaacgcttataactcagcataaagcagcctatcacagctcaatggcaaatcatcggttgaagtcaagggcaaaagggcagggaatccaagggctcctctgcccaaagcatcgcttacttgaggttggcagctggctgcacagcagcccttggctgccttcaaggaccggccagagtcagcatcctccaccccgcagctatgtcagcgtggcccagacagtgactgtggagtggggaggccctggccagccaggcacacatttcacagatgaggctgaaatgagaaacttcagggagatatttgcataaatatatttcccattgtccaaaaataaggccagacggaaacatctttcagtatgttccgatgagaattacaaaatgttatacaaatcaattttttacaaaggttattatgaggtttattctgacagaggacaaagcctttccccccttattaaaactgttgctgacatcactctgagggaagtcttgggaaaaaccaaaaataatatgtaggtaatattttgcaattttatcaaatatttaccaaaggctcagataaaagatatccagccacaggtgaagggtgttcatcactgggaagtggggttgaggggaatgtttattttctcactcatatttttccatttgctacggtagcacatcctacctttataaacaaagatatttcccactgcctggctcttctcttcagcttatcgatgatatcacctgcttatcttcgaatgggtcagaatcaacaactacttaccaaacatacactgtccttttttctaaccaattatttttctccagtcatctacaaataggtcttcaaggcgtattcccatacgttgtactatgtgtgtattgtgggattgagtacagcagggaagtcatatattttaaaatatggacaaccgggccgggccaggcggctcttgcctgtaatcccagcactttgggaggccgaggtgggcagatcacttgaggttaaagttcaagaccagcctggccaacatgatcaaaccctgtctctactagaaatacaaaaattagctgggcgtctgtaatcccagctactcgggaggctgaggcagggagatttgcttggacctgggaggcagaggttgcagtgagctgagatcatgccacttcactccagcctaggtgacagagtgagattctgactcaaaaataataaaataaaataaaataaaataaaaatatagataatcggaaaattttagtgaattcagaggaagcagaataaatttaaagctgaaattatcgagaaggtctttctggaactgatagcatgtaaattggactatgcaccgtgcaggtgagatgtgaacgtgttgaaatggaagtgagagggagtccactgagaagcagcagcagcagcatcaggaaacaagacatggagctttgggtgacgccaataacacatgagcctggatgctgctgccactgagtgtgggatcaaattagagaaaattagagaaaaataatatatatttttatatatatataaattatacataatttactatgtaatatataatataaattatatattataatatatattatatatacaacatatcttttatatatattataatatacatattttatatgttatatattatgtaatatattatatattaatatattatatattaatatactgtagtatatactataatatactatatattatatattatatataacatatattatatatgttatatataatatattatatattatagtaatatatcatataatatataatacattatgtataacatatatttatgtattaaatataaatatatacaacatacataattatatataaaatataaatatataataaaataatatgtaatatatattatgtattgtatattatatataattacatatataatatataatatacaatacataatatatattatatataacacatatgttaaattgtatatatatatatatattttttagatggagtctcgctctgtcacccaggctgtagtgcagtggtatgagcttggctcactgcaacctctaactcccaggttcaagcaactttcctgtctcagcctcctgagtagctggcactacaggcacatgccaggacgcccggctaatttttttgtatttttagtagagatggggttttgccatgttagccaggctggtctcaaacccctgactcaggtgatcctcctgacctcaggtgatccaccggccttggcctcccaaagtgctgggattacaggtgtgagccaccgcgtccagccaataatcaataaatttaataagaaaagtaaaaaagcagtttggatcgatggcccaaggaagagacgtagtgtactgagtgcgaggaaaagcatgtctccagtatgtagttaaactgcaggataaatcagtcctgcctgggggagagaaaaagtagggcagaggatgggcaggccagtctccttcacccctgtgcctggagtgagtaaattcgtctcattttcctcatgtccaaatactcacatcatgagatattacaaagctgccaagacaacacacctcagattttctgaaatggtctaaatttcaaatattccactccactctgcccataagtgttctaatgtggaatttttggtctggcatacagaaacaacggcattcagacaacagattacaaacaatggagcgggtctgatttaaacagggagaaggacataaaaatgtagatatttgccttaaaacaaatattaacaagaacaggttttgattgttacattttgtaaattcatcgtggctgcaggaaagactcagtgatttatgcatttgaacagagagaggtatgatggcaaaaggacggtgattttgtccaggaggtaactggagattctcagaaagggtcctctgaccctgctgctgcagctgcgagtgcttcagcttgggctgcgaggtgcaagttcccctggagagagtgggatgccgagtcatggagccagcagcctaacctggcctgcacattaagtgatgaatcagagcgtgtgatgctgacacacggggctttgcttccgaatggtactttcttcccaaacgaaaggcaaattcctctacctccatttcactgcaatgttatcaatagcagactcttcctttgacttgagaaaaataggagaacaggggtttctaagttaacatttccctaaagaccctggctgggcttatgctgcctctttccagcaatgcgtcagggcactcccctggccggccccgtcctcgcaccctctgtgagcatggtctgcttcatcccacttgcaagatgtcaaaacgtcaccaggctgcagaggctcagaagagactggcttctgaactggacttttgattaaatcacgagagaagactgctgtgtagtcttttcaaactgtgtgttgtgattcaataagaagtctaacctaaatgggttaagacggtctaaatatttcatatggttttgcttattcactcaaaataattatatttttaggcagagagtggtttagagtcactggtgtgtgtgtgtaaatgtaatagacatccgtctatctatctatctatctatctatttatttatttatttatttttttttttttgcgacagagtcttgctctgttccccaggctggagtgcagtggtaccatctcagctcactgcaaccctccgcctcttgggttcaagtgaatctcctgccttagcctcccaagtagctgggattacaggagcctgccaccacgcctaatttttgtaatttgagtagagactgagtttcgccatgttggccaggctggtctcaaactcctgtcctcaagtgatctgcccacctcggcctcccaaagtgctgggattacaggcgtgagccaccttgcccggctcatctatgtatttcttacataggacaaaagcactaaggcacagcgttagggaaacacctcatgctgcctgtataaacccctgctctcagaaagttgtgtgctgcaagatgggcaagacggtgcactgtgctggaatactggtttctggctggttctctacttaacaagtaaggcagtgagtcatctgatcctcaccttcaggggaactgttcatcgctattgtctttaaaggcagatgtccgaagttgcccagcacccagtgtctagatctagtgagagggatttagaggagtctttccaaaggagacaggacggaagcagcgttgtgctggaggcggctgcactggctctagagccaactgtgtctttccttcccaagtctgtactcagtgaggagacactggtagcttgaagctggcccagatgggtgtatttacaccacagaaattggcagcaactgcaaagtgggctcttttgtttacctcggagatctgcttgctaaactttcaccaattgttggatgaaagctagttctgagtcaaaaagatgaatatgtcttgaccaaggagacagaagtcaaacttcgcgaaggcaaagaaaagagggtgggaccttcgtttctgagctgacagccgccatctacctccatgcagcctctgatgggaggaaaattgttgtttttagggtgaatgaacatcaaatattatttgttgggttgccaaccaatttagagtcagaaatacagggaaagacagaggacatgagctcatattttattcctaacaaaacctacaaaacacagtgctttggatttgtggtcaaaagggctgatgaatattttgcctcagaatgaaacagatatacccacttaagtatgaggaaagagataaagaaagtgtgcagggaggagcctgggaacacagagaactttctttttttctttttctttttttttttttaatggtcccttttattgtatgtatgcgcagtgctggcctggctttgcaatgcaagtcctcagttaagatatagtcaaataactatggctgcagtttcgtctgcaggatccacaattcagatacaaacagggagctggggtgggcaggagaaacaggagggaagcagagtgcagactgtccccagcactggcctcttcacacagggttggcccaggcagacacaccccatggaatgatgaggaaatgacaacatggtcccttcccacagtgagcctggggctgctaggaaactgcccttcagaacctttgtgcccaggttgtcttggagcccaacaactttttatttggattaattaaaaaataataagttaaaattaagcaacagctgggtcctgaggatgctgagccagcacgcccacagtttggggggaaaaaaatagccagaccttttttgagggggcaaggtgtgttggcttgttttcgaatttgtggggttttttttttttttttttttttttgagacagagtctggctctgttgcccaggctggagtgcagtggcacgatctcagctcactgcaacctccacctcctgggttcatgccattctcctgcctcagcctcccgagtagctgggaccacaggcgcctgccaccacgcccagctaattttttgtatttttagtagagacggggtttcactgtgtcagccaggacggtctcgatctcctgacctcatgatctgcctgcctcggcctcccaaagtactgagattacaggcgtaagccactgcacccgacctcaaatttgtttttaaaaacacattccctgtgaggtaagaccgcagggggtgggcctctgtgaaagcctgaacttgggatgtgccaagtcgcagattcagccaacaccatctctgtatcctcttgggaaacagggactggggatgggggtgtgggtcaagaagagcgtgtggccagcaagatggggttgtgcagaggccgagctgcagagacagaccttgagatgcagaggacaaaaggcaagggaatgggaggtctgatgtggggggagtcaggataggactgcagccgtggaggtcaaggtgtggatggctctgctgctgcattcttcccctcccaatttctgattgacattctaatttttaactcttacacggacttaaattttgtttaatgcttagctacatctccatctgcgaagtttggtccccaccttgaatatccaccacgtaaaataaagaaacaggagcctgggcggtattttcacctcgtctccctccacttcccagctttttttcaactataccattattgttacattttcaagatttgttacatttacgttttattctgttaacaaccatgattacatgccttgcctctgagtggatgctggaagtgaaatagacacactcgtgacactaactaactacgtttgctggctggagcctgaaggtacagtctcattcttgtgttcctaaacctgggtcaccccaggaggaattttctgaaattcagatcaaacgaataattattccttacactaactttgaaaaatctttttgctgtatgtctatggacaggtttctggtgtagacttttgcttttcctgagtgtcaaagctgcctttccttcttcttgttgacagaagcaacacagggattccccacgggagtgctcagctctcccagctcattcagtgtctcgttaactgactgctctaagttgactccttccttttcagatccgcttccaagctgtctttctggaattttcttactgaatcccctgccttcctttatcttgggttttatttatatatatatttttttaaagtacattttcggccgggtgtggtggctcacacctgtaatctcagcacttggagaggccgaggtgggcggatcacttgaggttaggcattcaagaccagcctggccaacatggtgaaaccctgtctctaccaaaaatatgaaaattagcctggcatggtggaaacggctgtaatcccagctacttgggaggctgaggcaggagaatcacttgaacccgagaggtggaggttgcagtaagccaagatcacaccactgcatctaaaaaaaaaaaaaaaaaaaaggacattttcaggtatttttttcctcctttgggaattctttttaaaatttaatttaattttaaaagagagacagggtctcactatgttgcccagactggtctgtaactctagtctttcagcagtcctctcacctggggcctcccaaaatgttgggactacaggtatgggccagtatgctcagcctgggaattcttttcattcattctgaattgcatgtgtcttccacattgttgagtttccttgtcctttactgcagtccatatcatataataatatcatggtatattttttgaaaagttgcatggaagataacaatttctggatgctccatgtctgaatgtgtcttaactcgtttacacatttgataagaactggaataggtacaggaatccatgttgaaagaaacttcttctcagaaccttgctgacatttgcccagcttccaccatcagcatcagagggctgacagcaagctctgtgcctggcacaggacatggcttctcattgctgtagcttaagggacctctctggccaaggagaagccactcgactctgggactccatctagctttctcttggttagatgatttccagtagcttcttttgctattaattttgtgagtatttttacaaccttctagggatcagggtgagttatacccaagtgtattagtcagggttctcaagagggacaaatctaatagaacatacatatatatatatatatgtatatatgagtttatttagtagtattgactcacaagatcacaagataaggagcaaggaagccagtcctagtcacaaaacctcaaaagtagggaagtgacagtctagccttcagtctgtggtttaaggtccaaaagccccgaagctgaagaacttggagtctgatgttcgatgccagaaagtttccagcacgggagaaagatgaaggccggaagactcagccagtctagtccatccacgctcttctgcctgcttttattctggctacactggcagctgattagatggtgcccacccagattgagggtgggtctgcctctcccagtccactgactcaaatgtttatctcctttgggaacaccctcacagacacaccaggaatgatactttgcatccttcagtccaatcaagttgacactcaatgttaaccatcacaccagatattcctctgagatgtgaaattttcagtactattcctatggctttgttcttttctctgcccttatggataaaggatacacttctgtatttcattttggagaacattatttcatgctggttctagatgaatttcactggtttacaagaaacttcactgttctttgaataaaaataaggcaaaatcgtcaagggttttgagactatttggaaaaaaaaagctcgaaaagaatgggatgcacaaactagttattgttgaggcaatcagcatctcaactcctattacaccttaaaaattatttccgcaacataaccacacttgcaaatctcttcatttttacacatatatacacatattctatattagcactgaattttgctaacagctcacatttgccaagttattctaacttgtcttatttatgttcaagttttcatctttcccctactgcttgaaataaaactttgtgtcattgatttatttttgtgaatgtgcactggggacgtaagagaggaaaatagcaggagaagtgtaaacaatggcatgaaagtgacgtaagacgtgagccaggatggtctgtagagttcggactgtatttgctgagatcgaaaggaccaaacagcgctctcagcaaaggtgcaaacttaagaaggctgcaattattagaacataaagaatttccggcgaggcgcaggggcttatgcctatcgtcccagcactttgggaggccaaggcgggtggatcacctgaagtcaggagttcaaaaccagcctggccaacatggtgaaaccctgtctctactaaatacacaaaaattagccgggtgtgggggcgggtgcctgtaatcccagctactcaggaggctgaggcaagagaatggcttgaacccaagaggcaaaggttgccgtgagtcaagatcaagccactgcactccagcctgggtgacaaagcaagactccatctcaaactaacaacaacgacaacaacaacaacaacaacaaagaacataaggaattttccaggaaagtgaaactcaaaacttgacatttgtgaaataaatgtgaacagcagtattcaatcaatttagctcggaaccgtcaatgacctggggagcacgtgagagtcagtggggcagatttccggtacatggacgatacctagagaggtcctagtctgaaagaatcttccggatggaaacagggcatcttgtttatacaagcccaggtctctcacagcaaattcaactgtatgttccttctcctctcctgccagattgccagttactttgaggggaggaatatcttctaaattttctgaacctcctggaatttgacatatcgactgtattctggatatttaatgaattctgtttgatgacacaggtagagtaaaatggtcttaaatcattttgacagaggtaaaaaacattttattccacactttacttattctttttctgcctgaagtgattacaagaaaaaaaaacgaatagtttaatttaaaatccagattggtatgtaattatcacaaaatcagtgaagttcttttcaatgaaaaaaaaaaacaccagttctataatttggacagacaaaatttagcaataacaaaattaaaggtacaacccttaatctattaattatttaaaaatgcatctcgaactatttttctttttatttatcccttgtatcaatagacatttaattggcaaacaagaacatggaaaaatataaactgtaactcactgtaataaactctaaatcaatacaaagagtctaaaatgtgttttgacgtccaaatgtagctacagccactgtgtcctgtgttctataacacagagaaataatacaaaatgattaaaaaaataaaataaattgaagagaggcctgtaatgtaaggggcgctgtgtcactctcaggcagcaacgtgagccagtgagtcaatgcacgaggctctcctgtttgttggtacttcctgttctttctttataaaatacatggagaactaaatccgcaggatgctcacacaaatgattcatagagaaagcttaaaagaatctcacgttgttaatgagcatcacaataggctctgctcatgagaaggcattttgtttccgcagaaatgttttttcttactctgtcctgattttgatttctgtttaaattcagtaaacacattaccaaaatttaaagaaggtgacttgttttccccaactctcagttcaccaaaggtatttcatctatttgttctgaaaatgcagctgctctctagatgtatgtgtgccctgataagaaatgttttgtgtaacaataaaaatcatttcttttgattaaaaaaaaagaatctccagtcgtttacactggaaaacgagagagagcgcttgcatactttcttcacatatattaatggtgggaagaaaatggatgtagagtaatagggcctgaggaactcatagaaggaaccggacatgtatgaaaagatgatgactgccaggtggcactgacgcagcctccagcccctctatcttaggctttcgggacatgtgctctcttgcttccgctggacagtgtctcaatactttcctccctaaaagcaggttttaccctggtcagaggtgctcttgaggcccaaagaagagatttccacaaatagtctataagagcatgtacatactataactgcttgataagtgaatgaatggatgactaaatggagtcaatgctttcatgacctaacgttgtggttatgggtgtcactattctcttggcaatagtgcaatagtgaaatagtaaaatagtctagatgtcattaagaaccttcatggaaaacatgccggtgggggaaggaaaacaacattcatgattcatgggaggagataaaatagcaacatgaaggggaatttggaagatgctgacgctagccctcatgggtgattttgaggggttcaagtcttcagtggaggaagtaactggaactagaattagaagtggggcctgaagatgtgactgaattgtggcaatctcatgataaatcttgaacagtttacttcttatggatgaacaaagaaagttgtttcttgagatggcgtctacttctagggaagatgccgtgaacattgttggaatgacaacagaggattttttgtttgtttgtttgttttttgatacagagtttccctctattgcccagggtggagtgcagtggcacaatctcgactcaccacaacctccacctcctgggttcaagcgattctcctgcctcagcctctcgagtagctgggattacaggcacctgctaccacacccggctaatttttgtatttttagtagagacggggtttcactgtgttggccaggctggtctcaaactcccaacctcaggtgacccacccagctcagcctcccaaagtgctgggattacaggcatgagccactgcgcccggctgaaagaatctgaatattacttgtagttagttgataaagcagtggctttgacagggtttgagaggaatgactccaattttgaaggaagttctaccatagatagaatgctatcaaacagcatcatggtatagagaactcttctttcacacatgaaaggaagactcaattgatgtggcacatttcattgttgtcttattttaacaagtttccacagctgcccaaacaatttggcagtcaacaccctgcctgatcagacagcagccatcaacatcaaggcaaaaccctctaccagcaaaaagattatgacttgctgaaggctcagatgattgttagcatgttttagcaataaagtatttttaaattgaagtatgtactttcttaaagaaataatggtaataacacttaatagactacaacatagttagttttagaagcactgggacaccaaaataactgtggacttgctttactgtgatgtttgcttcgtgagggtggtctgtaactgaaactgcattttctccaaggtatacccatatttaaatagaaaatggactttcttttactaaggagaatggtattttcatttgtctcatttttggagggaaactctagagaagaagccaagacatgcccactgtccctctcccatcctatggaggctgcccagtgccaaagaggaagtggtcactctggtcactcatatacacacagctggcacaattgtcacagtcgctcccctttgtgacaggctggtggaatgacttacagttcagcccaccaaatataatacagatgaatttagtcattcagcctcatgaggtcacacttttactgttttcaacaaagcttaaacccccttcccacattctgtagaaaaaaaagtgatgacttccggggttgttttctaggccatttctatcagaactcctgcaactcgccagatatttcaactcttcggaaagccaccttgtgtccattttatgtcccccaaccctggataatgtctctgttttccatgtacctaaaaacattgcaaaaaaatctgctattcaacatatcttggtgttattgtcactggaggaaaatggaaggagaaaagcaaacagagagtatggaaataaatacccgtcagtatagaaatgtagtatatcataaaaatggcacttcaaaccagtgggaagcaatgggtcattccgtaatacagtactggaacaggttaataaaaaattacaaagtttaatttagatctccattgtattccttaaaaacaaagtaaatcccaataaaataaaaattcaagtgcgaaaaatcaaagaaagcatcaaaagtataagaaacgatgggccaggcatggtagctcatgcctgtaatcccagcactttgggaggccgaggcggacagatcacctgaggtcaggagttcgtgaccagcctggtcaacatggtgaaacaccgtctctactaaaaatacaaaaattacccgggtgtgatggcgggcacctgtaatcccaactacttgggaggctgaggcaggagaattgcttgaacccaggaggcagcagttgcagtgagtggagatcacaccactgcactccagcctggacgacagaggagaatctgtcctaaaaaaaaaaaaaaaaagttggatgatgaaaaattttctaagattgcactggtgatatcttccttgagcggacgttaaaaccagaagccataaagtagtaggtgcaaacctctgactaccaataaaatgtttaaactatttctatggcaacgtaacaaaagcagaaataatcttcttgtagtctgctctactggtggtcaccagtaaaccattcttggcaaaaggcatgcccctgtacccccccaccctcgtgaatctgagctgggcctgtgactggccttcaccaagagaatgtgacggacgcttcagaacttggcctcaggagtgctggtaggtcctgcatttgcactcctggacacccctgaactaagaagtacagctgcaagaagaacacagcacgtggagaggtggtatggaggggccacgtggagatagagagccctggaggctacatggagaagagcacagaacccagctgacccaagaactgaggccccaggactacagccccagtcaagccattccagttggctgccagccatcctcacctcctagctgagctccagacacctaagcagatgaggtctctgagacaccacatctccagcagaactcatacaggaagagcaccacactgtcctcatggggccctttccaaattcataaccctcagaattttaaaaagtaatatgttattttgttttaaagacatgggataggccgggtgcggtggctcatgcctataatcccagcagtttgggtggacgaggcgggtggatcacctgaagtcaggactttgagaccagcctggccaacatggtgaaaccccatctctactaaaaatacaaaaaattagcctggcatggtagcaggcacctgtaatcctcccagggaggctgaggcaggagaattgcccagaggcggaggctgcagtgagctgagatcacaccactgcactccagcctgggcaacacgagcaaaactccatctcaggaaaaaaaaaaaaaaaaaaaagacatgggataatgtataatgtggcaatagatagctggaacacccaatagtcaaactcaaaagaaaatcagcaaactgggaaaagactaagcaatacatatgccaagagactaacgtcttaaatatgaaaaaagagcttatgtgtaaataagaaaaaagtcaactcaatacaataggactcaaaacttactgcaaagaacaaaaacataagtggtcaaaaatcatttgaaatatgttcaagctcactcaatcttattgaaaaactgagtaatattcttttacttgcctattggattggaagatatttaaaagtttaacaatgaataaaattaaattaagtgaaataaaataaaataaaaagcaataaccagaatggaggtgatgtgaggctcatgaaccacttgttgagagcaatcattgtttacaaaaaacctactatgtctatttattcattgacccagcaatataatttctaacaatatatcttataaacatgatatactcaaggatacagcgatacatgaactgttatggactgaatgcttgtgtctcccccaaattcatatgttgaaaccattacctccaatgtcatggtatttgtaggtggagcgtctgggaggtaattagatctatatgaagtcatgaaagcagagaacccttatgggatttgtgtccttatgagaagaggagaaaccagagctcactctctgtcatgtaaggacagcaagaaggcagctgtcaataaaccacgaagagagccctcaccaggtttccaatcggctggagccttcgacttggacttcataccctccagaattgtgaaaaataaatttctattgttcaagccactcggtctatggtattttgttaaggcagccaaagcagactaaggctagaacaaagatgctcatgaagcatcatttgtaatatcttaaatgttggaaaattctacatgtctacccttaacaacctcattcaataatttgcaacacagctatacaacgtaacactgtaaagctttttatcagaataaggtagtattatatatactgatctctgaggatgtctagatattggtaaagtgaaaaaaagaataagctgtaaagtagaatttactgtaggattctatttgtgaccttttatgaaaaagatataggcacatgtatattacacacttgtaggcatgcatacttctatattatatttctaagtacacattgggagctattcatggtgattatctctgaggatagggagtattagaatggccaacttggtatgaatagggaataaagaagacttactttttatactacacccatctgcactgttttttttaacgtgaaacatgtaacttttattaaaaagaaaaaaaaattgtgaaatgcttcatagtcctttgtgtcaagagctctgccataacccaaagcacaaaacctaggaggtctgttgatcttaatctacactttggcctcatacatggatatagcgtgttggttggtaccatgcaaacactgtccctcctttctgggttggagaggaatcaggagtgtttggagaaaaagaaaagcacatcccctgaactggcaagcgatactcatgaccatcagcagccacaggctccattaacaagcaggagagggatgtttccctggtctcaccagcaataaatgtgtctatggggaagcaaagtttctaagaagtgcttaaggaactctaggcattcctagacagcccaggctctgaatttagatgggagaaaagtaggcagatatcactgaaaatcatgttgttttaaaatgttcttttttgcgttgggtgcggtggctcatgcctgtaatctcagcactttgggaggctgagacaggtggatcacctgaggtcaggagttcaagaccagcctggccaacatggtgaaaccccgtctctactaaaaatacaaaaaattagctgggcgtggtggtgtatgcctgtagtcccagctacttgggaggctgaggcaccagaattatttgaacccaggaggtggaggttgcagtgagccgaggttgtgccctgcactccagcctgggtgacagagtgagactctgtttaaaaataaaataaaataagatgttcttttcaagtttatcgattaattttcatgaacctgaaaggtgtttgtgaaagaacaccctattcttattattctatgtacaaagagaatcatattcactcttaaccctcacatcaagacacttactttgatacatttttaaaggcttgaaatccaaaatagagttttaattttcttatcaaaaaatttcaagcctttatatcaaggtggtaggattgttcatctcttttgtgtcaaccctgtaaatgtgagaactgtaattgatctctgctatgcgtgagtgacatggaagaccctgaatatgttgtagaaccagaacattttcattacctacatcatgctgtgtgtcaaacaggcatgccaatcagtttgtggatctaagcaggccattgcacatgcaaacgtgtatgataggtatgacagtttaacttagcattctcatttggaaaacattctggaatatgtgaataagtaactggaaaattcccaaatagacatagcattgcggttcagaaacatgaatatttaccattgacagagagcaagagagaaagcatgcacacaagagagggtccccatcaaactgaacaatgtataagcaagaatccacagtgcaaattggaaggatgatcatggctgcgaggctacagttatgactaaacaaccattgataaatttattctcgactatatcaaatgataaagaaaatagctatgaatttactgaaaaaaaagcattatccctaattaataagaaaaaagaaaaagaaaggaacatccagctcaaacacttgtccaccaaatagcacaacagatattgagaacactaatatttggttataaaggacaagaaattgttaagaagaaaagtaatttccactttggtatttctggccttatgaagacataagatacattgggaggattatggaaacataagtgattgagagaaaatctcatgagaaacttaagaagatgggactgtttatgaaataggaataccacccataattggacaaagacaataaaaaatttttctaattacagtatcattccataagtatacaatgtgtattatcagtaggtgaatatcataggccaaatgaaaagcaaacaagtaagtaaaaatattaagtagaaaaatattctcatgagtgattgatatgattacatttgaattttagaagatgtcattagtggagatgtgaacagaatcaggatttaggatgaagtctgggaaagctgttatgaggctactgcaatggtctgggctcttttggcatttcctctttaagctaaaattggccctttacttactatttattctcttttccctgatatttgctcttcttgtttttaaaaaatccttcaatttaattttaaattttatggctttcctcttcttctacccggttccgttccttactctgcattgcaaattacacagatagtataaacatagacgacgttagtctttaattttaatttttctttttctttttcttttttttgaggcggagtcgcgctctgtcacccaggctggaatgcagtggcgcgacctcggttcactgcaagctccgcctcccgggttcacgccattctcctcctgccccagcctcccgagtagctgggactacaggcgcccgccaccatgcccggctaaatgttttgtatttttagtagagagagggtttcaccgtgttaggcaggatggtcttgatctcctgacctcgtgatccgtctgcctccgcctcccaaagtgctgggattacaggcgtgagccaccgcatccagcctaatttttctttttctttttttgagatagagtctcactctgctgctcaggctggagtgcaatgacacgatctcggcttactgcaacctgcagctccagggctcaagtaattctcctgcctcagcctcccgagtagctgggactacaggtgtgtgccaccatgcctggctaatttttgtatttttagtagagacagggttttgccatattggccaggctggtctcaaactcctgacctcaggtgatccacctacctcgtcatcccaaagtgttgggattacaggcatgagccactgcacccggccgattttttcatttttatttcaaatttctgccatatattttggattctctctttaaaaaaaaatctgtaacattttaaaagcaattttggcattaatatttgtggtagtaataaggttttacatgatggattaggatatgatgacaatacaattcttaaggttaacacagccaggagaattatatggccaagtgaatagatctttagacctctggctttggaagcttcttatgaaatcctaagagatttacagacaacaaatgtttacaacatttaggcacacaacagcataatactagacacaaatactaagcaatattcagagtccaaatacagccatactcattttgcttgtaaaaatttagtttttcaatttgcctcctgctgcacagaagtaatatagcaggtgattcatttccacgtttgaactgctgttaaccacaatgggtgaaggagagcgagatgcaggcttcgctgatcatgtcacccttggaagaaaggggaataaaattatagggcagaatgacctatcatatttccttgacaggtgctaattcactttgatctatccttcaccataatttcattggtggggaggacatacatatttataagtgtggaaacaggcgactgtttttctgtttgcaatttacaacaacaaagaattcatttcaattttcatattagaagtcccaaggtgacccgggagtagataccagtcccctgctgtgcgggatttctaacataataaggaataaagcacaacaacagtacattgtgacctgggctcatgggtaatcaattcacatatttaccatggaaacaacagtaccacgcagaacatcgtcattgcttcaatttgctgacgaaagccctctagaacccaggaagagtgtgcgtgaaagctggctgattaatctgacttacttatgctttgttaaagagttattgtcttaatcataattaacactaaatagttactcatggaaaagctgcaagagagattcagctctacctcttatgaggcttatggtctgtgattttcaaaccatgagtcatcgacaaatatatacaatgaaacagagattgagccaaatgggaggacaccagggttttgatttcagaagtcggatttagaatttcattttctatgcaaaatactgcatggtatacaaacacctctcaggttatataatcatggtgcattatctttgtacccacaaaatgcttaacgaactcagtggggtgagttctttttcttctaaggaaggaaaacaaaacttctatgcacgggaaaacaagccagtgcacggcatgactaacacaatgccatgtaattaggcaaaagctttgaatagacatttcacttaacgagatatacgactgggttaataagcacatggataagatgtttaatatgactagtaattagagaacgtctataatgaacaagttgacaaaatctagtgtcggtgaggaagtagagaaactagaaaccaacacccccgctccccaccaccaccttttgctggtgggaatgcaaaatattgcagccacttgaaaacattcgagcaatttctgaaactgttaagcacacgactgttagagccagcaattcctctcctaggtatccaactgaggagaaatgaaagtgcagatccacacgaagagttttacgccatgttcacagtgtaactcacaataacaacgcaaatgtccatctactggtgaatggataaacaaaaggtatcgtatccttgcaatggagttttgctcatcaagaagagtttcacgtacaataactttgagaaaaatctcaaaattacgctgagggaaataagactgacaaaagattacatagcatttgattccatttatctaacatttctagaaaaaaagacaaaactctataagcagacagttgatcagtgtttgcctagggctgaaggtgggagtgaggatggctcaaatatgcatcgaaaaactttttagggtttatttttctgaaactggattgtgataactggttgcccaattataaatgtgtattagaaatgatcgaactggacatatacctggaggatttgcatgatgtgtaaattataccccaataaagttattggaattcagtaagaacatagcttgctctagatggttaaaggtttcagttgttcctgttataggatcttaccattatgaactgtcatcttcccaaaccagtgaagtcttagcaagtgctggaaatacaaataggttcacaatttaaaggggcagctggagcctcagtactccatcagtaatatgtattaagacatgccacagagcaaatgctcacagtgaaaagtgctggggagactgtacaggggtctactacatgtgattaaagaactgtgtcagatggcatttcaacagctttgtaagtgatgacagggacacaggtaaagttgaaaaatcacattcctatcctccttaggacagatagtaagcatacgtttttaattactgtcatgagtcgcttaaccacatggatacattctgagaaataggtctttgtgtggacatcacagagcatacttacacaaacctagatggtatcacctgctacaaacctagactggatggtagagccttttgctgctgggttaaaaacctgtacagcatgttactggactgaatactgttggaaaccataacaccggctgggcgtgctggttcacgcctataatcccagcactttggggtgctaaggcaggcggatcacttaaggtcaggagtttgagactagcctggccaacatggtgaaaccctgtctctactcaaggtacaaaaattagctgggtgtggttgtgcaaacctgtaatcccacctacttgggaggctgaggcatgagacgtgcttgaacctaggaggtggaggttgcagtgagccaagattgtgccactgcactccagcctgggccacagagcaagactctaccagaaaaaataaaaaaggaaaccataaaacaatggtaagtagatgcacaatgtctatctaaacacatgtgaacatggaaaaggtacagtgaaaatacagtataaaagataaaaaacatggtacccctgggccgggcgcagtggctcatgccggtaatcccagcactttgggaggccgaagtggatcacgaagtcaagagattgagaccatcctggccaacatggtgaaaccccgtctcgtctctactaaaaatacaaaaattagctgggtgtggtggtgtgtgcctgtaatcccagctactccggaggctgaggcaggagaatcgcttgaacccaggaggcggaggttgcagtgagccaagatagcgccactgcactccagcctggcaacagagtgagactgtctaaaaaaaaaaaaaaagaaacgtacccctgaataggacacttactgtgaatggagcttacagtactccaagttgctctcctgattcagtgagtgagtgaatgtgaaggcctaggacattattgtataccactgtagacgttatgaacactgtacatctaggttacactaaatgtatacaacaaagttcctcaataataaactgaccttggcttactgtaactttctgactttatacacttcttaatttttaaaactctgacacttgtaataacacttagcttaaaccacaaacacattgtacagccatataaatatattttcttcctttatatctgtattctatatgctttttttctgtttctaaatttgtaaaactttttaaactttttgttgaaaactaagacactgacacacacattagcctaacagggtcaggatcatccatatcaccatcttccacccccatatattgtcccactggaaggtcttcaggggcaatgacatgcatggacctgtcatttcctataacaatgccttcttctggaaatcctcctgaagatcctgcctgagactgctttaccgttaacttatttataagtaggagtatactctaaaatagcaataaaaagtatacaatatacataaaccagtaacataattattcatgaccattatcaagtattatgtactgtacttcatatgtgctatacttttatatgactggcagcacagttttgtttacaccagcaccaccacaaacatgaataatgccttgagctactacattgcaacagctacagtgtcactaggcgataggaatttttcagctccactataattgtatgggaccaccatcctgtgtctgtcatggactgaagtgtcattgtcattatacaacaccttactgcactcaaatgacctcctgcttcacccgtaaaggaaaatcatcatcagtgtagcctgtagctataggatggtgaagttcactaacttgccagccagtcactgtgttgaaatttggtagaacgtcatcctctgagccactcctaaatcttagtgggaacacaagtagcacaggataggctgacaactgaagtgaaagcagatagaaggaacttttcaacctctcttgtagaacaacatttcaattaccagagaaagtggattctctgggatgctacaaggcagatgtcagcctcaattggttaaatctgagaaacattgactgaatttctcaaaaacaacagggaatcctgcatctaattccaattcatgtttaaaaagcccagaaaattaagttacatacaataaggcaagtaatacattattaccattttgttgccactcaggattcaaacaaaagagactccaataaaccccctgttgtcaaatgcagaagatgaaattggcagagtgtcaacttctacagaaggcctcacttctcttccttgttctagctatttcctgcttgtcttttaaaattcctattacgtcttatggttttgaaaaatattttcctgacccctcagtgtgtccccactttcagccaccttacttacagtctgattcagaggttccattgttttgccctggtatgcaaaatggatgtctatcatttctcacattgcatgcaaacaaatattagtttacttttttctctcatattagaaatctgttaagggaagggggaaatacatatgtgtgtgtatatatacttatatttgtacacgtgcacatacatataagtaaatttgcttaattacctaggtgctgaaccagaatttcataaattatttgtggggatataatataagtacatgaggtaattcctacatgaaatggagtaactaacataggtcagcattaagttgccattaaaaagttccaaagtatgcattactcatgtttggataccatgtaacctgtaatgagatctgaattctggaaatacaggcaatgattacaggagtctaagaataaagaagccagcataagcctaaaaaataaagagaaggttttggagaagttggagttttgtttttaattttcatacatcttggattttatagcaaactcaattaactaattaaaaattagactcaattaactcataaaaaatgcatgttcttatgctgtgatcatatttcacaattgcagtttaaacaaaaccatgactcactatgctgacgttatgtcctggtgctgccacctatggacaccaggtcacagctccctccaggctggcaggcatcttgcagcatggctggaggatcctcccatgtggcctccctgttcctgatctcagcagcttgtttcccacaccttcaagtgtacatttcctcaggtcactccatagcatacaatcctccactgagtgaatccccatcacacatataaagtagattctgcagttgggggccagtgccggggctcatgcctataatcccagcactttgggaggctaagtggggcagatcacctgaggtcaggagtttgagaccagcctggccaacacagtgaaaccctgtctctactaaaaatacaaaaattaactgggcatggtggcacacgcctgtagtcccagctaccagggaggctgaggtggaaaaattgcttgaacccgggaggtggaggctgcagtgagctctgatcacaccctgcctcaataaataaataaataaaataaagtagattcctcctcctcttctttttatttgcaaaatattgcaaactcataaaaagttattaaaattgtacaaaaaactgttcttcacctaggttaaccacttgttatcaattttgtgagatttcctctttctgtctctacttacatataatgaatataacatagttattactatatgtataactgtattgttattgttgctatgtagcgtctgagttcttagagagtaatttgcaaacatcacgatcctttaccccctaattgtttagtgcctcctaaggaggaggacactgttaggtaactgcagtacaatcacgaagttcagctggtgcagattctgaatggaacttgcgagacccttcagaacgtggcccacctggcttcctctttccctgtctgcctggtactctttgtactttgcctaggaaagaaacggccattccttgctatcctccattgctttgtacacacagcccctgcctttcaagcatttttcccattctctttcctcagctgagttcactattgtttctgtgtctggacttgaatccaggctctggcgcttcgtagttatgggacaatggggaagttacttaacctctctggggctcagattcctcgtctgtgaaatgggattagaaaaagaaactgtctcctgggatttattgtggggttaaagtcagatattttaggtcaagagctaaagaatacctaggaaaaagtaagcattcaaaatctacttactgcccctatcacactaccatcatcaccaatcacttctcgggcctcatctttaacctcacacactccaggaaggcctcactgatcctcaaatatgaatccaatggcccagactgtgtgcttaggtaccctgcattaaaatgacctactataatttactggaagtattttctatttgtttcctcctagtttgcgtttaatgtcttttccacagtgactaagtctgacttggtcaattttgaaaggctagtattcagcatagtgcctgacacacagcaagattttaataactactcactgaatctataaatgaatttcagtaattcagaattcagaatgaatttcagagtctaatggccgaaataattttcccaaactcggctgacaattgatttttcaggggaagtccagataggttaagagcagaaaaggtgactcattcttcaggggctcaacacccattccccactgcccagggaaagtgtttgcatgccatgtgaaacttcaagcaagctagtttttaagctgttaaaaaaaatgagggaattaattgttctgagcagtttctcaccatctccacagcattaaattcaacattcgatttgcttttcaaacacagttaacaggcaggaagatgagataatctatttcagtgaaaatgtaaactgtggaagtaccctgtgagtaaactaggggagagagtccctccacaaacaagaaccacggctgcccgtggggaggctgggaacatgcccagaattcacctggcatcactgttgaggtcaaatgttaagacttgctgggaaaaaaatattgttgttgttgttttttggtgaatccagaggaaggaaacatattaaaattctaatgaatgactaaagtgaaaatgctttacaggcttatgaatgaaaattttcccaaatttttccttatataaagattatgcatacaaatttaaataccacaaaatccaaatataaaacaatttatgatgggctaatataaaattacactttttcaatatgatagaattgcatctttgactttatagaaatgttgtttaaaaatgtctttagaggtcaggtgcggtggttcaggtgtgtaatcccagcactttgggaggcagaggcaggcggatcatgaggtcaggagatggagaccatcctggctaacagggtgaaatcccgtctctactaaaaatacaaaagattagccgggtgtggtggcgggcgcctgtgatcccagctactcaggaggctgaggtaagagaatcgcttgagcccgggaggtggaggttgcagcgagctgagatcgtgccactgcactccacgctgggcgatagagtgagactccatctcaaaagaaaaaaaaatgtctttagaaactcctatttatatacaaactgatatctaaaggaagatccattttatacttcattagtgtaactttcagttacatggagttgtaactaagtgcattaaagatacaattgaacttattcccagatgtcaagtgtccctgccaagatttaaatccaatcacaatatgaatgatgtttaggagattcaatggggataaaacaaacaaacaaacaacatggaagacatcctccttctttgctagttgatgatgaagaaaataagggcagctactatgctttactaggcacttaccacatgccagacactgtgctgaactctttatatgtctcgtctcctccccacgagactcatttaaggtttgtatttattattcccaatttaaaattaagaacattggagctgagagaggtcaaatagctttctctaaaccactcagctagtaaacggtgcagtagaagctgaagtaagttctgtaatctattttaggaacttttcaaaacgaactgttctgtttgaaagttacggagagtctacctctaagtaaatgggagtggtgaacacttagaatgacaaggaactgccacttcgttcttgacctgtagaaaggcagtcggtgagggagacatgctatgatctattcggtagtcctaaaagagactcatacttatatacctaaatacgcaggtcaagacctgggcgaatttccctattatatattcctgtagctgagtgatgattcctttgtagcgggagtcgcagattcagtttcatctgtctgttgtggttattagactgaggtcatctccctcacttgacttaccctccaagaaaacagggaacttatctggcttggcgcacactgtctcttcagccctggagcactttgtaaagatgaagtactgaataaatatttcagaatgaatgcataagggaaatgtgtgttcagagggctgcagcagttgagttcttaatacatcgaccctttcaacacattcctggggcctggtgacctctaccaaggctaccttcatgttcgtcttatccctgttgcagcaatttgcaaattgaggaatatataatctagtgagttttaggtctggttgcactctagttgcagtctaagaaacaggtgaaagagcatattttaaaatgaaaacataggagagttctttgaaactgaatctaagtccaacaagcctacgagagatataactgtctttctctataagacattcaaatgagctctgaagtggtacaacaagggcaagtagtggcaaaccctgggaatcttctagcagaggcaaataaattcagcctttagagaaaatccctctaaattttgcttctcctttttaaaagacaataagttacattttgataaacaaggctcagataaatgagaacatttaattctaaaggatacctgttctagaatgactggtgggcagaaaattacagttttagatacttcgtgtgtgtgggagaagatactatacactaaaatgaaaaaaaaatacacatacacatgggagttgttttctagtttgccaatgatagtttgttaaccagtattttccttccttagtaatctttttataagtgaatttgtgtattctccaaacccacttgcatgtacatgcttttactcatatattttgaagaggattgcaaagtgtctgaagaactacgaaggagcttaatcaaaaccgtgaatacatcactacgtcttacatacaggaaaattaggcctccatatttttaagctgaaaaaatgctgaagaataaataaggggtaaagaggaatacaaacactacattaacttacagggtaaaataacttacacttataactagaatagaagaaaatcaaaagtcatgttaacaaaaagcaaagatgataatagagtccactttaattatatttgaattagaaaatggctaagggaaatgttattagttttaaaacagaaaagacatttttacgactgaaatttaaaagaaacatattttaggaaatcaatctaaacaataatttcatctttaatggaaatgagagtagttagaattttttaagtggttactaaaaaattactttgcttgaacttgggaggcggaagttgcagtgagccaagaccctgccactgcactccagcctgggcaacaaagtgaaactctgtttaaaaaaaaaaaaaactttacaaaaataaacagtaccatagtaaatgtctcaatgaaattattttagagtgaagaactttagataaagttactgaagaagcataaaaaatattagaacaatctgtatatcattgttaaggaaaagagtgaacaaggataacatttatgtttgcttactgttgtagaccaaatatttgttccttccccaaattcatattaggaaatacacctactatgatggtacccctgggagacggggcctttggaaggtgattaggtcatgaggatacaaccttcatgattgggattagtgtctttatgaaagttgccttctgctatgtaaggacataaggagaaagtggtctgcaacccagaagagagctctcagcagagcctgaccttgctggcaccctgatcttggacttccagccttcaaaactgtcagaaataaatatctgttgtttataagccatttaattgtgatattttgttatggcagcctgaatggataatgacacttattattaatatttgggaagatagggaaaaataatttatgatggttaaaaatacagatttgtaggaggaaataaagcacagctttgaaagacaaatcatactcgatcaggtaaattccctttatgactcactgtgtagattagaagaggcaggagatttaatatttcttagcttcataaagtccttggttttattccacaggatttagtcataaataagtgaatatatatttcagccctacaagaagttaagtggttccgtatggactagggtgggaggtgagataagatagaaaatataacaatcatcagaatatataacatataacaagatactatttgccagacgccatagtatagtatcttacacattatttcctggaattacaacagctgacctagtgaggtaggtgtttttattttaactttcacctaggaataaactgagggtcagagtgtagttaagaaacttgatcaaggtcacataagtcccaagtggcagggctgaaatctgttgatttttcaaagcatctttctgcccctaagcctttggagttaacatggggactcatgagagcatttcttaaaaacttgtcttggatctaattggaataggctcaagcacctcaaaaagttaaacacacaattaccaaataatccattaagtccactcccatgtatataccccaaaaaagtacaaacgaggactcaaacccacacttgtatagatatattcacagcagcagtattcacgatacccagaaggtggaggtactccaaatgccaatcaacaggtgaatggataaacaaaatgtggcatatatataaatggaatattatttggccataaaaagtaataaaggatttctatatatgacaacctggatgaaccttataaacattatgctaaatgaaaaaaacacaaaatcacaagtattatataatacgattccttttatatgaaatgtccagaatagacacaactatagagatggaaaatagcttagtgattgccagagactgagagatagaaagtagcttagtgattgccagaggctgggaagacagggaaatggactaactgcttaatgtgtatggagtattattttggggtgatgaaaatattttgaaactagatagaagtggtgcttgcacagcatgggaaaggtacttaatgctactggattgttaattctaaaatgtttagttttatgtgaatttcacctcttttttttttttttttttttttttgagacggagtcttactctgttgcccaggctggagtgcagtggcatgatctcagcttactgcaacctctgcttaccaggttcaagtgattctcttgcctcagcctcccaagtagctgggtttacaggcacacgccaccacacctggctaattttttagtagaaacggggttttgccatgttggccaggctggtctcgaactgaccacaaatgatctacctgcctcaccctcccaaagtgctgtgacataggcatgagccaccatgcctggtctcacgtcaatttttttaaaaggctcaaaacacttcctaaaattatgaagcccaagaataatgtctgcaacccatgaatgcataaggcaaaggaaataatgggattccttgttttcataattgaataaacaaggaaggtgttccctttgccttgcacagactgcattttcagtaaaatggaaaattgttggcaatgccactgaatttacctgttggcaatgccactgaatttacctgaagccagcattctctcttggacagaaataaaacaatgagccatactggggttcagacagcctgggttccagtcccagctcaaggaagaactaggtgaactaaggagttcacaacctgacatcttggtgtctgtttatttatccatagatgtgagtgaaatcaggccagatggatgaatgattgctacattatcttctaacctaaaaaaatttataagttaatattttatgaaatgaaacaaattgtgatttcatcttgtatataatagatacaataataaatagtgtccagaaagcactgggagcaatacattaggagtgatgtatgatgtgcagacaaaaatgagaagattgttcttcaaacattgtctggggacgaaacaagtcatcatggatcacaggtttacacaatttagtaatctacttaaatgcaacagttctcagtagaatatagcatttcactcttcacctacatggctgagtacctcgttgtaatactaaatgttcttgcccattgtagaaactcatatgtattgctgaataatcctgacactgaatcattgtggtaggcagaataatggctcccaatgatgtctatgtccaaattcaaaaaccctgcaaataggaatatgttactttacatggcaaggggaaatcaaagttgtagataataatcagctgatcttcagatatgatgaggatcctgaatcacttaggtagtagcaatataatcacaggatccttaaaaggtagaaggggaaggcaggatagtcagtgtcagagtgacacaagaaagagtccaccggctactgttggccatgaggatgaaaggggccatgggcccaggaatggcagcacctccagaacctggaaagcacaaggaaatggactctccctgagagcttccagaaggaacgtaactctgccaacaccttgatttttaggacttctgacctacaaaacttgaagataatatacatgtgttatttttagccactacatttgtggtaattggttatagcagctgaaaaaatatatataataggttgtttttgaatgaacgaatgaatgaactcatggatgtgggaggtcaaagtagacacggcggctgggcgtggtggctcacgcctgtaatcccagcactttgggaggccgaggtgggtggatcatttgaggttaggagtttgaggccagcctagtcaacatggcgaaaccctgtctctactaaaaatacaaaaaaattagctgggcatggtggtatgtgtctgtagtcccagctacttgggaggctgaggcaagagaattgcttgaacctgggaggtagaggttgcagtgagcagagatcacaccactgcactccagcctccagtccagtagacatggcacccagcacccccagaggcattgtgtgaagttccaagaaggtactggaaggtgaatttgcatctatatctatcccttgatattgaacttcccagcctccaaaattgtaaaaagtagatttctttatcaattacccagtctgcggtattctgttatagtgacacaaaatgggctgaggcactgaccaacaaaaattgtcctgagaaagacaggggcacctattttaataatggcatgagaacaaacaccattctgaaagaaagcaaagggtttctctgagttttaaaagcacacaaaatatttaataatagattataagtattgatgatgaagactacttatggattatttgtactttcccctatggaaagcagaaagattttaactatggttatcaaaatatattatgataaaatgttggaggagaatttagcacaaaactgtgatttcaagagaataaaatgatttaatttcttaccgattaggagattgtagaggagaagaaaacaattcatccatcgaaggcaatgctatcatggagtttagcaggaacttaagtgaatgctttagtgaaaatcatcaaccatatgtgactactttaaaaagcctaaaaatgttttttaatgctaaagttcacagaaaataaacttctaatcctttaaatatgttagattaaaatatttttattataaaaaattcagaaatatttaaaaaaatctcagttaacataattaagattaatcttggcaatgtgaaaaaaacacagttgtcttttctctgatgtatcgtgttaattaaaaagcaaacatacatattgttttatgttgggttatgtttccgaaacagttcaaatatgcttcctcccacataatgtttaagatcataaaaaatataaatttttgttcattgaatatttatatttttatatcaactataattatgttttccagaatatcaccttaaaaatgctttccaagatctttaggcaagttaaaaccttgaagtaatattaaattaattgaaaatcatttgatactcagaaaatttcaaagtaagataaaaagaatactgaaacattaactactaagcataattttaagtttgtatacttttatttttatttttacatgctcgagggaagccaaatctttagcttatgttaatgaccattttcatttttgccactttgcaaagcgaaaaaaggatgtgtgtagctataaaaaaattatgttttatgtgtctctgacttctgctagtcagctagaatgcttatgtacaacacacaatctcaattatctgtcaagtatcttgctgaaatagcaattatagttatatagatggttacaactatactagcagaaagagtgagagaaaaagaaaaacatatttatgcttttttttttcaagaacaaagactggtttttgaataaagcagcagttctcaacatcttttctctccatccagtagattcttaaaaattactcaggaatctaaagatgttttgtttctgtagtttataatgtgggttataagtatcaatatttgatgttttaaatcactaaaaccagccgggtgtgatggctcacgcctgtaatcccgtcactttgggaggcggaggcaggcggatcacctgatgtcaggagttcgagaccagcctggctaacatggtgaaagcccatctctactaaaaataaaaaagttagctaggtgtggtgatgcacatctgtaatcccagctacttggaaggctgaggcaggagaattgcttgaacctgggaggcagaggcagcaataagctgagatcagccactgcactccagcctgggtgacagagcgagactccgtttcaaaacaaaaacaaaaacaaaactgagaaaataaaatatatatttattaatgtattgggaaataacaatgttgactccattagataataatgtaaataacattttcttaaagaaaatttgtatgagaaaaatgacaaccttgaacatttttacaaaaatatcctgaatgtttggcttaatagacaactgatgggttttcaagtctgcttctccatttaatctcttctggtcatatagcctctgaaaaactccgtagcttagtattgttatgaaaataactttggtgtcacagttcccctgcaaacatttcagggaaccccagaagtcttcagaccacactttgtcctaaagtgtctgtctgtcctacaatgtaaatgaagctcacagttcccctgcagacatttcagggaaccccagaagtcttcagaccacactttgtcctaaagtgtctgtctgtcctacaatgtaaatgaagctcacagttcccctgcagacatttcagggaaccccagaagtcttcagaccacactttgtcctaaagtttctgtctgtcctacaatgtaaatgaagctcacagttcccctgaaaacatttcagggaaccccagaagtctttggaccacactttgtcctaaagcgtctgtctgtcctacagtgcaaatgaagtacaccacttggagagtgaattggacttgtgttggtttataatgctgatatggttaggctttgtatccctgcccaaatctcaccttgaattgtaatccctgtaatccccataatccccaggtaacgagagagaccaggaagaggtaattgaatcacgggggcgcttcgccatgaagttctcatgataatgagccagttttcaggagatctgatggttttataagaggctcttcccctttccctcagcacttctctctcctgtcgctttgtgaagaagatgcctgcctcccttttgccttccatcatgattgtcattttcttgaggcatccccagacatgtggaactgtgagtcaattaaacctctttcttttatgaattacccagtcttaggtagtatttttatagcagtgtgagaatggattaatacaaatgcctacatatatctaaaaagaaactacaaagatacatcaacatcaaaattttagcaaaaattacttaacttcaatgggtttgcttcattggtttactgattaggccttgacccacaatatgaaaaaatgtccagtgaaagcaaattcctctgccttctgtctaatctgcctacagagcagagattctgtgtctcatcagaatagttttctgtgattttagatgactttattatgcccttgattatttaagggcaaaaaatgttgcctcacttaaggaagagctaagattctttacaattgtctttatcctctatgttttatgcttgtattttaaatatatgttgttactttgagagacaggttttttcccctcacttattcacgatcctgtattaatctagtaaaacaatctcctctgacaattattaattttaacttcccaacattgaaccccaaatttagataaaaaatagaagtttcaggatgtttttttctccctaaaactaactttgagatctcccaaatggccctggaaaatcaccaaagcttgttctttcaacttataaatagatgctagaaataattaggtctgtctaatgtgttattttaagagttgcacaggaagaattttcagatctgaagaaacactagcctcctctaggttaagtttgcaaaatcttattactataaacatttcagaaattgtatgctttatggaaagtctctggtgccctttctgcccaccatatgaggaaacttcaaaagttcacagaaaatgcatattatagaaaaactacgcatggattccaatttttgtgccaaaataaactcatactaatttgttacaatgtgtctgagtaggatccagtttgaggcactaaagaggataagatggtcaggtgtggttggttgctcacacctgtaatcccaacactttggaggccaaggagggtgaattgcttcagcccaggagtttgagatcagccttggcaacatggtgaaactccatctctactaaaaatacaaaaaattacccaggtgtggtggtatgtacctgtaatcccagctactagggaggctgaggtgggaggattgcttaagccggggaagttgaggctgcagtgagctgagatcatgctactgcactgcagcttgggcaacagagcaagaccttgtttccaaaaaaaaaaaaaaaaagaagaagaagaagaaggataagacgtgagtatgaaaagagtccctatcagagcaacatgaattctgctaaaatccaagcaacttacagtgaaacttaggtgaaaaaatagtgaaatcactgatgtttcttgaaaattttataacgacaatgccccaaagaaatgagcagtttacaaattgataactcctgtttagaagggatgagatgatgttgaagaggaagcctgcagcaatagaccatccacatcgattcacaggtgaaaaattcatcctgtttgtaccctaactgaagaggaacaatgactaacagcacaaacaatagccaatgccatagacttctcagttggtgtaatttacacaattctgagtgaaaaattaaagttgagcaagctttcctcttgaggggtaacaaaactcttgtgcctagattagtgacaaaagtggagctttcaatggaaattttaaacaaatgagatcaacatcctgaagtatttctttgaagaattataacaggagatgaaacacagctttaccagtacaatcctgaagacaaagcacaaccaaagcaatggctaccaaaaggtggaagtggtcgtcaggcaaaggcaaactgatgaagaacaaaggtcatggcaacattttttttttttttttttgagacagagtctcgctctgtcacccaggctggagtgcagtggtgtgatctcggctcattgcaccaccacctcctgggttcaagcgattcttctgcctcagtctcccaagcagctggggactacaggcgcatgccacaacacctggctacttttttgtatttttagtagagacagggtttcattgtgttagccaggatggtctccatctcctgacctcgtgatccacctgcctttgcctcccaaagtgctgggattacaggcgtgagtcaccatgcccggctggtaacagtttttgggaggctcaaggcatttttgcctgttgactttatggagggccaaataaagaaaacgtctgcttattatgagagtgttttgagaaagccaaagctttagcagaaacatgcccaggaaagctccaccagagactcctcctgcaccacgagaaagctctgataactcttctcattgaggaagggcaaatatgcaagtttcaatgagaaattattaggcatccactttacaatcctaatttggctccttctgacttatttttgtttcatatttttttttttttttgagacagagtcttgctctgtcacccaggctgaagtgcagtagcgtgatcttggctcactgaaacctccacctcccgggtgcaactgattatcctgcctcagcctcccaagtagctgggattatgggcgctcaccatcatgcccagctaatttttgtatttttagtagagacagggtttcaccatgctggccaggttggtcatgaactcctgacctcaagtaatctgcatgccttggcctcccaaagtgctgggattacaggcatgagccaccacacccagctgtcctaaatttaaaaagtgtgtaaagggtccccatttatcttcagtcaatactgtaaaaaagaatgtactgatgtggttaaatgccagcagcctcagttccttggggatggactaaacggctgctatcatcacttacaaaagtgtctggatcttgacagagattatgttgagaaataaagttacatttttcatcttttaattccattttttttccacaaacattttgaagtatgcttacatgttcttactatcaggagaaacactgatatcaactcatatacaacagaaaattttattctccaaactgaaagtattggtcgcagcagtaatttaacaacagcttttaagtctttatcatctatagtcacttgtttcactctgatgcttttctaaggctttgctttaaggtacagaccacagcttgtgtcttcaacaaaagacagtttcagagatttttggaaaagcgctctgaactactgacatttcaaacagttatctcctgggcatgggtttctgagctgagaatgcttagacaactttcagatatatcagtggactatgttacgatttctagaactctttttagtgaaatcagattattaatctaagatccagcaggagaagaattaattatttaggactgaatgagctgatgaggaaaactctgttttgtttgtttgtttgcatgatgttgttgtaatattccattttctagatatatgacaaagccttttgtctttcttcttaaactttctatcatgtacaagaatctagtagactccacttttctacaatcaaacgaaacatttctaaatgatccctgatttttactgacactccagatttcatacattcttcctaaatttcattacttttcatggcaatgtaatagtctgcacagaaatcagtaaaaatctgtcctactttttaccagaaaaataattggacaacctaggtcaatataaaataaattgggcaacctaggtcaatataaaataaattgggcaatctaggtcaatataaagcatcacatttgagaatggttcttatttcatcagatctgacattctgctcttaaggaacaactgttgattttgcatgggtccacagaacactctcagggaaactggcttaccaggctccagcgatacagatgggaagacaggtaaaatcctggcacattagaagcattaatacattttcaggacttcaagagagtttacccaaatttacatgttatacaggtataacctagtaaagacagccttgagcttagttttatagtcacagaataataaataagagcaattttaaaacacaatttgaaattccttataaaaacatttgtggttttagtagttacattgtatggttctagatggaagaagtaaagtcaaggaggcctatatagtaaattaacagtcctaccaccaccatataactaattaggcccaaacaaatgagtccaatattttttgtgattattaaattttgagattattataatcataaattgggatagaaagtaagaagaaattttgaaggacgttgaaacgaaagaaacaagatgagtgggtgtgttatgaaatgccaatcctgtcatctgatttatgggtatgtgccacttacagtgtttgagccactgtataactttaaaattaatgcaaattatttgtgtctgtagagacacaaatagattttgtctatgttttagaaatgtgagtgattctttcctcctcaacaaaaaccactttgcatttattgtcagatacgtttcagcatttgtgattgcctagagatgacttccctttgcaattcctttgaactggtttttaacatctgactagtttcctcaaaatttaaataaaatctttgatgtgttcatttatatttgcctgagagtcatgactttgttttaaaaaattatacttttaacaatttaaagaaatcaatattaggggattgttcttgattttgaaaaggaaaaactaagaatatcaaccaacttcaatccaggactgctcagaagctggatagaaaaaataatgaggccaggcacagtggctaatgcctgtaatcccagcattttgggaggctgaggcgggaggatcacctgaggccagtaattccagaccagcatggccaacatggtgaaaccctgtctctactaaaagtacaaaaaatggccggatgtggtggtgcatgcccataatctcagctactatggagactgaggcaggagaatcacttgagcctgggcggtggaggttgcagtgagctgagatcgttccactgcactccaggcctgggtgacagagagagactctgtctcaaaaaaaaaaaaaaaaaaaaaaaaataccgtcgtcgggcatggtggctcacacttgtaatcccagcactttgggaggccgaggcaggcagctcacttaaggtcgggagttcaagaccagcctggccaatatggtgaaaccccatctctaccaaaaatacaaaaattagtcgggtgtggtggtgggttcctgtaatcccagctactcgggaggctgaggcaggagaatcatttgaactcaggaggcggaggttgcaacgagatgagatcgtgtcattgcactccagcctgggtgacaggagcaaaacctcatctcagaaaaaaataaaagaaaaaaaggcagatgttaaaaacaatttcaaaagaaatgggaaattttaacatggtttatattttagataaaattactaagtaatttttttattttaaaaaattaataaacagttttcttaggggtaaaattggtactaaataatggagttattctctttttttttttgagacagagtttcgctcttgttgcccaggctggagtgcgatggcgccatctcggctcaccgcaacctctgtctcccgggttcaaacaattctctgccaccatctcccaagtagctgagattaagtcatgtgccaccatgcccggctaattttgcatttttagtagagacggggtttctccatgttggtcaggctggtctcaaactcctgacttcaggtgatccacccaccttggcatcccaaagtgctgggattataggcgtgagccaccacacctggccaatggagttattcttaggccatgcttgctgaagtattgaggtgtctagtatcacaaaatttgcaaatcatgttcaaaaaatatagcaaaaaaaaaaagaaaagaaaagaaaaagaaaaaagaaagtgtgtctttgtgtatgagcacaaaggaaaagaaagaggacagagccattgagaccacctgttaatggctggtgccagcaaggtggtgcctccatggctgctcaatgttgatataatgttgatgtctctcaacttctcttgaagttgaaaattttcaaaataaaaatggggcaaaataccagagagaaaatttgcatttatttaaaaaacactgagcattggttgagagttttagaaccagaggacataaaggttcttgataacatatgtatttttcattcctcagatccctagccagtctatactcctttgttccagacacactgataagagaataatccaacttagttcatgaccataagttaatgattatttcagatcctgaaaaagaagagccggaaagtgactgttcagaaatcagaatgtctatgtggcatgtggcaagggaagaaggtacattcaggctccctgcaggcgcacaatctacaatgcaggaccacccatttccagtctctgtgatgctgaccacagcctcttagagctggaactaatagcaaacctcacttggtgtttgtggtctcctaatgcattaggttctccccgcacacaccatgaaattcatcagtactaactgctttggacacagaatattattactgacaggacagaattgaaagaggccatactgatatggaagtgctgggaagggaatggcatggtcgctttaaccaatatggaaggtggggaagggaagtgctgggtagaggagggcatggtccctgcctagggctccactcttgggcctgtgcccagggacctaggtgtggacaattattttcattttcctgccccaatgttggcatttcccaagaccaccctggccttccacatccccatcctgtgcctataaaaaccctgagagcctagcaggcagacacaggcggctggacgttgagaggagcacatcagcagaggaacacaccgggggctggatgtctacaggaacacaccaacagccaccagcatgttggccactgactggcagaacgatgtggagtgtggctgaggcagttggaggagatcccaggctgctgagcagcccgactccaggtgaaaactatctctcttctggctcccccagctgctgagagctactcaataaaacctcactctcattctccaaggccacttgtgatccgattcttctggtacacaaaggccagaaccctgggatagagaaagtcctctgtctttgtgataaggcaggggtctaattgagctaacacaagctgtctacagatggctaaactaaaagagcaccctgtaacacatgcccactggggtttcaggagctgtaaacattcacccctagacactgctgtggggctccaacagccctgtctgtatgctcccctagagcagccgggcactaaagaagtgagccacgcccccatgacatgccctgggaggaggacaaggaaacttcctgtttcaatacctggttataaatattgctggagaccataataaagagatggatcatagaggaaagatcatgtgaaaaaagggtgagtgtacaattttagggtaaaatagaaatacgttattaatgaagcaggaggtgggtgttttaattttggtccaagttttcagttaaaactttttgcttataaaaataatatctcccaaaagcataagtgggttcttgcatgaacagagaagaaaacaaagatttacattcctataaattacagacaacctgaaatatggccctcgagctaccaaatttactaaagcacactggcagtcattaaaattgcagaacattttacttcagtggtacaaccacaggggcctctggggaaaggctgggcattttactcaccaaaacaactcattggaactaaaggcatttaaaattactccactcaggctgggcgcggtggctcactctcaatcccagcactttgggaggccgaggcaggtggatcgcctgagatcaggagtttgagatcagcctggccaacatggtgaaaccctgtctttactaaaaatacaaaaattagctgggcgtggtggtggatgcctgtaattccagctactcgggaggttgaggcaggagaatcgcttgaacccaggaggcggaggttgcagtgaactgagatcgcgccattgtattccagcttgggcgacagagcgagactccatctcaaaaaaataaataaataaaataaaataattccactcagcaagattttgttgttggatacttccttttgttccaattcaaatacagtgcatgacattggaattgcaaattgctcccattatacctacctgaaatgaaaaaactcaagagatttgaccaagaaatatgaacacctttacatcaacagagtaaatgggagaagactgttcatatcatttatttggaaacgttaaggttggaaccacaatctaacatttgacagaaaaaaattatatcagagatctgtaataaaaaatacagcatatacccctttaagagtaggcaaaaagagaaaatagctggagtatccaacaggagatattttgaggcaaaaaatttaaaatagacatttgcaaagatgatgattagggaagatggttttcttctaaagacacatgcagtgaagaaagaaatctttattcttatctgggttgcaaatggcactttttgcaaaagaactgctacttacttctagagtcagctaaaatgatatcaaacttttttaaagatgccttcttaaggcagaaagtgtcttaatttagttttaagatattttaggcttattaacctcaatagtgaacttgaagattttccattaaatccactgtccatcagcctattatagacatattacaattctcctcccaacatcttgccttctttatgaagttgacgcgaagctgaaaataattctgtcaaataagacaaaaaaaattaacaaaccacaaaattctatttcatgtcattcatcaaatgctatcaatacactctgtgccaagcactgggttagaagagaacaatgatattatttgtcatttattttaactttatctaattcattttttataaatgcacgagtaagtatcttttagacatgaaatgtaatatgtggatagtatgtatattttgaaggaatataacagtttaatgctattttcacaaatgattattttatgctttaaagaagtttttggtaagtgaatgtggaaatcctgaaataaagtcaaatgatatgatttgcattttcccagcagcctctaaggaagcagcctgagggatcagcctgaggaaataccctgagggatcagccttgaggaatcaggtgaggcatcagcctgaggaaataccctgagggatcagcctgagggatcagcctgaggaaataccctgagggatcaacctgaggaagcagcctgagggatcagcctaaggaaacaccctgagggatcagccttgaggaagcagcctgaggaatcagcctgaaggatcagcctgagggatcagcctgaggaagcagcctgaggaagcagcctgagggattggcctgaggatgcagcctgagggatcagccttgaggaagcagcctgaggaagcagcctgagggatcagccttgaggaagcagcctgaggaagcagcctgaggaaggagcctgaggaagcagcctgagggatcagcctgaggaatcagcctgagggaccagcctgagggatcagcctgagggatcagcctgagggaccagcctgagggatcagcctgaggaatcagcctgagggaccagcctgagggatcagcctgaggaatctggctgcagggaaaatagaagtcctatcattggactttatctcaccttctctcaccatgttctgtattgcccataatctgttttttgatataatttcaagatactgtccctgaaactctgcaatggggggcttaaggaatgtgatagcttgacaaaggtttggaggagggtttccaggataccctgtagtgctctttcaactccaggtcttaaacagggccacattccctgcaaggcccggcacagaccccatgctgaatacatagaagctgcttattgccttgttgccccatcaccatttttttttctgttctgcctccttcttggggccattgaaggttcctcagcattgggctccaaatcccttctctgtccttcccacccacttctgtgctaagtcccagaacctggtattgtcctttcccctagatgatgagtctctgagcctgcagactgtctggatcactttctgggggccaagcacagtgtctgctaagaaggcgatccctgagacttttattttattatctaaataaaaggtgaaagaatctgtccaaaatagttgctttaggaattgtactccttataaagcaaagaacacactgtcacagaattgattttatcatagtcatgaaatctatgttagaagaaaacagccctttttctcagccaggcagagactttgaagagttaacttttactgtatcacagtggcctacttaatgctatacaagaacacagaatacatgctgtatttacaaacttcaaaggaaactagctatttgcatttttatctgtaggagaggagagaaacatgtttcctttttgaccttttatcctcaagttatatatgaggaagattaaatttgtcagtattgtcagtgtaatctatttagggttttaaaccataacagtggaaaatatcaagattgactttaaagcctactgaatataacttttttaaaaaaaagctggatgagacgctgaaatggagagaaagccttagttatgggaggccggattggaagtttttcaaaataagcatcagaaataatgggccccctattgctcacatgcagacatcaatcttttgtttgtcctggcaaggtgagaaaaaaaattgggttaccatcaaagccaggtaatacggcccgctcatttgtaaatcacatggctttagtaagcaaagatgcttcctagatttaatgaatgtggtatcagaatgttttctttgaatgagtacagtggtcttctatccggttttcttccttccatatatctgtctctttgaatgacaccaagtggattaatcttcctaaagccccagttgggaaaattatcattctgccttctcccaagctttcaaccattcccactatatgccaaataagctcgttatgttgcattcaaagccttctaggacttaacagtaacctatctttctttttatctcaaatttctctcccaggtacaccaagttgcagctaaaccaaactgtggtttgttgcctgtttctggatctttgctcattcttcaccatcactgataatgttctctctaccccctacctttcaaaatcccacctgcacttcgagattcagttcagctcacagatccatcttgaagctagacatgacagtttccctcttttgcagtagcagagaaatatgtttgtactcacaatatgtgtcacaccctagattttaaagctcccgaaatggatgagccttcttttactatttttatatctcccactgtcctgccaaggacgaagaaatattttttatatttctatatattattcctactataaattccttagggtgatgagaacttccttagggtaaacacctagtttttggtattatacttatcccttacagtatttagaatttatttagtaaatgcttaataaatattttttaactaaatgagtagaaaccgtagaatgagtagaaaattttttcctaaaactacaagtaggaattttgtctatctcagagacagcagaatatgcttagtatttcaataaaggacagttttttagaataaatagcgtactttggaagcctgaaatagctggaaaagatgaagtttcttatttattatgcctctggatgtgtttttaatttatttccctagaagagctcttaggcaaagtgataacttggcttagaatctttaggagaaataaagatgaaaataaatacggttctttaccaaattgcatgcacatcacacacacacacacacacacacacacactctctctctctctctctctctctctctctctctctcaatacaaaagagacagcgctaaccctgtcttgaatccatagaatcctcaaatgcatgcatttcagagtattgatggtgacactgataaaacattcagaaaatgacttattctgaatctgctgaaggggtgtcctcacagtgaatgccttcctttccttctgagatccaccaaaaaacatactagtctgttcagagtgatcttagaattcagttatttttatggcttggaaaatctactcctggaaatctgttctttagaaatactggcaaggctgtaaagatacatgtacactgctgttaatcccaacatttggagaaggaaaaaaagtaagcgatctcaatgtctactaatagagcaaagctaaataaattacagtacaatggaatgtatactctgcagccgttgtgataaatcaagtatgtccataggggtccttggttaaaaggctgtccatgatgttttattaaatgtaaaaagcgcgttgcaaaagatggggaaatacccaaattgctgaacacttctgtagatctcatttttctaagagtaatattctatgtatctatgcacttatatttatagacaggcatacatatgtataaatttgagtacatatgttgatgtctgcaagtgcttatacatctgtttatgtgtagatgtatgtataaatgtttatacgtgttatatgtaaaatatataagctatatatatatgcatgtacatacctttatagatatttttacagccatagataaaaagatgtagaaagattcagaacaatttagaataattatctcttttattggcttaaaggagggaaaagtgaacttttattcacttaatagaaaaaaagaaaaaagtagcagaagttcaaaactgtggtgtttaatttgggggcctgttctgattcatgaatcagatttgaaatatacttgaagccttttcttaaaaatggtcattcttctgacttgatctgcagactttattgattccaaatggttcacaatgaggctgtgttctgtcatcttttacagcaattgttcctactttcatgtatctgcctgtgactacaggaggcagcggcttccccagaccactcacctccctccttcacacctgcctggcccgagtcccacagtgatacctgtcatggaactacatcttgtattcatgtgttaaacagagctctgtagttgattcgcaagaaagaaagttcctttcagtgaaacagagttgtagcataattgttgttttaaaacggtatttttcacatcaaaagatgatttaatgtagaattattttttaaatgagctgccttcatagatttaaaatatactttaacaaatatttgacttactctcacatacttgacattacctaatatgtaccttgtacaccttttttatggattagagtttgaaaccaaaccagaggcaccttctgttatgccatcctctgaaagcatatttcaggctgagaatatctattttgcattttcttattatgtatcttgagatgcaatttctttcttttcttcttcttcttcttttttttgagacagagtcttgctctgttgcccaggctggagtgcaatggtgtgatcttggctcactgcaacctccacctcccaggttcaagcgcttctcctgcctcagcctcccaagtagctgggattacaggcacgtgccatcatgcctgactaatttctgtattttttagtagagaggggatttcaccatgttggccaggctggtcttgaactcctgacctcaggtgatcctcccacctcagcctcccaaagtgctgggattacaggcatgagccaccgcgcccggttgagatgcaatttctataacagccctcaccaactattttaggtcttcctgctggactcatttgctcatttattcagcagatagttactgaatacctacctgcttcctgccactcacttttgttaagtgctggggatacagatgtgaatacagtgaacatagttcaagtctactgaggcaggcaacaaactttcatcctacagtctcctaaataaaggtagactagcacattgcattatgacacatgaaagaagagtaaagaaggaggtgagagttgtcacaggctgcaagaatcaggacaaggaactgttctctgtggaaaatcagataaacagagacctgagacctggacaggagtcagctgcatgaaaaaatgcagacaatttctctggccatgagacatgcgaaggccttgagatacagaaagatttggaacttgcttaggaatgggaataaggcccatgtgtttggagggcaagaggggacccagacacagagccgtgtcagtaagggcacatctgagtaaggctttcaagaagctggcatttcaacacagatccttctggcagtcagtgtgcatttaccaaatgggcctgccattatccgtacatgttctcatgtagtataaaaagtcgcaggaagctttttgggaacttgccccagaatttccacaaaagcagagctctctgatttctacggggaggcagagaggctggagggaagtggaccagtgagaagtggactgcagggctgcagggaagcctgatcaacacgtgggctccaggctgctggatgaacagagcctggggtggacttcagcggggtagttccatgcaggacatgatccacacaacgctatgaagtcctgttccctgcccagagccaccagaagtatcttcctaaagcataaactggtcactctgttctcctgacttaaaaactccaggctgggagtggtggctcacgccagtaatcccagcactttgggaggccgaggcgggtggatcacctgaggtcagagttcgagaccagcctggccaacatggtgaaaccccatctctactaaaaacacaaaaattagccgggcattgtggcaggcgcctgtagtcccagctactcgggaggctgtggcaggagaatcccttgaacccaggaggtggaggttgcggtgagccgagtttgcgccactgcactccagcctgggcaacagagcaagactctgtcttaaaaacaaacaaacaaacaaacactccaatgactccctgatgactaagtgatagagttataactccttgaaggacacaggaggccctctgcaagtggatcccccaaattctttgtctacttttacttccctgagatataactacagcttacttcctaccccatatgggccaagacagagcactctctgtgattcagcacatgggattcctcttccagggatgactaaccacctcctctgcatggtaacctactgctgataccacaagacagcctgctgcctctgtcctcctgattccacagcttttggagggcagcacacggcactggggagaacagcgggcatgcccctggctgtccaggtcagctcaatttaactggtggtcagtggcttacagatattggtaccagctatccctaacagctaaactctttgcaaagcatctcctcatggggcaaagtaaaaggaaggtgggagattgggaaacagttacaggtaactaaaacagcatgtgccaaggtcctgtgctgttttgctcaatgaactggagaaagaccagtgtctggaatgcagtgtgaagtaagaagaagccaacagtggcaggctctgattaaggttttaagaagtgcaactatcttttgcttttacaaaatattagtggaatggtgactgatggacatccccgtgaaatggcagcagacaacacagaaaacatgaatggacccaaccatatgttaaattggttctatctttggccgggtgtggtggcttatgcctgtaatcccagcactttgggaggccgaggtgggcagatctcctgaggtcaggagttcaagaccagcctggccaataagacgaaatcctgtctctacaaaaaatacaaaaattagccaggcgtggtggtaagcacctgtatcccagctacttgggaggctgaggcaggagactcacttgaacctgggaggcagatgtttaagtgaagccgagattgcgccactgcactccagcctgggcggcagagtgagactcagtctcaaaaaaagtggttctctctttgcaatagcaaagagaaagaaaacaaatggttacaaaaccaaaatacagtaggggacactgataaaattcaatttagcaaattcttcctggcctgtgaacttgctaagggtatggcgttgtagggactgtgaaagatgaatgggacctacagactggtttatcaggtatgagggaaacatttaaatatttacacaaaatgcaatggggtttcaatataaaagaaggttcagaaggcatcacagaacacgtgaaaattgtactgcgtcttcgagagttgtaaaagcctcaggcgaagggctagaagagggagtttcaggagaaggaagggcagcagagtgaagacactgaaacaagaatcggaatggctgccctattccaggggcattgagccatgtccctagagcaaaacgtgtctttttagaaagaaagaaaatcatcaataaattataatttttttttacatgtcaaagaggaaaggtacgggtgttaagtaatcagtctaaaaaaagttttggggcaatttcaatatttgttcataagaattcatgagtagggtttttacgttactattactttaagttgctgtaggcagaatttagcttgaaggaaatttaagatttcttgataattaaaatacgaaacagtatggcaagacaggctggggaactccaagtctgccttaattagatgctaaaaatagatgtttctaaaagtcctgtttcctttctaggccatccaacattctggagaagtgcttttaatctcagcaatgtgctaattgtttctaatggcctgtaaacaagctccctgaactattaaccttcttctctctttagccagagattcaggaaattagtctttgaaagaagagtctccagcaggttgcccaggagggtgtcccaaagtacagacactgtcactggtttggaggaaaatcaaggtcagatctgagcagcaagcttgtaatgtggaatagacaagctcaaaaccttaaaaagaaagatcactccactcctctctggtttagtttggttgtgttcctatctggaaggagaaatataaatgttaggctgggcacagtggctcacgcctgttatcccagcacttcgggaggccgaggcgggcagatcatttgaggtcaggagttggagaccagcctggccaatgtggtaaaaccccgcctctactaaaaatacaaaaagttaccttagctaggcatggtgacgggcccctgtaatcccagctgctcgggaggctgaggcaggagaattgcttgaacccagaaggcggagattacagtgagccaagatcgagccactgccagcctgggcaacagagcaagactccatcttaaaaaaaaaaaaaagaaaggaagaaggaaatgtaaatgttggcacctctccaatggcttccaaacacaaacacaagcccataatcccaggatttttaaaaaacattaaaacaatatccttcagttgacaagaatgttgaaaatttgattgtgctaagttaaaattgatgccatattgaaaatggcgttcaatttaatctcagaaaggcaatgcctacctgaaccctcggaaaggagctggggcattgagggtgccaccctctgttctgcttgtccttttcagaacatgacaaaattaacttaatttgtcatgaaagatgaatgatcacagagtagccaaaaaatgttgtgaaaaagatggtcagtgaagagaggctttatcaaacatatttcaaactttatttaaaattacaatagtcggccaggcgccgtggctcatgcctgtaatcccagcactttgggaagccaaggtgggcagatcatttgagctcaggagttcgagaccagcctggccaacatggcaaaaccccatctctaccaaaaatacaaaaaattagctggggatggtggcgcacatctgtggtttcagccagttgggaggctgaggcaggaggatcacctgcacccaggaggcagaggctgcagtgagctgagattgcatcattatactcaagactgggtgacagtgagactccatctcaaaaaataaatacatacataacataaataaaattacagtagtaaaactatgtgcctggcacagaatgagcaatggaacagaagtaaaagcctggaggggagaacccaagagagacagatatttatgtgtgatctcagcttataaaacctttccaattagtgaggtattagatgatttgctaaatggtattagaataatcaacataataaataataataaaagttggatctttttagcattcctcaattgaggtaatcaggaggatcaaagaatcacatgtataaaacaatgaaagggtaaaagtaggatgacgacgtgagtcaatcaagttaatagcccaagaggggccaagacatgcccacgtgagcagagaaaccaaaatccactgatcattgactacacacaaatgtaataattgatatggaaagacactctaaacagagtaaacatatggaaaagtgctagcattcctgacatctgaagaaatctcctgaatttatttatttatttatttagatggagtcttgctctgttgcccacgctggagtgcagtggtgtgatctcagctcactgcaacctccacctcccgggttcaagtgattttcctgcctcggcctgccaagtagctaggaccacaggtgtgtgccaccatgcccagctaattttttaattttaataaagacggggtttcaccatgatggccaggctgattttgaactcctgacctgggtgatccacctgcctcggcctcccaaaatgttgggattacaggcgtgagccactgtgcctggcccaaatttatttatttattttttaagacaaatatccaataggaaatttagggtggggggatggcaggtcaaaagaagtaattcacagaaggataaatacaaacagccaggtttaccgggaaatcacactcagtgtcaggggagcagctagccagcaaatggcccaacagctagcagcacaaccacgtccctgaacacctgccggatgccagccctgcaggtactgctgcaaagaggtgcccagataggataggtagaaacaagtgacacacacaagtcagagggcagcatgtgtgacagggtctcatcactacagcattctacacacacatgtacattccgaacacatcagcaggaagactgggcatcagagttacaagacaggtgtgagctagcacgacgcaccctgaatttcagatccatgaataagccctttcctacttataatcagtggtactgaggcagaatggggcgcacctaggaatacacactttagtacaaaacctgggcttgagaccctactgtaacttattgactatgtgacattgaattacattccaagcctcttcccacataagtcttggtgacttacgtgaggactgggacactaatagtatctacctcccaatgttattctgagcatttaaggaggccctgcatgtaaacacagttagcacgcactaagtttgggcaggaagagatttttcacagttgggtaaggcttccagcagatgcgacttggttgataggaatctcagccgtgtagctgaaacgtagcttctataatacatcgaagcgaagcacttagaggcatatggcttctgtgaatgtgctgcagcgctgagcagtatcttcttcatcagttccactaaagactggaaactcattataatcctggcaagactgaggtttagccaagaatgttctaataccacagaagctctgtatgccacatcactgatgccgccacagtgagacagaattcgaagtacagccagatgcttttagtaaggttctctttggcctgaccttttttccactccattcgccttgctttctgtgggaataattctctcaacttaaaattaccaaatagcattaaaaattctgcaatatttctgaaatcatattgacacataatggaggatttttcagaataaaattagatgactcttgtaattgttttattaaggaactgcaaacttgtttccattcttcctgaaattaagtattcatttccactgtaaggcaagaaaaaccagctaacattatacagtcaaagggtgacacctattaaacctgatcgaggtttttggaatttatttaaaatacagaactaaattacagtttgttggttctggaaaatgactttcagaattgctttatctctgtacaaccagactcagcctctccttcacagtgcaggcctcctaatcactgcctgtttaccatgaagcatgttttccagtattggctcagccagtttttcttccttcctttatcaaaatccaatggaaaagagccagccccatggctcaatgtgaaaggccaggagttcacatgcacaatcttaaatttggaactaaatgtatttctcttcagaccatgaaacaatggagaggaacaggagagtttggaatgtacatggtttaagcagtctcggaggaagtcatcgtcctgtctcacaaaatcattcctgggtcagccccacctcttcttccacctagagcaggctttcctgacctcagcatcattgaaagttgggcaagataaccctttgctgtggggctgactcgtgctttgtaagatgctcaacagcagccctggcatcaacacaccggatgccaggagcaccacccttcattggtgacaaataaaatgtctccagacattgccaaaggtccccattgggaaaaaactaccccggatgaaagccactaacttacagctatttaagggtattattatatctagattcttgcctcatgtcatattatcaaaaaagaaaacagagttacagagaatatttactaaattttacattatcataattatattcataaaaattacataattggccttaaaaacattattgttttcataggaaaaaaaatttcaattcaactcgccaaagaagggtttgtattaaaatttccttggaggccgggcacagtggctcacgcctgtgatccctgcactttgggagaccgaggtgggcggatcacctgaggtcaggagtttgagaccagcctgatgaatatggtgaaaccctgtctctactaaaaatacaaaattagccaggcatggtggcgaatgcctgtaatcccagctacttgggaggctgaggcaggagaatcgcttgaactggagaggtggaggttgcagtgagccaagatcacaccattgcactccagcctgggcaaaaagagctaaactctatctcaaaaaataaaaataaataaataaaatttccttggacagatgatatctgggatgtgaaagcatgcgtgccagtcacagtaaagattatatactctttcattatgcttcatagaaccatggctgtggtaagtttggagaacaaagtacagataagtcaagacctgttggttcaagtaaagacttacctacaatatccccctttcagttagcaagtcagggccaaaatcttggctaatatttactgtccatatgtgatcagcactgttcaagttttatctcttgtaattttcacaaccttttgaagaagttgagagactggggaacttgcccaggaaacaagacaactagaggtagaactgggttttgaacacaacattctttctccagggcctgtgctcttgattccagcctgttccatggaaaatgttcaccaaaggctaactcagcgggtgtccttgagcaccactgagccattcaagggcaaatcaatctatgctcagaaacaaatggaaatgaagactggaaaacaagaaaatcagatatggtgagaaactgggggaggagagaaaagtctgtgccttctgccagtctcagtgcaaaatcagtatggcataaaatagcacaaatggacaagaagcaagtgagagagtacagtgctctctcaggaaagcattccactgtatttatggaaaaataaactctctcaattaagccaaattttcaagataaaaggatagttccatccatctataatttagtaagggatacaacaataaatgttctgaaatttattctttaatttcctgaattaaaatctctctccatatggactaggagttgcaaaaacatatacatatatatgcaattatatatataattccagaaaaccagattagagttgaacagtgacacctatgtaaaaaccaatgtgtgtgatggagtcatcctatttcgtgcattttagcattttcctaggatactgttctatataaattctgtaatagagttatatataatataattactgtagctattagtgatttgaaaggccactttcttggaaaatttcaacttagtgttgtcaccggcattcctggtcattttctttgtgcatcctgtacacgtgtgcaggtgtactggactctgtggtcatgggaacctccgagtcttcagacacccgctggaagaccagccatcatcactcaagtctgcagccagctgcccaatacagaatggagtgagatggcaccttccttactgtcatacgtgtaaagtcttgcagtaggagaggatctgagagggagcagcaattccaggggaaactgttcattgataataacatctgaatgacatttgacagtttcctaagcactgtcacgtgaatgttgtttctgaactatcaccacaaccttgatactccttttaagtaggtaccatcaacatcatatgacagagaggtagctgagggtaagggtaaatgactagttcaagtttatatggcaagcaatcaactgcagatgcaaatccatgtctgtttttatttttttgttgttcttgttgttttttttttgtttgtttgtttgtttgtttttttgagccagagtctcactctgtcatcaggctgaagtgcagtggcacaatgttggctaactgcaacctccacctcctgcgttcaagcgatcctcctgcctcagcctccctagtagctgggattacaagtgtgcgccaccacgctcagctaatttctgtatttttagtagagacgaggtttcaccatgttggccaagatggtctcaatctcctgaccttgtgatccacccgcctcggcctcccaaaatgctgggattacaggcgtgagtcaccgcgcccagcccatgtcttctcttgattttgtttgctttctgttccaccatgccatgtttctgacagtatcgctagacaccactccagaccaccagcaaagaaagcagagggcttgcgctcagggggcaggtcctgaggagtctcctgaagtcctcccgtgcaggtcaaggctttcattaactacgcggatcaatttaaccatctctcttgtagaggagtactttaaaacctagtcaatgagtgctaatcacagaaatcatttcagattaatcttagaaataatcattaaataaatgtaataccctttaaaaaggggcataaaaacagattcaagttaagaaagtctagttgacaacaaaatgcaattccacatcccagaagcttactgaattgcattaagcttaggatgctaatattggatgtcatgtctctatatggttaaaatgcacaaagagataaagacgcttgcatttattttaaaaacttattataatacttgggtaatttatcagtgacgttgtttatttgtactgtggttaaatttttagcgcaataattgtatttcttaaaagacacgctaaattgttcctctcttcttatgcctgggaaaccatatgaagattcagtaggaaactaaattttgaagtttattccctaacttttctttaagatacattttgactatttgaatgttttatgttgttgctatttttaagggaatcatttatatcagatataatgagagaaatttaaagtaatttctacatcaaatcaatattatggtatttgtaaaaaataataataataattaaaactctgttttttctttgcagttgttttcattgtaatatgatacctgaattttatgtaagaatgtgagagtgggccaggtgcagtggctcacacctgtaatctcagcaatttgggaggccaagacaggtggatcacctgaggtcaggagtttcagaccagcctggccaacatggcaaaaccccatctctactaaaaatacaaaaaattagctgggcgtggtggtgggtatctgtaatcccagctacttgggaggctgaggcagaagaattgcttgcacccaggaggtggaggttgcagtgagctgagatcatgccattgacctctgaactgggcaacaagagtgaaactccatctcaaaaaaaaaaaaatgagagagaaaaaagaaaagaatgtgagagtggttagtttataatatagttaacatagttgaatctgactgttttttgctttcaaaacatgtattattccactaagtggtatcagttccctttgcattacagcagtcactggaataagttaaatattgttatttttgttatttcttgtccaaaaaatacacactgtacactttctcttctaatactgtcctaaacaacttttcgcaggattcactggttattctcctgcctgttgcccaagggctgtagaagatacagagagaagtaccacccagatcccgtttcaaataagtatttgctgctcagatgtgaggcgtgtggccagggatggcctctgctgtcagcatcggcacctgtccctggcagccgcaccgagaggctgagcgagctggggatctagcggttttccctttgcaggcctcggttccgacggataagataaactcacaccaacttctgcctcaatttctgcctctggagaagtccgcccataacagtctcctgccacagcctctgcagcagccacatataagaggttaaactctactaacatttccaaagcaatccttttagagaagtcttatctttcccaaatacttttctgtcaccaatgcccaatttcttccaaaactacttcttatacaattacgtgtccacactattcctcccattaatattaaaatatatttgcttgtagcaacatggtccctcctaactcaaaatatttcctctgaggtgatactcagggttagatactcccaaatgaataaatgcctcgtttctaaaaataactatttatgacatatatttcccgagaacaggattattaataatcataagtgatttagatttgtgtacagatctaaaattttcaaagtgtgttcacagaaattaacttatttgatcctaccaccacctcaggaattaaccaaatttaggaaattaaagtcacagtgattgatctgcccccagtcagacaatgaaatcggtggtgggttcaggagggaaagctgttcttatgacctccatcctggagtcatctgctttctgtgttacaacctgcacacctacagaccttctgcaaagtagaatgtgctccctgggggattggggtatatgatcctaaactccagggcttcagaatctgtaacttggatgttgccatttgaagctgaaatggaaagggagggctgtgctaacttggctccccgctttggtgccaccacactggaaaaaaaacatggttccaagtgcttactgcatggactcacttcatccttacaataactgcaagaacaagaagatgctcttattatctagaaggacagaggcaaaagatggcagagccaggttctgtacacacagtctggcttcaaaggcagggctctgaaccactgtgcttcatgtgtatcttgggaattggaaagacggctggagacaaacgcaaaagacatccaaatcttagcagtgagtaaagaatgaaaatgaaagggaaggcagaagcagaaacttctttagctgttggggataaatcacgcgataagaatttaagaattcaggggatgatttaagatcacctacatagtcacacatgtctataaataactcttggattaatggtctatgtatacttccatatttataagaataatgcaaatcagaagagccttcaccagacgaggccatttgaaagagatgggttttaagcaaactgggaaggtgatgtggagtgacgattagttactattagcaaaagggtcagtgctgcaatgatgtaggactgcagcttgctggggacagaaagtcaatctgtcttgctttgttagaacaagaaatgaaagtcagtctgtggatttaagaacagcaataccaactcctcacctacatggtagacagcttgcttttccaattgcagtttaggaacaaagggaaggagaattcactttgtcacagaattttcactaatgaatatagacaccaatgcaggaatatgtgttatatttgtgtgtaaccctaatcactattacctatgctacctctcctgaaccccagtggctgtggcactgtaaaatgggtataaataacattcaaaatgttaagataaacatacatgcaaaatatctaacaaatggtaagaacaacttgttagcaatagttggaccttctccagccttgtggaatatatactgatgtcacattatcctgacgtacacatgtgtctggactgagcgcacaagaaaacagtcctgtgcagtctggaacaccacaaagtcacttttgttccggctcagagaaggaatctaatgtggagacctgcaatgatagcaacaggtgttcaagtttgactttgtggtcacggtctggtcatttccagggtaatatgcaaggaggaggtacttcagcagaaacggaagctacgtgggatggcttggggttaggcaggtaatgtacgtatctagccggttgggtgtaaaagaaaagggagtgggaaaactggtgcatgctctgctcaaacacatagcaaatgattctatgtatttcttcaaagttctgtcttggccaagtattataaaagaatcttggggaaaacttagcctaaagaaataaagtttgggtccctgttctaccacgatacagtgaaaatgaacaagaggtgttcacaccttctgccttgcttgaactagcccggttccgtcacaccttcacctgctagagagtgtccccgtcgacggctttccctgccatcgacagaaatgcatcaggcttgatcagaaacgcaaggttttatctcagcttgaagcacctggaatagtttcttgagccacggatgaactcagtaaatatctgttgaatgaacagactaatctccttttaccttatctttgatggtagaagaggtattaaagatctcaaatgcctgcatgagactgcgttgcctgtgatactgatataatagaatgctggtatatctgtgtagcccagtgcctctcagtgttgtgaaaatccacatcgagatctagaaactcttgaaattccacttccggtgcacagaagatacagcacatgaggtcatgtttcctgtgatgcagaatgtgtcaaattcacaaggaacagaatgaacacaccacggcccttgctgcgataaatgaatttgcactccgggtgtctgaaactattgcttattttgtcacaaatagctctacaggctttgaaagctacaaaggacaactttgcaaatacttaattctaaatgtcatgagaaaatagagctacataaaggatgtttatagagggcaaggtagatcatattagtgctaatcactaaaaagtgtcccagcagtttaaaatttctatctgaagatatgaactggcacaaacattatttgcaatgaaaagtaacttcttcccctcacctagtttatagcaaattgctaattataaggataaaattgccattagaaataaatgcacaagtaatgcaatagttttctttaaaaaaaaaagttatttaaacactgtgggtatttctttcagatgaaaatggaccttaaacacaaagcttaactgttaacaaagttctagcaagggtctcttagatgcttcaggaatgtagcaccttttttttttttttttttgagacggagtctcgctctgtcatccaggctggcagtggcacaatctcggctcactgcaacctccacctcccaggttcaagtgattctcctaactcagcctcctgagtagctgggattacaggtgcacaccaccatgcctggctaatttttgtatttttagtagagacgggggtttgccatgtttgtcaggctggtcttgaactcctgacctcgtgatccacctgcttcggcctcccaaagtgctgggattacaggcatgagccacctcacccggccgctccatctttcttaatatccaccaacaggccaggcatggtggctcacacctgtaatcccagcaatttgggaggctgaggccggtggatcacctgaggtcaggagttcgagacaagactggccaacatggcgaaaccccgtctctactaaaaatataaacttagtgggcatggtggcatatgcctttaatcccagctactcaggaggctgaggcaggagaatcgcttgaacccaggaggcggaagttgcagtgagccaagattgagccattgcaccccagcctgggtgacaagagcgaaattccaaactctgtctcaaaacaaaaacaaacaaacaaacaaacaaaaaacacccaccaacagaaaatgaagtgcttaagatccagacagttacaacacgcaaggttgaccctaacggatacaaaattggtccaggatttgcaatattgccctgctcttcccagcgggggttgctgcgcacctgcggtgacagttaaatgaaaaggtaaggcataagaatttcatgcacaagcacctgtgacatctctaggaagctctgctgacgcagctgctcacatctgaagcccacaggttcaccacgggagaaatgaaggtcactggctgacattaaaactgaatggttcacatttcaaagtaccagtggggataaaatatttcttctatgctttcgtaagtaactgaccccagataatatggcagcataatctatatcctgtgacttggacttcaaaattggacatttccccttatttctaacacctccttaaaaatctccattgatttctgactaattcattgttttatctgagttaaataattaactcaattagtctattaaattcagaagggatttttaaaaggagattgtttcatgtgaaaatagtttgctttctgtttgttgcactgcatgaaacagattttcctttaagtcagcatttatttaaacctctttgatgcaaagtcttgtgctggccacggtagggaggaccagtcacactggcatgtcagtcaatttgggtcttgccctgcaagcagcctgcaattttgcagagcagcagacttggaggcagctctgtatttttctactcttactggtttttaaagacagacacacaggacaacagcgagttcaactttttcttttctctgaatctcactttactgctacattctccttttcacatgcaaatccaccttccggcctcaccagatagccttgcttttcgctgtacagagaaagccaggaccatgcaggttggagggtaaggtgtaatgaaagaatagcaatgcaagccatgtagactttggtttgtagattggtttaaccacttccttgtggtgtgatcagatgtaatttttttaatgtgatagattcaatttcttcatttataagatggaagccctaattattttaaatcaatgtagctaaaaaattacaggtcattaagcactgcatctgaatctcaaagggagcatggtgatcacctgttattgaaggctttatgcaaagattctttctggaagggtttatagcagctctccctcaagactggattagatgagggtgtgtcacacttttcagaaaagaatcactcctggcataaggagatagaatttactcctatggggcctggggcacagtgtgaagtagcctgcttcaagctagaagatatatctttgaagttttctctttcatcttaaaaagttgtaagattttccattcgactctagaacatacccttgtttattataatataaacatatttgggtctactgggagaaatatatagctctgtgtgcacaaacactggtgctacaacacataaaaatcttccaacaatttccatgacagaaagaaaaccacttactgtgaaaggctatgttaaagattccagtttaactttttgtacgtatacctgagtttctcaccatgctcctcagagtctgatgactggataaactatcagatcccatctgatccctaaattttaagaaaatcttaagttgatggaaagtagctattggtaatgtcaaaaatcagactgacaaagaacttacacagtaattctaagtcacaacagaatgccagctatagccagaattaatatgtgaattgacaaaagaagcttaagacataacaaatgcattcaaagggaattgtaactaagatctccattccctatctctctttgttcaatgaatgaatgaaagcataccaaaatccagtcaaattatctttaagtcattctcccccaggaacacctggagaaagtacaaatggactttgagataaatctttgctaatccccaggcccaagtaaatcttttaagtctgcaatccattgtggcattgcttcaataagccgaatgaattttattttaggacaaatttgaaggcaattatgaaaccatttatatcaaacaacaatgacatcaaaaacataagtctttattggaagggttgagggaaataacatggtagaacagatttttaaatttaatgcccaacagggacctgggttttcaaacatgtgtctcgaaggttaatttccgactaagcaaatcgggctatttttcggtctgcttcagctttggaaactaaggaataatgattaaaggtgagataacatacagagattcactagctgccttctatcgatgaaaagagtcaaactctgtaaaatatttaaagagatttattttgagccaaatatgagtgacaatggtccatgacacagccctcaggaggtcctgagaacatacccaaggtggctggggcacagcttggttttatacatgttaaggaggcatgagacatcaatcaaacacatttaagaaatacattagtttggtcgagaaaggtgggacaactcaaagctgggggcttccagcctataggtaaatttaaacacttccctggttgacatttggttgagtttgtctaaagacctgggagggatagaaagggaatgttcaggttaagacaaaagactgtggagaccaaggttcttctgaggtcttataatggctacccttagagacaatagaggacaaatgtctcctattcagatctttaaaaagtgctagatttttagttaatctctttaggattgggagggcctggaagaaaaatatctagctatgttatctagatagaaaaatatctagctagctataaacagatgcaaattttcccccacaaaggacagctttgtagggccatttcaagatacagcaaagaaacatgttttgggctaaaatattttgtttttcttccttgtctcataatgttatcccgaagtcagtttggaaagtagtcacaataaatagggttaaataaaacctatctgatgagaatatacgaattgtagggcatgactccccagactccttagatagaaatttgggtatgataaaaaaaatcagagtttagtcctcaatatcttgataaggatttttctattttgtatgttttcaatttttaccctttaaaaaatttagaaaactggcactgtaaagggagattgaaggagcagaaatatcaatttcgtttgggagacactgacagagggtgagccccaagacacacatgctggctagggaaagaattccggtatccctttggcttacctgtgccatttttatatgacttaggcacccaaaaaagtcctgaaccttctgttgtaacttctattggaaagactaaacaaggcagctattttgccttcaagtgctagacttactgtgcttaatccagttcttgctttttgttcagcttgttatgcttatattcataaacctcaaactatcaactgacaaccctgaagggtgaagagcaagtcactactgttggtaaggagaggagaacacaaggcttgatggccagaagggaacctgcagcttcacaaaaaacctcaggacattctggttcccagatagttcactttttcccttaagaaagagtaaaatattttgtttgtttgtttgtttgttttgagacggagtctcgctttgttgcccaggctagagtgcagtggcacgatcttggctcaccacaacctctgcctcctggattcaagcgattctcctgcctcagcctcccaagtaggtgggactacaggtgcacaccaccactcccagctaatttttgtatttttagtagagatggggtttcactatgttggccaggctggtctcgaactcctgacctcgtgatctgcccacctcagcctcccaaggtgctgggattacaggcgtgagccactgcgcccggcctaagaaagagtaaaatattttatgtcaaatgtaaactcaaaggacacaaatcatgtacctgaattaaactgtaaacctaaaatctggccatgagtcacacatgtctcttatacatcggcctacatgttacaacatatatgtgatttggtaggcgcatcattgcagacttcatctttgatttctgcatttgtcaacagacagaactaaatacaagtatttttgcaactgtctcaatcaatttataagctatgaagaagtcttattcctccctcctgcagtccttagaaccagtcagagccttggagatgacctacttaaaatcctggattttacacggaaaccaaaggccaaagaaattgtggtattctcttaaggtcaaaaagttagctttgtggcattagagcacttgaattattattaaaaaggtaaatgaaagagttatcagtctcttactatatagaagtatatttgtaaagcacaaaaacataaaattcttactttcattagtactgacaaccgaaatgagtgactgaggcagaaggctccgtcatcaaggtctattattccagcttgagagcatgcctgggaaaaacccaagtcacagctacctttgtggctgctttttccctaagaggttctcaggagatttagcatttatgcattttccttaaaagggggaggcaatgagacatacttgtgatgattatatacttgtgagcctttagatagtgcccagtaaacctacattttacataagataaggtgaacatttaaagaaaatcagaatagaggaaacagctgtctcagggagggtgaaggactgatttatcttatcttgcctttattctgtacctgggaagatataagccagtgatggacattatcagtgtggggccttttttttcttttgagacacagtttcactctgtcacccaggctggagtgcagtggtgtgatcacgcctcagtgcaacttccgcctcccgggttcaagcgattatcctgcctcagcctcccgagtagctgggattacaggcgcgcgccaccatgcctggctaattttttttttttttttttttttgtattattagtagagatgggatttccccatgttggccatggctgctctcaaactcctggcctcaagtgatctgcacacctcagcctcccaaagtgctgggattacaggcgtgactcaccatgcccagcctcagtgtagagtcttttcgaaggcctggtttctgtttagcccttagggaaggaagcctagaggtggttagtgagggtggggacatgacaggcctgtctgacctcccaccccatcatggctggaactcagcttccaaggtgtctccacggtccccttgacaaggagggattctgttcagtcagttggaggcttacaattttatttttatttctcagtataaggagtacgcagaaactatatttacagataaattaatactatcctccgattttcatctattatgtggttaattatgtctaatttgattaatgatgtatgattaatacatatatatacacataagtaaaacaattataagaataaaaaatagatttaaaacacccttttatttttaagtctgtaattatgaatttgatttatctccaggaaaatataatattttaaaataaagaccaaagcaacatatttaaacataaattcaaaagacagtaaactgtatatttataaaggacaccgtgatattatgaatagtgaatgagaaagcaattgctgaaaccagatctgttttgtagactttttgtatagctttcatatggagaaagtttcacattgttctctcacaataaaaatgcaaataagccagtgagaaattcttgtattcataaataacaaaataataaaaaatctcctttatcaaataggcaaagacaaaaattatgctgaaagagaggcaggagggagccctctcaaacatgggaagccagatcagaactagagcagtgtttctggaaaggaaggtgacaatatggatcaagaacctcaaaaatgtccattaccgtggacctgcaatcactgttatgaccgtattcttagagccaaggcatgcagtcaatgatgtctgtaaaataatatggttttcagtcttatttgttttttttttttttttttaactgtgagtaaatgctcaaaagtggggaaatggttaaatagaactgagacagccaaggtacccaagggggtacccggagaaagtgaccagcctgtgcactgggagaaagggatggagccttgggaagttcatgctgtttggggtggggaggagcctggcctctcctgatctgggtagtacctgggatttcagctggtgaggtgggaaaacctgcctggtttctgtttagcccttaggaaaggaaacctagaggtggttagtgagggcgttggcataacaggcctgtctgacctctcaccccatcatggctggaactcagcttccaaggtgtctccacggtccccctgaccaggagggagtctgttcagtcagttggaggcttaatattttacttttattttccagtatgataaggagttcacagaaactatatttacagataaattaatactatactctgattttcatctattattttaatccatattcattttgccttatagattttcatctatattcatcttgctttgctgagagtccctgttaccctttttcttttcctttttgcccaataaattccatttttctcacccttcaaagagtctgcgggcctaatttttcatggttgtgtgacaaggactctgtttttagctgaactaaggagaaagtcctacaacagcatatccccacataacggaattttaggtacctatttttaaaaaactgttttcatggcagagaaaatttattatgattttcattttttatttttttgagacagggtctcactttgtcacccaggctggagtgcagtggcacaaacagctcaatgcagccttgacctcccaggctcaagccgttctcctgcctcagcctcccaggtagctgggactacaggtgcatgccatcatgcctggctaatttttatattttttgtagggacagggtcttgccatgttgcccaggctggtcttgaactcctgagctcaagcaatctgcctgcctggcctcccaaagttctgggattacaggcatgagctgccacgtgcatgcctggcacagagaaaatttatcataatgtcctgctaaatggaaaaagcatgatacgaaactatatatatatatatatatatacatacacacacaatataattatacagcacacacacactgcaaataggcataatcaagatattgcaaaaaaattaaccagaaattttactaagcatgagggtaaaaataacttctaacactttttttttttcttgagacggagtttcactattgtcaccctggctggagcgcagtggtacaatcttggctcactgcaacctccacctcccggattcgagtgattcttttgcctcagcctcccgagtagctgggactacaggcatgtgccactacgcctggctaatttttctatttttagtagaaacagggtttcaccatgttggccaggctggtctcgaacttctgacctcaggtgatccacctgcctcggcctcccaaagtggtgggattacaggcgtgagccaccgtgtctggccacttctaatgctttttatagtttattgtgaattatttctaaatttaaaaagaaagcattatcaggaaaaaccccacaatgatcaccaaactgcacggagtgtccgtgcaggcgctcataatgtccttacacgtggatccctcgaagtcagaagaaagagttcttctctctttcttacatatggggcacttggctgccttacacgagaagggaccttattcaatcaagtggttggttatatacacacacccttaagatgcatctggatatagtcgcttctatttataaattctcccaaaggcaatcatatgaacaaaattaatgtgacaatattatttttccagcaattatcaccctgtgtatctgggaagtaagtggctcattctcttcgaaagatgttgccagttattaatacgaaagtgacagcataacagcaggaaacggggagggcaacgctcttagtaagataataccatcatcaccacatattttaatgtcatgtttaccaaccttaatggaaagtttaaaatactggctgatgagctgttttctgacttacagaagagtattttgaatttttcctttgaaaaactgaacagtgacttaaattacctgctgctatcagcgcagtcaagccctcgcttttagcacttttcaatccctttcccgaaacaccagaatccccatcttagctgttcttcttgcatgttgaaagcgttagccatacacagtcattcaccttgccaagagaggctgaagcgctatattttaaaggcaatgttgtggtgcttcctgccacagcagtgactaaacatgcagcaaagagaaaatcacgtctcatttttattccttcttggaaacaggtttgttcaacagatgctgttaaggtttttgggcttctattaatcaacattttaattttaatttattagagaatagaaatagcctgataggagtgtgaatatttgcttatcacgaaatcacagagtttaaagcaactttaaaagaccatctaatacagttccaaaagccagagagagacaacacttaaaatgattagggtatatgactatttttgcttaaaagtctgaaacaatagattctttgactttattcattaattcattttggcatttcattaaaaagttctttctgggctgggtgcggcagctcacgcctgtaatcccagcacttggtggggctaaggcgggcggatcacctgaggtcaggagttcgagaccagcctgaccaatatgaagaaacccccgtctctactaaaaatacaaaataagcctggtgtggtggcgcatgcctgtaatcccagctactcgggaggctgaggcaggagaatcccttgaacctgggaggcggaggttgcagtgagccgagatcccgccattgcactccagcctgagcaacaagagcgaaactccttctcaaaaaaaaaaaaaaaaaagagttcttcctgatatgagggctaagttctcactattgcaatttgagcttcttagccaacttcaaagaacatgtaacgaagctaatttcttttctctgtccattcggaaagtgtagagtaaggaattgtactctgaattgcctactctgcagagcaaacagactcagtttcttccactttgtccttggctcctacaccgcaattcgtattgagtcgttttccctttttttactaacaggccatctccacatttgcttgcttttcttgtgttcactgggattagaaataacaaggtcccaaactagctacttgctttcattttgagtgcatgaatgtgtgcgaagcctcagcataaatataggcaaatatggagaactgaaatgtatggaaaagacattttaaaaataaaatgtatgggctacatgttgtggtgttcataaattttttttccattcctggccgggtgcagtggctcacgcctgtaatcccagcactttgggaggctgaggtgggcagatcacctgaggtcaggagttcaagaccagcctggccaacatggggaaaccctgtctctactacaaatacaaaaaattagctgggtgtggtggcacatgcctaatgttaacattttaaatgttagcaccatattttaattttattttggaacttaatggatgagtttacattttatactcaaatatgtgagcttatattttaatatcaactaagattacatacactattttagatatgccatctcccatcttaggaccctatttacctacttaaactaagtcactggcattttaaattgtttcctcacattaaaatatacccaaattgggcagacgcatcaaaataaagcagacactccccaggaaagagagttcactgaggaaggctcgtgtggcagaacaatattgggaaagtaaggaggggggagtgatgctatttttagatccttacctcacgtccgtggagggaagtgacactatttttagatccttacctgacgtctgtgcacgtaatgcaagtgatgttccgactatttgttgcgatcaggtgcaaagctactgatgtttccttgtcagaggtggggtgtgctccacatttaaagaaaaattcctgaaagaaagataaatatgatcacacacatggatcccggctgctcatttttcctctaaatgtttccacagtaaacaatctctttggacaagagaagaaatctgttacgaggtgtgagatggaaataaatcagcatcaaacctttcccaggaacggatgaccttgtgccaaagtggtcaacaattctgttttagaagggccctgagtctctgctattcttttgctctttaagcgagggagctggagaaatacgctgtgaccttctttaagccatgcccctcgatgataataagtgagtctagaagaatcacacgatgtggaggtgggaggaagcctctcactaatgaggaaagggagacgtgaagccatgaaatgaggtgcccacgggtcaaacagtaagaggtgaagccaagaagtaacccaagctccccgcagggaaatccagtgctttttctccagtatcactacatggttagtcatttagcggagtcaggaattgagagagccctactgtaaatagccacacaagtacacatggactcctggtagacacagaagtgcagcagaggcccggcgcgttggctcgcgcctgtaatcccagcactttgggaggttgaggcgggcggatcacctggggtcaggagttcgagaccagcctggccaatgtggcgaaaccccatctctactaaaaatacaaaaattagccgggcatgacggcacatgactgtaatcctagctactcgagaggctgaggcaggaaatcgcttgagcccggctgaggcaggagaatcacttgaggttgcaatgagctgagatcaccccactaaattccagccgagagtttagcagagcatggctctcccagccccatctggagtctgccccttttctgcctggcatcaacaccccagcattcctgcgaagactctgccgcccaccctctgtgccaggcaactggaatgctccaatccagtatcttgctgcttcttagttcctttccccagccaggtcctgccacatactccctcattttagcttttcacataggtcacgttcttttgattgataatattctcccttctcaaccacgttttttcttcacttttttctgttctaacttctgtatttgttctcactctccttctgttcactcacacaccaaggcgtttggccagcaattgctttacttcttgtcccacagtctgcatgccttccatgatactaacatctgtgaagctaaattttttgctactgaaaaaaaaaatacatatattttactggatgacagaataacccctgcataccacacatactcctaattccacttgcgtttaactacctgaaatgtgggaaggattttcccttaaaacacttgatctggtattgacaaactttgatgtaaagtgccagatattacgcattaagtgcttttggttttgtagggtatatggtctttgtcacacttctcaacttggccttgtagctaaaaacagccataagcagtatgcaaatgaatgggtgtggctgtgtcctaacaaaaccttatttacaaaatatgtggcaagttggatttttccctgcaggccatgatgagacatttgtagaatgctttattcatatttgtattctaacagtgactgacattaggataggcatgacatatacttcttttttttttttttttttttttgagacggagtctctgccttccaggctggagtgcagtggcgcgatctcagctcactgcaaactctgcctcctgggctcacgccattctcctgcctcagcctcccgagtagctgggactacaggtgcccgccaccacgcctggccaatttttcgtattagtagagacggggtttcaccattttagtcaggatggtcctgatctcctgacctcgtgatctgcctgccttggcctcccaaagtgctgggattacaggtgtgagcctgtaatatgcccagcctgacatatacttcttaagtgaaaaacaatagattaatcaacgctatttaatcaatgttatttatcatttatttaataaatgctatatgttatccccttatacgtttgacagcaacatttgatttcttcttttcctgtttataatttactaacctcatcctcctctgacatgtgacaccatgagcaacagcccttggtctgaagctgtagtgtgcatcagaatcactcgggtgggagggggcacggacttgctaaaccagagatcgctgaacccaccctgggatttttgtgatttctgggatggcatcaagattcgcatttctaacaacttgccaggtgatgttgttcctaccgctcaggggcccacacttgggaaacctgagctccaccaatgtcagaggcaaagtgagtaaactctagttactctctcgcaagaccgctgctgtggcaggtcgcttaccgtgtctgaaaataatgctacatcttacgtaaaatatgtgactctcaaaaatctggagtgtgccattttactttttttttgagacagagtctcactctatcgcctaggctggaatgcattagtgcagtcttggctcactgcaacctccgcctcccaggttcaagtgattctccctccttggcttcccgagtagctgggattacaggcacccgccatcatgccaggctaatttttgtatttttgtagagatggggtttcaccgtgttggccaggctagtcttgaactcctgacctcaagtgatccacctgcctcggcctcccaaagtgctgggattacaggtgtgagccactgtgcctggctgagtgtgccattttgatgagagtatcccaaagccagggatttggaacccaggctattcttcactacaagtctcaccaatcccaggtggtataatttagttaactaaacctatcctatctggggcagtggaatatcagccggtcctcacacctgcagtcctcagcccatggaggcatgtgtgtggagtcttgctggagtggacaggatgtccagtgtgtgtgatgggcccaggctcaggcatgcctgtggagtcctgcccatgagtccaggaccttccccacagcagcatggaaatcatgctggctgatgtttttgtttggttatgttttgttttcctgaacataggatcccattccttttactcaatcttttgaaatgtgacaaatccttcaatggccagctcaagggtattgagaaagagatttaaaacaatgtctgaacaccaaaacgaaaagtctgaaggacatgactgacccttatgaaatacgctgagctagctacgactggtttttgcagacatgaaaaaaatcctctttcaaaacataaagtaattcctccaaaacagctgagttggcaggactattgaaaaagtatttcatatacagataaatagatagaaagcacttacgttttttcttagcttacagaaagctgcagtggacattcagctaacaaatcacaaattgttctaacaccagataaaattcagccagataaaagcctttttattgggggtaggtgtttatagataatggtttaagaaattacagatagttgaaaaattctagtaacacatatagtgttgataaaactaaaactcacattgccaaccctatattaaatatgtatgcctcaacagtaaatttcagtgctttctccaccaatttttatgaaagaatgtttttgttgtagtactagaataactggcaagaactgtgaagaatgtgggattttacccagcttgcaagttagcaagttagtttgctgcagtatcataaaagctgacagaagacaagagactcctggatcagagacaaaggactgcagaactcagagcacagggagaaagaagcatgagcatcatattacaccagttcccctccacacgtctctctcagggttgaagtagataggctaagtcagattctacaggtgcagtggttttgcatcacaaatgagaactctgaacttaggaaactcaaatcttctttaagtagttctaagcaagtcatcttttcatcctgaagggaaacattgtctttattatactgcataataagcaaatctgccttttgatctggagagaaacattatcttctctactttctgtttttttggtttttttttttttttttttttttaagacagagtcttttctgtcgcccaggctggagcgcagtggcacgatcttggctcattgcaagctccacctcccgggttcacgccattctcctgcctcagcctcccaagtagctgggaccacaaggcgcccgccaccacgcccggctacttttttgtatttttagtagagacggggtttcaccatgttagccaggatggtctcaatctcctgacctcgtgatctgcccaccttggcctcccaaagtgttgggattgtacaggtgtgagccaccacgcccggccctatcttctctactttcaaggtcatttgctctaaaacttccttgaaaagatgggtcagaacaagttggtgtctccctcagagatgagcggacaaatgacagacccatggagaattgcttctcaataataacaccttttcttgcaggctaatttgcagttattttattgtattttattttattgtattttattttattttattttattttatttttttgagatgggagttttgctctttttgcccaagttgtagtgcaatggtgcgatcttggctcactgcaacctctgcctcccaggttcaagtaattctcctgcctcagcctcccgaatagctgggattacaggcatgtgccaccatgcccaaccaattttttatatttttagtagagatggggtttcaccatgttaatcagctgatgtcaaactccagacctcaggtgatccaccggcctcggcctcccaaagtgctgggattacaggtgtgagccactgtgcccggccgatctggtcatttctgctcctgtacaatcagtgggctggattgttgaagtcttttctgacacttccaatctgtattcaaaaccagcagacaataaaggaacacacaatagaagtgagaagggcctttttcgaaaattccaccttgggtgtctgagatggcttgttcacacatgggtgtcatctcacagacagtggcatgattctttgggattaactgcctctgaattctgttttgtttctcttaattactcagtttaaaaaattaaaaaagtcaaagacaggaaagctttctagctggagtccaagaaggctggtcagaaggctggcaccactgcaccactgtgaggtcactggggcatagcagggcccaagccaagtggccaagaaacatctccagctgtgctgagcgacagtggttatgcctgaggcaaggctgctcaaggtggcattgtttgagttctagcgtgtgcaggggttggccggggaagttgcttctcggtcactagggaagcagagtattctgggggagcagccgggcagtgtcctcttcatcaggaagcccagctgtcaattctagtgtggctggaacagaatcctttacggcgggtaaactgagtctcagagcggcccaccccacctcttacaaatggtagttcacagataaatcagctacagaaagattcccccacctaaccaggagctataattcccaggggcttactcacatcatttgtataccaatagtcacttctgggaaaccttaattagcgaagagagctaaaatctataacagcaaatggccagttttttgtttttgtttttccaaatgatagcctaaatgattttatacttgaaaaaaataaggctttagaaaatgtgcttggctttatattgtgacactgttaaatgccataagcgttttcaactttatttatttttttgagacacggtctccccctgtaacccaggctggaatgcagtggcacgatcttggcttactgcaacctacgcctcccagtttcaagcaaatctcatgtctcagcctcctgaatagctgggatcataggtgtgtgccaccatgcctggctaattttttgtatttttagtagagatgaagttttaccatgttggccaggctggtctcgagttcctgacctcaagtgatccacccacctcagcctttcaaagtgctgggaaaacaggcaagagccactgcgcccggaccgttttccacttcattagtattaaatggaaaacccaacaaagttgtattcctcaagttcttagaaaggctactcatgcttttaccatttctctggacaaggctgtgatcccttccttccattcttctctttcatcataactcacttgccctctcctcctcactgtcgaagcctgaccctccaaatcacatcagacccatacaaatcaaagggggaccaggggagaagagcaggaagatgtcaactggactgtggtattcctggaagccactcctgctcacttatgtcccttcacccatgactcataagcagtgccactcacaaagaggaaaactagagcaagaagaatggaataaatagcccagcaaaatctgaaaattagattgacaccaagaatccaactgtataaacacatttacgatcagaagcgaattagccaaacccaaatacaatttgatagatttcaaattactataaaggtagatgacaactggcttgaaagccctgcttatcacagtcctaatatggtcaaatctgaaaaaatcattagcagtaagacctgacttagttacccatgatccttccaatagcttttattgaacatcctaaattttatgtttatagatattgtttaacaattatgttttccaaacgaaatattgtatctatcttcacaaagagttaaattccattcttgtctccaaatccttcttagttaatatttcccaaaagaaaaaaaaactatccttctcttgataaagtaatggggacacacactttccactaacaaggttgcaaagggtatagggtttgtacttaacacgtaactgcatagctatttgcatggctcagggtatagttaggaaaacagggcccacaccaggtagttcaactgacggaattgaatgagattagttatagaggagtggaagcacagaagaactaaacagagaaaggaagccacttgagattagcgtcattattgcacagctgccatctggggctagaggacaatgggagaaggtattggagtcaccacagctctgcagctgggctatctggttgggagtctgacaatgaatgggatgaagccactgccagagatgtcccctagagagagagggagaaatgcccctggcttctgccttctcttggccctcccatctccagaaacagccccaacttacagagcagagagggggaaaaggtggcttgggtctgaaagccaccagcagatgactgctgcaccaccacgaggtggaccctgtgtgagatcaaaattctccaagtgtcaccctttgttagtggtgacacattctaatcagcctccactaaaaacaaaaatacacattcagatattgttgtgaaatatgtattgaagatacagaaatactcacacaaatatacattgtatattgagattaaactcaactatactcgtcaaaagactatccatccaaattttccgatgatattaacaggatacagggctgtggttactgcttatgagatgaactcgtaataagtatcttacatctatatcagaaagattctcacagttaccaagttaagacagacagcctgtcacttcaaatcaatctaaatgcctctcacaaacctaaaatcctgtttgtagctaacagcaacagatattccccagttactctctcctcagaaactgtccaggctagaatagttcctcgttagtgagatacagattcttttctaagacacaactactagttttaagtcttcctatccatgcagaggtttcattattaatcttaataataaagttttaattttctttaagttaaaacatgtcagctgggtagggtggaacacacccattgtcccagctatttgggaggctgaggcaggaggatcgcttgagcccaggaatttgagaccagcaagggcaacatagcaagaccctgtctttaaaaacaaacagaaactccacaaaaacaaaccaaaaaatgccagataaagcataaccacaacattctctacctaatacataaaaaaagcctttaaaatagccatggcaaagcctgtttatcttgtgacttctttattgtgtcttagccttcatactgaagtgttcgacttactgggtattacataaacccagtaactgaatttatcagttctgatacaaagtaactatgcaaactggaggactatataataaatgtacactttgttaaattaacaatgccagttttacaattaagttacacctagtcaaacagatcagacctaaaaagttaatgagtctatcaccatgttcaattacaagtttgttttctctcaagatgtcaataaagcctctagatgatgtgcaaagtttatcaggagaaagaaaatcaatatactccacacaaagcaaaaccatgtcacaactttgctgagaaggaggctgtcagtttatggtacatgtcttcaagaagtctaacttaaaacaaaagttggctaatataacaacccacatccgccccttctctgcctgattgtaagttcttcagtgtgccttgaagtttattccaggtgtaatgccactcagccataatttgatgtttataactttaagagcaaaagggagattgttaaagaagatgttaaaagtgattcctgaaaagtaaaataaaaggtttgcccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattactattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctataatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcacggcacatgtatacatatgtaactaacctgcacaatgtgcacatgtaccctaaaacttagagtataataaaaaaaaaaaaaataaaataaaaggtttgcagtcattactgacccttataaaatgcgtgaaaactaggaaaactaatattctctttcccagctcaaggtacttgctccaataagctcagatggctgtacctccttttcccctccccagcccaggggtgaacaggcagctctggcctcagcggtcagagtaaaacaggctcatacatgtgaccacaatgagatacctgtctgagaaccaagccggtgctcagaaggaaaaagtgatgagagaaagacagtctccaagaaagagatcacttgtaccctggatccagctatgcctgatgtttccccagttacttattaatttttatttatttatttattttgagatggagtctcattctgttgcccagactggagtgcagaggcgtgaccttggctcaccgcaacctccgtcccgtgggttcaagcaattctcctgcctcagcctcccgagtagctgggattacaggcgtgtgctaccatgctgggttaatttttgtatttttagtagagatggggttttgccatgttggccaggatggtctcgaactcctgacctcaggtgatccacctgcctctcaaagtgctgggactacaggtgtgagccaccctaatccctggctgtgtttttcattctttaatttagcagtgcccataggcacttccaagactgatttccatattatctgtcagactgcaaaacaaggattttcctttattatctttattatcttggagaaagctttgaccttaggcgttgtcccctagataatctatcactggggaatttttcagagcaaatgcttccactatgtttgttgctatttctttacttgtgcatatgatcttgctgttagcatttcatgaagggtccctgactccaaacgctttagaactatgggacagttgtcaaagttccacgctgcacagcctccctgagagtgagcaggaggaccctgctggccagatgaagcagccctccctgacctctgactcattcctgggcaggaatggccatctcaggggaaactggatcgggattacacacaacacagcaaccatgtttttttctttccttaggttttggactagtggctctggtgtggtaccagcttcccctgcatttctctcccaattccaacaaacgtttggagattgtaacttgtctcacctcaacataatcgcagtgacttatgcgatgtcatctgctcagtttataaatcgagcatatctcttccctttcaattttgtagcctagcccgacaataaaagaacatttattattctagctgttctttctctcctttagaagctaaaggtttcacatgctctcataatatgtcagcttcaagaacataacggcacccaaaacatttgctagttgcatgtttaggccaagctttccagcttttgtgctcagataaataagatgttaaaatatctggttgttaacatggaatatttccttttgtaatctcccaccaccgagtgttcgactccatgatttgacctccaggagaggacatataaacgaacatgtgttagctggtaattatttacgagaaactgaggagacaggtcacaattttgaaaattccttatgactcaccatccctagatgagttactatattcctaacattttctagggagtctctagaagacagtattattttacatttatttctaaatgtgcaaaacacttattctaattaacaatggcaaacaatgtagacgagctatgtaatcatttcactgtctgggttaattatcttccaggccaagcacactggccgagcaaggccttgtagactttctaacctccttgcctcactgcctcccacctcacctgcccacctctcccttggcctgccatggagaccctttgaggaggggctggacttccccccttcactctggccccttgcttgtggtttgagctcagcaggatctgtcttcttcctctgctttgtccactcattttgcctttcaaagccctagatgtctttcggcctcagtgtatctatcttcaaccctggaggccttccttgatcctgtccctgttttagctagtcctcaattatgtccggtgcctaagctctccataagatacatccaccagtgtgtcatgtcagtttaccattgccatggcaacatccaggagttaccagccctttccatggcaatgacccaatgacccagaagttactactcttttcctagaaatctctgcataaactgccccttaatctgcatgtaattacaagtaggtataaacatgactgtagaactgccctgagctgctactctctgcctgcagggtagccctgctctgcagaagcagtcacagagctgtaacaccaccggagctataacactgctgcttcaataaagtggttttcctctactgtcagcttgttcttgaattctttcctaggtgaagctaaaaaccctcttgagctaatccccaatttaggtcttccctccccaacatcactattcttgggaattaagtaattcactctgttctctccctgctctttggttagtctgcagtgtcctttttttttttttttttaagactttgatattccatcttttgagttacaattgggacaactgagagaggggaagagctggagtggggtgagaactaggagggctcaacagctggaggtgtagttcacttagtttttgtactggaagggttcatcactggtttcattgagaagtcaggtgcgacgagagcttctgtcacctacatattcctcctaacatttactgctgctgttgaatccattgtgctgtttatttggaaaatcccccccactccctggaccaagtgagagcggaacagccagacctgagaaatgcagccacagcaacttcacagtgtccagtctaggcagggaaagtgcaagagaaacataccttttgatagcaatacttcacaaaatgataatataactggtttgttggctatgagcaaaaagaaatattgagcaataaaaaaacagcctagctttaaaacattttaaatgactttagacttggaatctaaacttttttcgttcaaaagtccttgtttctttagcaagtagaatttaaagcttctttttattcgtgtcttctttattgcaggcagcacaagccatcataaacattccactcaagataaactgggcaaaggcaagtgcttaacacaatttaatactttctcacattctatatatttactttatttcctcattaggaaaagaagaaaataaaatgtaatttgtaaatttacctataaaccatataccggaaaactaagatgaataaaactggaaaataaatgttacactgagttttttcttttaacatgccagtacaagtgataaccaatggaagaattaaaaactcaaccagccatcctacttatgtaaaatatatatcgatgggcgtagacatgtgtgctttatacatatgatcatccctcagtatccaggagggactggttccagaaaccccctgcagacagcaaaatctgcagatgctcaagtccctgatataacatggtgtagtatttgcatataacctaagcacatcctcctgtgtactctaaatcatctccagatcatgtagaatacctaatacaatgtaaatgctgagtatatagttgttacactgcattactttttaaatttgtttttaaatattgtgttattttttgtttttatttttgaatattttcagccgatgattgaacccaaaaatgcagaagctgtggatatcaagggctgatgttacatagattgactgaaaaatttcggagtccaattaatactgcatctaaaataagttaaataacatcaaaccttttgtgtcataaggacaccattaaagttatttatttgtttatctctcctctattttttgagaaatgtatgctgtgttggagaggcaaagaaggaggatggcaaatagtgcagcatcatccggttgctaagaggcatatgtaaaaacaaagaaacatcccacaaggcaagaagaggaactgttagagtgaacgatgctccctcttagcccaggcttatcattatagaacaattctcaggcgatggcatctatgggcacagtttgtgtgtgagggcaaaagactcctgtacagctcatgcccccaccaggagagaaaagttggtggccccggccttccatcactgttggggaaaagtcaggaagagtcagttcttccaaaggggaaaaaaaattttttttttaatctaaagaaaattcttcagggctgggcatggtggcttatgccagcactttgggaggccgaggcaggcggatcacctgagatcaggaatttgagaccagcctggccaacgtggtgaaaacccgtctctactaaaaatacaaaaaattagctgggtgtagtggggcgcgcatgtaatcacagccactaaggaggctgaggcaggagaatcgcttgagcccaggaggcaggggttgcatgaggcgagatcccgcactgcactccagcctgagcaacacggcgagactccgtctcaaaaaaacaaaataaaataaaataaaataaataaataaaaagaaaaattttcaggaaacataactaggacacaataaagtgtttcaatcaggtttaaacataacttgagaatataagaattttaaaatttaattaaaagctaaaaaagaagagtaaaaacagagaaaacctattaataaaatggaaatcatgagtgaaagctcagagccatgaacacgacagtgaggacatcaatatataaatcataaacacagagaagcggaacccaaaaaaaaattgcagaaaagatcttctgtgggttaaagctacccaatggataataccagtactacagagcattttcattgactgcctgattattataacatgtttggtaagttacttaatcaaatttatggtagctgtctttatcatgtttaatttagctgatttttaaaaaaatatttacaatgagctttatcttttttttatactttaagttttagggtacaagcgcacaacgtgcaggttagttacatatgtatacatgtgccatgttggtgtgctgcacccattaactcatcatttaacattaggtatagcattaggagacatacaatgagctttagtacaaacagcttctaagtttgatcaagtgatttggattcactatggacataatcacacacatctcttttaagctttagatagcatgaattaaattgatggatatgtgaagattatgatatcctgacactttgaaataaacacttactcctttcttactttcatagtgcctggaaatatatatatacaccatccagggcctggggatcaaacagccttacccgttacagctggtgcccatgcacatcagggggcctgaggacaggtctgccttcctgctgctgttcccaccagtgcgtggatataccatcaactgggagcctgggggtcaacctaccatacctgttgccactggcaactgtgtatgattgcagggcctgtcaacaggtctgccctgtccttgatgcctgtgcataccatctggggcttgaggataggtcagttacaccccccaccacctctgctggcacccaagcatgctatatggggacctggggaccaatgtgtcccagccgccacagcctgcacccacacacactattggggacctgaggacaggactgccccacctgatgctaccactgacagtgcctgcatgcttcatctggagacctggggattgatctgccccacatgctgctattaatggctatgagcaccttccagggccctgacgatgggcctgctcagcctgccggtgcccacatactttgactgtgggactggggaacgaccctccctgtctgctaccaccagggctcacacacaactcccagaggactgaggatgggcccactcagccggctgccatcaccactgctggccatctacccatatgcatcacctggaggcctgagcactggcttgcttaccctgccaccaccaccactggtgcctgcatatgctgactaggaaccagagatgtggcttgccactactattgccatgaatgatgccacacaccacccaggagcccaaggaccagcctgccctcccagcccactgccaccactgccagcacataagcagactatctggaggcccaaagtttggcatacccaaaccactggtgccaccactgtgcccgaagaccagcccacttggtgtccctgtccccacaaaagcttcactgcaacctctactaacaagtgctgcccgagccactgaagagatcacagacacaactgatgctgattacagctgaagaaatcattgagacattacactgctgtgcccagctagaatcaaagccaaggtgacctaccaaagcaacattataaatacatctgtagaaaaaagtagtctttttctaaaaaagccaatccataaaattggaagaagcaactgctacatcagaggcactgtaaaaagctcaatgagatatgatagaacacaaataaaagatacgaaatatcagaaaaacaattcatgatctgaatgagaaactaaacaaagagaaagatatttttaaaaatgtctaaacaaaaatcctggatctggagaattcaatgaatgaaataaaaatacaattgagggcttcaaaaaaagatgagatcagggagaggaaaaaagaattctgaacttgaaaagagatcatttgaaataacccagttaaaaaattttaaaaaattattaaaaaataaagtaagcctatgggatatatgggacaccacaaagcaaacaaatggaatttggggtgttccagatggtgaagtgatgatcaaagacatggaaagcctatttaacaaaataatatctgaaaacttctcaagtcttgcaagagacttagacatccagatacaaaaagctccaagaatcccaaataaattcgactcaaaaatgtctttttcaaggaacattagagtcagactgttaaaagttaaagacaaacagaattctaaaaacagtaagagaaaagtgtcatgtcatatataaagctatccccatcagacaaacagcagatttcacagcagaaaccttacaggcaagagagaataggatgatatagagtgctgaatgaaaaaacatgctaggaaagaatattctaccaacaaagctatctttcaaaaagaaaggagaaattaagtctttcccagacacaaacagaaggaattcatcaccactagacaagtcttatgagaaatgctcaaggaaattctacatctggaaggaaaaggacaatatgtaccatcacgaaaacacacaaaagtgcaaaactcaatggtagagcagacacacaaaggagaaatgaaggactcaaatgctactattacagaaaaccaccaaaccacaatgataaacaacaaaagggaaagaaggaacaaagcatatgcgaaacaaccagaaacaactaataaaatgatggaaataagtctttactcattaataataacttcaaatgtaaatggattaatttcccccataaaagataataaatggctaaatgaattttaaaaaatggcccaactggccaggcgtggtggctcatgcctgtaatctcagcactttgggaggccgaggcgggcgggtcacctgaggtcacgagtttgagaccagcctgcccaacacagtgaaagtccatctctactaaacatacaaaaaattagcctggagtggtggtgggtacctgtgatcccagctactcaggaggctgaggcaggagagttgcttgaacccaggaggtggagcttgcagtgagccaagagcacaccactgcactcagcctgggtgatgagagtgaaactccgtctcaaaaaacaaaacaaaacaaagcaacaacaaaaaaatggcccaactatatgatgcctacaagaaaaacacttcacctataaaaacacataaagatgacagtgaaaggatagaaaaagtcattccatacaaataaaaaccaaaagtggacaatagtagctatacttacatcagataaaacagattacaagtcaaaaaatctaaaaagagacaaagaaggctgggcacggtagctcacgcctgtaatcccagcacttgggaggccaaggagggcagaagtcttgaggtcaagagttcgagaccaacctggccaacatggtgaaaccccatctctactaaaaatacaaaaattagttgagtggggtggtggcgcacctgtaatcccagctactaggggggctgaggcatgagaactgcttgaacctgggaagcagaggtttaagtgaactgagatcgagccacagcactccagcctgggcaaaagagtgagattctgtctttaaaaaagagagagagagacaaagaagatcatcatataatgaaacatgtatcaattcagcaaaaggatgtaacaattctaaatatatgtgtacccaatagcagagcacccagatatattttttaaaaaattatagattgaaagggagagatagaccctgatacaacagttgggggcttcaatgcccctatttcagcactggatagatctatgagatagaaaataaagaaacactggatttaaattgcacttatgaccaaatggaattaacagacttctacagaacatattattaagctgcagaatacactttcttctcatcggcacatggaacactctctagaatagatcatatattaggacataaaagaagtctcaagaaatttgttaaaatcaaaatcatatcagatattaatatcttttcagacaacaacagaataaaactagaaatgatagcaagagaaactttgggaactgtacaaatacacggaaatttaacaacatgctcctgaatgaccattaggtcaaggaagaaactaagaagaaaaccaaaaaatttcttgagagaattaaaaatggaaatgtaatatattaaaacccgtgaaatacagcaaaagtactgctaagagaaaagtttatagcaataaacacctacatcaaaaaagtagaaagacttcaaattaacaacctaacaatgtaccttaaagaactagaaaagaaaggacaaaggaaacccaaagttagtagaaggaaagaaataataaagaccagagtggaactaaatgagatagagacaagaaaaatgtaaaaaggattacaacaataacaacttggtttttgaaaaagataaaaatcacaaactactagttagaataaccaagaaaaaagatagaagactcaaataaaaaaagcatacacgaataggagacattaccactagcaccacagaaatacaaagaatcattagagactattataaacaactacatgccaacaaattggaaaatctagaggaaatatataaaccttggacacatacaacctaccaagaatgaagtaggaagaaagaaaacctaagcagacccataatgagtagtgagattaaagcagtaattaaaagtcccccaacaaggaaaggtccaggacaagacggattaactgcagaattctatcaaatttatatagaaaagctaaaagcaattcttaaactatttcaaaaaggtgaagaggaagagattcttcctaatgcattctacgtggccagcattacattgataccaaaaccagataaggatacaagaacaaaagaaaggaataggccaagatcactgtcttagtcgatttgtcttgctatattggaacacctgagactggataatttataaagaacaggggtttatttgacttacggttctgcaagctgtaaaagaagcactgagccagcacctgcttctggtgaagggctcaggctgcttccaaccacagcagaaggcaaaggagaaacagcatgtgcagagatcatgtgacatgacagaaggcaagagagcaggtgaaggtgccaggctcttttttaaacaaccagctttcatgagaactaatacagccccttacctgagacagggcattaatctattcatgaggaactgctcccatgacccaaacacctcccactaggccctacctctaacattggtgatgaaatttcaacataagatttgggtggtcaaatatccaaactatagcaacccgttatgaacatcaatgcaaaaatcctcaacaaaatagcatatcatgatcaagtgagatttttctcagggatgtaagaatggttgaacataaacagatcaataaatgtgatacatcacatcaagataatgaaggacatatagaagcatggtgtgcagaaaaaaaaaaaagaaagtgaaggacaaaacccatataatcatctgaatagatgtagaaaaagctttcgacaaaattcaacattccttcatgataaaacatcaacaaactaggcatagaaggaacatacctaatggggaaaaggtgaacgtctatcctctaaaggactgaaacatgactaggatgcccactctcactactccaattcaacatagtactgaaagtactagccaagtcaatcaggtacaagaaagaaaagtcatccaaactggaaaaaagaaagtcaagttgtccctctttgcagacaacatgatcttatatacagaaaaacctagactccaccaaaaaactcttagaactaataaatacagtaaagttggaggacacaaaatcaacatgcaaaaatcaatagtgtttctctataccaataacaaactaattgaaaaaaaaataaagaaagcaatcccatttacaatagctaccaaaaaatctacttaggaataaatttaaccaaggaggtagaagacctttgcaaggaaaactacaaaacactgatgaaagaaattgaagatgacacaaaccaatggaaagacatgccctgctcattgaccgaattaatattgttaaaatgactgctcaatgcaatccctatcaaaataacaatatcattcttcatagaaatagaaaaaaaaaaaacagtcctaaaatatgtatggaaccacaaaagaccctgagtagccaaagcaatcctgggcaaaagaacaaagctggaggcatcacactacctgatttcaaaatattctgcaaagctatagtaaccaaaacagtagggtactggtataaaaacatacacatagagcaatggaacaaaatagtgaacccagaaatcaattagtgtatttacagccaaccatcttcaacaaaggtaacaatgacaaacattggagaaaggacactacaataaaaagtgctaggcaagatgtatacaagaagaatgaaactagacccttatctctcactatatgcaaaaatcaaggcagaatgacttaaacataaaaccccaaagtatagaactactagaagaaaacaaggaaaacattcaggacattggtctaggcaaagatttttatggccatgagctcaaaagcacaggcaataaaaagtacataaatgggactatattaagcaaaaatgcttctgtgcagcaaaggaaacaatcaacagaaacaacctgtagaatgggagaaaatatctccaaactattcattcaacaagggactaatacccagaatacacaaggaactcaaaaaactcaaaagcaaaaatacaaataaacccatcaaaaagtgagcaaaaggttagaatggacacttctcaaaagaagacatacaaatggccaacaggtatatgaaaaaaaattaaatattactaatcatcaaggaaatgcaagtccaaacagcaataagatatcatcttacctcagtatggctattatcaaaaagacacaaaataacaaatgttggtgagaatgtggagaaaaggcaactcttatacactgttgtaacctgtaaattagtacagccattctggaaaacagtatgcaggcatctccaaaaactaaaagcacaaggtggcttacgcctgtaatcccagcactttgggaggctgaggtgggaagactgcttgagtccaggagtttgagacaagtctgggcaacataccaagaccccattttcacaaaaaattaaaaaatccccaaaattagagctaccatatgatccaataatcccatgactaggtatttatccaaaggaaggaaatcagcatatcaaagggatacctgtacccccatgtttattgtagcacaataggtcaagatatggagtcaacctgtgtaaatccaacagataaatggataaagaaaacgtggtgtgtacacacacacacacacacatacacacgagtactaatcagccacaaaaagggtgaaatcctatgcttgcagaaacctggatgaactagaagtcattatgttaagcaaaataagccaggcactggacaaatacctttccaaagtcaaaggtgaacattaatcccattctggttactggacctttattgaactgacccaaataaaaggttcctatatgtttcttcaagccagcagtatctacatactttactttaaaccccgcttattttctttttggctgatttgccaaaatgtggttgactgatccatcaaaaataatactgtaatctctaatggtattccaaatttactgaaattaatttgcgtctttattttccccaatttttagctcctcttaatcaaatttacatgtaactggtataagtaatttcagctaattaaatgaagaatagcagactctctatttgttataaatttaatagttacgttaacatgtattgctatttcaatacttttatatttacatagataacaacactattcagcattagttagtatatgtgaagggaacagtataagtatgaaaaacagcctacccccaaaatatatttttagatacaggagaagtttatgattaagttgtacaattttctaggggaaaaacgttttattttttttttaaattaacatggagaaagcacctaaatcatcatgcttcaaaaggaaatcacgctgaaaacaacccaaccacttacatgtgccccttgacattggactcatatcagcgggtagctagctcacaactgaaatgacccataaatcttgcaaacctagtctacctctatacacataaaagagcaagcttcaattgcgttctcgaatgacaataagtatgtacaatgaaatacgtaataaactgagatctaggtggctagcacattcgacgcaacgtgctctattccatagacaattccattctacttcttggtgcattaaatgaagttattttccttatatacatagatctgtatactcattaaatatagtgacttctgcgaaaaaatttatttctaccctgcagtggaagcctaggaaaacattaattttatgttactgagaggtacaaactacaaccttctccttagaacaggaggtataaaaatcagcctcctggggttctgttgctaattcctctggacggctgggaacttgatctaagccattccacataactggacatcatttacaacttgtgggttttgtgcagtgtctctgtgccttcctacatggggactcaatcacataagcaagaaatttcttttccccagtcacctaactcagtaccagccagctagatggcatctctcaaggcactgtggtagaggcatggtggctgttactcatattacacttttccaatcagttgggtcaatctgtctactcagaacatactaagtgatatcaggcacctgctattctgtggtgactgtgaaatactcttcctcactctacatgtacaaatctagtttcttttcagaaaaccagcagttagtgatagaaacaccattcccaaaccaaaatacatgagggtaaactcaagttggacagagttatcaatattttttagctgcaaacattcctttcatcaccaacacctggtgctcaatgaatgtatcattacttggctggttatatataagcccatctgtgcaaaaatggccaaaagccctctcgtagttggctggacctgtgtcctaaaatacaggagccaggtaatgacgagctttgatgaccttcataaccatgggaaagacagctgacagaaatggtttatatggcaataatgtggaaataaagaaccacatatactgcaaaatatattaaaaaacataaaacatatattatatggttattatatagcccttttaaatacaatagtcatcttttctttatagggatttttgggaagtatgagatttcccatctaagatttagtgaggaagcagtaactatatcacttttggatagtctatgaatatgagaataatgagttgactattttcagcccatttatcagccttaactcctcaaacacacaaagtagatacactgtcataaatctttattcgtgctatgatggttgccaagaaacgcttcatttctcagtaaatcatagttggcatgaagtcatgtgttgctaaatattttataacctcctcttatgaacctggaaacaatctattaactacacatatgaaaacccccatatatttgcatgtaaataaatatttatttgttttgtccaatttccatctttatctgacaaagataaaatgagtgtaacctcagcaggcaattcacatgtggccagggctccatccagttatcctagttacagctttctactctggtagcaggtagctactgtttcattagctacagtttgtatatcaggcttagactgccattcctaaaaaacaacaacatttatttacactttcaataagaggaagtttcagcgaattgcctgggctccaggaaagtcttgagagaataaaagatagtgtaagagaaatccaatcccgttatacatacttgcagtgtaaatttgtcatcgggtcaatttccagtatatttcctaacccccaaaatgcctcaatataaatgggatcttcagggaaatcatactgtggaaataagtaatttatggtgtcagtttgtttccaaagatgagtagtgtgaactgagtatgtgtgtttaggtaattttcctcacaatcccataatcattttctagtcttttgagaatgaaaaacattctactttattttgtcctcttaacacacaaaaacatttgatagaaagataagtagattctcagtagatttaggaaagggtgaagaaggatttctaacaaccgcaacacagaattatacacagcttgcctccaccacaagcgattctcctataaacccctcttcacacctctcagaatcattgccacagtgagctatcaagtctcagcaataacaacgaacaaaatcagtgtcaactgcttagagaagaggcagtctggataaatgtaaaattgacaacctgcttggggtggggcggaggagatgtcactgcaattgatttcaggaagtgaactcctcttgtgcccatctggacactggactttactggtgactgttgctgtaacagcatcatgaaaaagagtgactgtccctacctcggaattgctccacaattcctgaaaaataaaaacgtgtcttgtagtgaaaaggtgaaagcacaagcagtgaatccccatctatgcatgagcaaatatttcatggcacgtccatttatgcaatggcattcattttgcattttctatgtgctaagcaatgtgcgaggtccaagagtcacacgaaataaagcacaatgcccgagccaagaaggtggcaagaggtgaggagtgattgcactatggtgattgttagctgcagtggtaggcacagataggaatgatgaaatggaactacttttgttaccaagactaatgcaccaaaacatgaatgtgggaaaacaggacactttggtcagctaatttccgcaaacaagctttagaggacttttttacttgatgcatatggatgccagattttagattccacagaccaaaataataatagcaataacaataataataaatgatgaactgagttactagcaacttgaaaaatactgataattatatttcaaagaaatactaatagtaacaagatgcttatattaatggtaaaattaactatgcgtgagttctttagaacaaaattttgttttaaagacttacatttaaagacttgttatatttttccatccatctactgaaggacatcttggctgcttccaagttttggcaattatgaataaagtcgctataaatatccatgtgcagtcttttgtgtggacataaacttttaattcatttgggtaaacagcaagcagttaaattgctggatcgtatggtaagactatgtttagttttgtaaaaaactgccagactgtcttccaaagtgatgagaccatattgcgttcccatcagtaatgaataagagtttttcttgattcccatactccccagcatttggtggtgtcagtgtcctggattttggccattgtaatagatgtgtactggtatctcattgtttgtttgtttttttaaattttaatttccctaacatggtaagacgttgagcatcttcttatatgcttacttgccatgtttatatcttccttgagaagtatctgttcaggtcttttgcccatttttaatcaggttgtctgtttttgtattgttgagtttttaaagttctttgtatattttggatggtagtttttcattagagatgtctatttaaattttttctcccagtctatggcttgtttcattctcttgacagctgcttttcaaagagctgaggttttgtattgtaataaaatccagcttatcaattatttctttcatggattatgcacttggtatcgtatctaaaaagttattactatacctaaggtcatctatgttttttccagtgttactttctcggagtcttatagttctgcactttaacagtgaggactatgaaagttttaattttgtaaggagtacaagatctgtttccagatttttttgtttttgcatgtttgcatccagttgttccaataccatttgctgaaagactacactttctccattgtatattctttgcttctttgttaaagatcatttgactatgtatgggtctacttttaggctgtctattgtgttccattgatcgatttgtctattcttttactattaccacactgttttgattactgtagttttgtatagttaagccttaaaattggatagtgtcagtcctctgactttatacttctatttcaatactgcaatggctagtctgggtcttttgcctcttcatataaacttttgaatcagtttgttgatattcacaagttaacatgctggactttttattgtgattgcattgactctagataaaattgggaagaattaacattctgacaatattgagtcctcctatccatgaacacgggctatttctccatttatttagttaatttctttcatcacagttttgtaattttcctcatacagatcttggacagttttgttagtttacctaaatatttcatttttagaggagctaataatatttttagaggagctaatatgttattgcgttcttaatccgaaattccacttgtacattgctggtacagagggaagcaattgacgtttgcacattaaacctgtatcctgcaaccttgctataattactaactagtttgggggatttttttggtcaattcttttgtattctccacatatataatgatgtcatctgctaccaatgatagttttatttcttccttcccaattttatatgttttgttccattttcttttgttcttgcattagttaggccttccagtaaaatgctgaaaaggagtggtaagaaatgacattcttgcattgttcttgatcttaatggcaaagagtctagcttctcaccattgagtatgatgcccactgtaggttttttgtagatattccttatcaagtttagaaagttcccctgtatctctagtttgcaaatagcttttttttttttttttttttaaatcatgaatgggtgtttgattttgtcgaatgctttttctgcatctactgatatggtcatttgatctttcttctttagcctgctgatatgatggattatattaattgattttcaaatgttgaacacccttgtagatctgtcatagatctcagttggctgcatgttataatttttcaatacattgatttgctcatattttattgaggaattttgcatctatacgcatgcaagatcttggtctgtagttttcttttcttgcaatatctttctctgttgtttgtagtagggtaatgctggcttcatagagggaattagaaagaatttctgcagtttcatccttctgaaagagattgtatagaactggtaaaatttcttccttaaatgttttgtggaattcactagtgaacctaactggagctggtgctttctctttggaaggttattaattcctgattcaatttttaagataggtaccattcttttcagactgtctatttcttctactgtgaattttactagctgtgcctttcagggaatttcagctacattatcagattgtaaatatagatttgttcataatattcctttataagcctttcattgttcatgagatctattgtgatgttcttttatttccaatgttagtaatttgtgtttcctttcttacttaacatggatagtcttattgattttttaatcttttcaaataaccatttttttttttgcttcattcatttttctctattgatttcgtattttcaatttcattgattttttgctctaaatttaatacttctcttccacctttggatttaatttgctcttctttttctacttttctaacatagaaactgagatgatttattttaggtctttttctcttctaatatattcattcaatgctgtagatttctcaaaacactgctttcactgtatccacacattttaataagttatattttcattttcatctgatttcaaatactcttgtgatttattatttgactcatgtgttactgagaagtttgtgtttaatttccacgtcttttgggattttccatctgtctttctgtcattatagtgtaattccactgtagtcgagagcaaatattctatgatttctattcttttaaatttgtaaaggtggctgttttatggcccagaatgttctgtgtcctggtgaatgtttcatgatagcttgagaagaatatgtattctgttgttgttggtggtggaagtggtctatagaggtcaattatatccagttgatcaatggctgcaatgagaaaatcccagaatcatacagaaaaaccttcccccaaattgggaggttgttgacaaaaaaaaaaaaaaaaaaaatttggacatgtccagtttggcgagtagatgggttataaggacttatatatgaggacctcctggatggcagcaggacagctttagagctccacaccacctcttgttcttaaactacttttaagcgaattttctgaatttttgtatattgtgtttaagtgctgagactatttttcttgctaggttctcagacactttctaggatgcttaggttctcaggaacacctgctacttggctgagccccatagccttggctcactgcctggtcttcaaggtttaggtggtagacatatacccttggctaatgggtgggagactcatcatgctacaatggtgctgctgagttcaactatgtccttactgattatttacatgctgaaactgtccatttctgaaagagggtattcgttcatttttattgcagtttactatatcactgtataaatataccataacttgtttatgcattgacctgttaaagatcaattggaacacctcataatatagcctaccatggtaaatatgcctggtgtacttgtaaagaatatgtattctgctgttttgcacaatattttataaaagtcaattaggtcctgttgattggtaatacagtttaaatcttccatatccttaatgattttctacctatgtgttctattattgaaagagatgtattggaatctgaaacttgaattatggatttgtctttttatcttgcaacttcaacgtattctcactgcagcaacttgtttctaggcctgaaacacttaaagccttggtctcgtcacacagataaattaggagttgatctgaaaaagctgggatttggtttggatctgtatccccacccaaatctcatattgaattgtaatccccagtgttggaggtggggcctggtgggaggtcaccggatcatgtggttgaatttatcatgaatgacttagcactatcccacttggtactgtcctagtgaatagaaagtgagtgagttctcacaagctctggttgtttaaaagtttgtagcaccagctgcttcacccgctcttgctcctgctcctgctgtgtgagacacctcactttccctttgtcttctgccatgattagaacttcttgaggccttccccaaagcagaagtcactatgcttcctgtacagcctgcagaaccatgagccaattaaacctcttttcttataaatccaattaactctcttttctatatttctttatagcagagcaagaatgcactaatacaggccaccatagacctctgaccagcagttcatatttggtgcttactgcttaattatttgcttgaagataatgagcatttattgttgcagtagcaattagcaaactcctcaacaccagcgtaggtaatataaacataatgatagcactgaaagttttctgaagatgtctgttgcaaaattgtagcttcagaaagaaactaatgaactcatagaactgggagcacttggaatccacatggaaactcatttaccacactgcagatggtatgtctcccctgtgatgagcaacagcttttgcaaactggctgttgatcaggttcacttcctaagtggctcctcaggctcacatatgattacgaatggaaagaaaatttcaaggaaatagtgttgatgttgggctcagtgggataaattgtatttaagaaaaatgttgaagataatgctctatttgaattggcattattttgcaaaatactaaacatatacatttttctttccataggaaaatattaattaattgtctgtagggacacaaaggaagacttgcctgtaaaggcacttaaattaaaatgaaatgaatctcagagtaatagcttttgaaatctgaagatatgcctgaaaaagaaagctaatataaaaatcgagctaacgtttaatattaaataagttagtacaattaagtaagaaaaagggaaatgacaacatatttcaagcatgtgcttcttccaggataaagtctcaaactttggggacttttagtttggtgtgcatttgactctttattggtaataaaagaaataaagtataggacaatatagaataccaggaaagttgttcacattgggaattttgtaagaaatatgtccaaaaataaaaacaaagactgttgactcataatatatgctacatggtaagacattttatcatatcactaaaaattaagtcgacctcttcactttgattaagcaggagaaatgctgtagtggaaaagattcaactcaactctcaatccacctctgactcttgcacatgcttgctctctctctctgtctctgcaggactattaaattggtagaaaaaaaaaaaggaatgaaactcttgagcccttatttgtgttcttgcttgagtgttgacagcccgaatctattgccctgccgagaatgcctcgggctagagagaaaaaagccttcattcatgataaaagctccttaggctcagtttacttttccaagttagctttaaagtagttgagatacagaactgcagggtctttgctaatatatcaaatctaaccttttttggggggaaaaaagttaactttagaaaaccggtgctagatgtcagggttggaagatgggaaggagaaaggttgtgtattatttctattatctaaatctatttaatcctataatctgagtccaacacttgtagaattttatagccatttgtgaatttaatataaaaggatagtgtatatatatatatatctactcacattttatgatgatggtgacattgctaaatttaaaaaagcatactaaaaattgctatcttatttgaacaatattaagtaaatctgcatttcttagaattactataaagtacacgagagctttgaaacatttaaaatgaagttatatatgtgtgtgattttattttgtctaatgacttgtttgttccatctttgtttcccatcactcagcactgttcctagcacccagcagttgcttggcgtttgttgattaaacgactgacaattcctgggactttaaaagagttccaattcaatttccattcaatttaaacactgaatggaaaaattctcacaccactaattgatgcttttgccccatattcttcccacagcaaaatgagtctttcaacaatgtcaaccagattccacattcaacattgtgcactcaatttaacattccacattgtaaaccagattccacattcaacactgtaaaccagatcatattcttcccctactgactatcctctagtgttccattccacttggaaaacacaatccagatttcttgccatggtctacaagaccaacgtgagttggcccagtctgcactccactcctgtctgccctcttcaaagcactgtcctcctttcagctcttcagataggccaagctctttctctgcttacgatgccttgcactagctgtctcattagccgagagagctctgccccctggtcctttgcacatctggctcaatcttgccatttggggctgagttcagcatcctaaagcagcctcccacccttctcttattgtttgcatgatgacatcccatactgatctccatcatggcacttattggtacctagtattaactaagaaatttatttctcttgacatactgcgcccaatgaaccccagaatataagctccataagtccagtggccccctcctttttacaactgtactctagaacttagaagagcgccagcacattgtatggcttcattatctatatatacagttaaaaaattatatatacaagtaaacaaatgaaccatgaataactgaatggataaatgaatgggaaatatactatcagccaatatccaaaaattatacatatttagaagaacgatggaaaatgagcatttaaaaaaacagttttaattttgcctgaaaaagcaaggttgctattagtcatttttcaatatttaatgaagggctgtgcatttaaagaaatgtcactgctctcaggatacagtgcagtgagtggtcatgttgaaataacacacagtaaaagatgtctcatagaaatttgactatatgacgttttaaaaaggccatggggttcattctttcatgctaagaatttagagaaatattcactaacaacaacaatgcaagtataatagcagacacatttcaggcaagaaatcaaaactgttgaaaaaacttcaccgtcccagagtataatgtgatagtatgacacatgtttcttgagctagggataggggaagttttgtgaatatacttctgaaaatgaaaaaccaagcttaatgggcaagagttttgcagggtctccaagtctaaactttaataggtaccacttaaaccgttgatggcagaatcatcaattaagttttatagcagagctgagtaagaaatcaatcaacaaaatattagtaatccatctgctcatcacaacaaattctggcagacaacattattaccttaatgatatgatattggaaggaaaaaaaataaggaaaacggcttagcatctcccaaaggcatgcaatatggttccaaatcaattcgaatttatagctatcctgagttctctataataacttcattccacaaacactaaattttgaacacctttttaaaaagccagaatcaatatacatccaaaacaaccaggtgctctatttacatgtcattccaatacagcagaatgaaaagctttcatattcaacccaagtttgaaaattatagctgtggatatattttcagatgtcgctaggggagcatttataagataccacacacttaagcaagatactaaaataataaatgaagttcaactgaaaaaactgcaaagggataagaggcataactggattacctaagaccaaaaaattgaattcctcctgagggtatccaggaaagctgagctgcaaagtttactatgaaaattcctgtaaactctcaggagactatagaagtcaagaaattagagaaagatgcacatatatgtgtatgaacatttggcaccagatagtgagacacggagacgtgtgcttggaggcagaatgcctgctatttgtctcttcagccccatttcccaccattctccacctgcttcgtgccccgggggccccaggacgctaccctacatgggctacatgagcttcttactgattttggtcaattggtagcagctacaaaagaaaatggagaaagaggtaattattcctcaggcctcactaagtactcaagccaaggctgagaagagaacagtgtatcgaaatgcatcatgttcagtgttgttacacaatcatttaccaccagatagaagctgcagcaggaacttgaacaaagtctggtggttaatgaaccccaggagaatctggaaaagctaagggtatcacacctcagttatcagtcttccttggatttaaaacaaaattctgtatggaacacttcccaatttaaaataaaaggaaatagaccatgagaatagaaaaatacatcctgagaacttattatatgagaaaaagacaccatggccccagtgaattagatcctggcattagaataggaatattatttatttagccttacaatatttgaaggggattttaacaggaaagataaaggaatatgactacagtagagaaaaatttaacagtctttgagaaccaaaggaatctggctggatacccttgtaagagttatgtgggttcaggagcaaaataaactatgtaaaaaggatcataaacaggtgaggtgtggccaagcgcagtggctcacgcctgtaatcccagcactttgggaggctgaggcgggcggatcacgaggtcaggagttcaagaccatcctggccaacacggtgaaaccccgtctttactaaaaatacaaaaattagccgggtgtggtggtgtgaccctgtaatcccagctacttgggaggctgaggcaggagaactgcttgaacccgggaggtggaggttgcagtgagctgagatcacgccactgcactctagcctgggtgacagagcaagactctgtcttggagaacaaagcaaagaaagaggtgagatactacattgtctagattcaaccttggaaggtaagtggaaattttgacataaaaattgggaaaaatggaaatcaaagcaatgaattcccagaacactgtacagaaattatcaaactgcataagctaatgaaacacctacatgacaatttcagcaaaatgaaaaaacaaacccacaaaccacaaccgtcagaatcactattcttcaataacttatggcaaaaaaggaggtaaaaagatgtcatttttccacaaagaagaaaagctgaagctcaaacacagactcggaggttttttgtaacctttgcacactaaatataaaaattgcccttcacaggcacacaggatgcatgcagtgaaataaaagtcctctcgcggctgggcatggtggctcatgcctgtaatcccagcactttgggaagctgaggcaggtagatcacttgaagtcaggagtgtgaaacgagcatggccaacatagcaaaaccccatctctactaaaaatacaaaaattagctgggcatggtggcaggcacctgtaatcccagctactctggaggctgaggcatgataatcatttgaacctcagaggtggaggttgcagtgagccaagatcccaccactgcactccagcctgggtgacagagcaagactctgcgtcaaaaaaaaataaagtcttctggttcataactaggtgtacttgtaaaagttgtttataacttcaacatctgcatgctaacttcacctacgcttggagttactatttaatgaaacaaacaacaatcttttagaggaagcaatggaacattttagaaatgggaacaatgtctcttgtttgcctttgctgcagatgtcacttcctctggctcgtgttagcacagggagacccctcgcagaatcaatcaatttgctttggaacaaatttctgatatatatattatatatacataatatatattttatatatttattatacataatatatattttatatatattatgtatgataaatatattttatatatttattatatatattttatatatttataatatataatatataaataatatacatttattatatgtaatatacatttataatatataatatataaataatatacatttattatatgtaatatacatttataatatgtaatatttatgatatataatgtatttataatatatattatataatgtatttataatatatattatataatatattatattatatattatataatatattatataatgtattatattatatattatataatatattatataatgtattatattatatataatataatatatattatataatatattatattatatataatatattatataatatattatataatatattatatataatatactatatattatataatatattatattatatatattatattatatataatacatattatataatatatattatataatatacaatatataatatattatataatatattatataatatattatataatatatattatataatgtataatatatacaatatattatataatacataatattaatatatataatatattataaaatatattatataatatattatatatactataatatattaaatatataatatataatataatatataatatataatatataattaatataaataatataaaatatataatatatatttataacataatatatttataatatatattataatatataattataatatatatttataatatatattataatatataatatatttataatatatattataatatataatatatttataatatataatatatttataatatataattataatatatattataatatatactatattatatataatatagtatattttataatatatactatattatatataatatagtatatatttataatatataatttataatatatataatatagtatatatttataatatatatttataaaatatgtaatatagtatatatttatgatatatttttataatatatataatatattatatattataatatatatttataatatatataatatattatatatttataatatatattataaatatataatatattatattttataatatatatgttatatatttataatatataatatatatattataatatataatatattataatatatataatatatatttattatatatatattatatatatatataaaactttccagactgactttaagattggtttgatatttttattttctattttactttgttttgcagtgctatgaataattgacagatgactaaaataaccatctttattgttacagcaaaaaccttgatagcggtgtttgttccatagtgcatatttaaaaggctgtatttcagagggtcactctgggctaatgacctttcttcagattaaatatatatttttaaattttacaaagttctgggtattctaaccataagaaataactgaaagtgcataaacctttacaaaatagcaactatcaaattattttacttctacatataaaattagttttattgactaggaaaattgtactataaatgctgtgagaactttggagaaataattgatggatagcagagatttaggtagatatatatttagatagctagctagctagaggatagatatagacaatactacactacactgtgctatgtcatattttaataatgacacgcaaaatgctttccatgcattgttaaatacagggtcttcaacaactctaccatgtgggtactttcctttgatcacgtcatcctgcggagatgagaaatcgtttaaccatgatgtcagccttagtctgatgccaaagcccatatttgatttctttgggaattataaattttaaaacaacttcagatatatagaacagttgcaaaaattgtacaaagaactcttacatattcttcatccagcctcctcaaatactggtatttttttcacgtttagtttatcttcttctctcaatctttctctatgtacattatatagagaaagtaagttaaaaaagaaagtaaactaaaacaagtaaatgcaaagtaaatatatgcatatatacatatttaactatatataatgtacattattatatatctttatgtatgtaattactttttctaaaccatttgaaagtaactttcagataggatgtccctttacccctaaacacttcacttgggatttcctgagaataaaaacattcatttacataaatttttacacaatacttttctcaaaatcagaaaatactgatagaatgctgttaccttattgagcaaatctgatccttacttgtaaattgaaccaattatatctgtaacacccaagccccccaaattgaaccgaggaccacctgctgcattgagttttcatgtactttcagtcccctctgatctggaacagtccctcaatctctctctcatagccttgacattttctgttgagtgtaggccagtttttgtgtagaatgttcctcaatctgggtttgtctgatgtttatattaggagacacatgctatcgtttgtcccaatatttcagctttgatcatttggttcaggtggttcctgccaggtttctccactgttaaggttcctgatttttatttttatgttgaataagtgttttctggggcgacaaggctatgcaaatattctgctgttaatcaaacctctacttaccagttttagtatccattgataatccctgcttgaatcaattattagtatgatggttgccaaactgcagtttttctaaatgaatcaatccttctacatgtggaattttacagagaggaagagacttctaacatttatttatgtatgtatttatttggttatatcatacagacccatggattcctattttttactgggttaacatctattggtcataatatcattatttattttgatactcaattcccctagagtagccaatgggagccctctgaagctaaatcccttgtcttttggatacgtcctcactgttacatgcatccttctttcttttctggtgtaagaaaaatgttccagcctcctattatacttttccggctccaaccccagaatcaaccatttctatgaggagccctagtatttttagtggagaaaatgttcagaaactgagtgccaggtgtattcattcctagtgggatgtcattgcttccagatattctcaaagacgaagctaggaaatgtgtgtgttatacacaaaaatatctttatgacaaccccaagtgcatagtgataactgtgattccaatcaagcatcacagtgtttattcgagactcttctttttcaatatctgtagcttccttctgtgacactgataaatctgactctggttatctcaatatttgttgtttatcaaatttagaatacacaggagttatagaaatgacaactcagaacaaaaacaaaactacttattaaattcatttttatattgagttctgactttatgctaaaagtatgtagtaaataattcagtgggtaaagttatttggaaatttccttttccctttcactgtgccatattatctatttgaaatactattaagttcatttgtttgcatttataattggttttagtttgttttattctgtgtccttgctgatttttttaaacataatacattaacaaggttccaaaggtcaaagctatacaaaaagattcagagaagggtcactgtcctaacctgggccctggctgggcactgctaccccctcgtacctcccattcagttcctactcaccccccatcgggaaatttatctcacttgtttctggtttattcttcccatttctttgataaaaatcagcagacatgcatactttcagtgtggggcctggttaaaaacccacgtgtgacatttcaggcggagcatgggcagttgagcaaagctgccctcccacatgggattcagagcacagccagagccctgcacagtcaaggtttcagagcccccggccagtcaggcttttttacgtactcacactgctacatacctaggtctctagctgaggccctgggcaaggccctcttcaggcgcctctgcagaggcctccttccaggaggaggggaaaccttgaagacatgcttcctcactgtgactcagtccactttgagctctcttcacctggccacagggtccataaaactgctggagccttttgttgggtcacgcatgtccgcacggatccacctgacccttgaccagtgcaccattccatggaggaaacaggaacggaagcgagctggtgcttcctccctataccactccctatacactgcagtgagtgatgaaaggtttaactcattaagggcttgttgctttaaatggctactctgacacctggctctctctcccagctgaggggagctccttactccactccactcagtccccttcactcctgcaaataagataacacaatacagatcacctttcgtattttttttttcactcagcaaggtagtccttaaattactccacctcagtgtgtagaggtctttctcatgcctttttcccagctgcatagtactctattgaatggttgtactctcccggtttaggcaacccctaggttgtttctggtatttttcaataacaattactttttgtataatatcatattgttgaaagacaacatgttcacgttgtagaaaacatgaaatttaaaacatattatcttgagtaaacttgcagcatgattttaagaacagcaacttttgcgattgatccttttgaaaattggaagccaaccgttcaaatttattgtcaagtgtttcctctagtgaagtggtggggaaggtttctttgactgtgagttctgaaatgttaggctaacaaatcgctaaactgtggcagtggagaaaaggaactcacacaagtacaccgctgagcttcattcttctgggagaaaaaaggcttctttgagattatatgattggtttcttttccctcaattgcagtaacaagtatatgggctaaggatgatgatcagaaactagagaaaaaaagagctatgtatcaaaggtaactgcaaagggaaaagtagtatggcaatcccagctttcaggcagaagcgcagaaccaactcaattcagggctgtaatattctcccgttcaaggtccagtttcagccacagcctaattttcaacaggaatggcatttgtaagctggagattgtcagctacgctcttgctgctgaatcctgttttcaatgcatccctcctcccttcctttctcccctgtcaccttccactgctcacccttctactctctgaaattgaagcaaattacaatgtactctatagcattccagctagaagaatgaaagagttattcagatataaagaacataatacaggaaagtccttcagtgagaaaatggtaagccgagaactttcaaatttcaagactgaaagtatgaatgcttatatgttacaatcaatatataaggctgaggtcagaaatcaaatgtaaatgacatattcatggaaagtatctactcgcagggtaggatattcttagagatggaaatcaatttgttgtaaattgactgaagttcatttacacgaaacagaacctttgtacaatagagcataaactgacaagataagtattcattctgagactctaaaatggaaaagaacagttcaaaactgccaagatgaaggtctccatctggcatttcaaatttgctgatattttatgaaagtcagttttatgttatagggcaattttctgccaaagaaataaaaggtgggactaattcttgtttaaaataataataaaaaaaaactgaatccatagcaaaggcgacacatctgttgttgttccaatttattttctgtaagccacattaattatacatatgaatcacatacatgaatttaattcaaattaataatagactcttgaaaatacaggccgattagaaaattactgagcattttttccatcactcactttccatacacaaaatgtaacttgccttggaacccctgcagactgccccttggacaaaatatcctctttgaaaggggataaaatgctcctcctgtctttcttcttgtcttgataggtggaaagtgcacaggactcctgaggtcctctgactgtcccttgccaactttcatctcccatcacgaggagggagaaggttcttatgatggacaacatttgattccttagttgggccatgtctattgctagcagggccaactagaagtagggtattagatccatgcaagttaccctggaacactctcctcgtggctgacccatccccactggtcactcaatagtaacaaccctgagatcacaatttatatatggtgagagcctgaaggttgtcttcggtctcaagcccaagcatgccatggagtcctacctcgcctttaccagggagatgtcatggagctttaggcacaggatcctggcgataaagcagccctcactgctcatctcacagtagtcccttctgcatctgatgctttcaggatcatgcagtaacaagaggggatgggcaggatggatgcctacccaacacgccaactccaccttccgaaacctcacacacgcggctctgaaattcacacacttccactcagtcaactgtgtgtgtgcaactcaaacatccgcctctctcccgggcctgctcaaatggccccttattaacaaagagtttgtcttaaatatctaagatcatagcatgtggattaattttttgtgttttacattttgtgaagctcatttcattattttgtgtggcttcatgaaaatgttgtaaatagctatttttagaacttccatagggagatatatcttatggagtcagctccctagggtggttaagagtctgtacttgggaatccatcagaactggtttgaaattcaggtctgggaatcgctagttatgtagcattaaatgtttgctaatctaggcctagtttacatgcatgtacatgttacaatgaggaaaatgacccttaccacatagaaactatgagggttaaatgggatccaatatgtgtatagaaggcatgtggcatggtgcctgacaatattaagtgccccataaatcatatccattatgttcatgtcataaatattgtagaaaaatctaattctgactaaatgatagaaaatcaccacattcaatgtaacactgaaaattttaaccattgtaactataactaaatatttcaagaatgtttgaaaaaccatggtttaacatttcatgcgatcattcttcacgacaaatatagtttttctcatcagaggctcaacagtatgggcttttgtatctaattaattcagatattttctccattacagtaaaagatccccttgggaaaatcacatccatcatcttctgaaacgttgcctgtcacagcaagggactatatataggcttcaaaatttcatacttaaccttttctgtcacttagcgtttctatttcttttttgatttctataagacaagctgcattcatcttaaaataaaccaataccaagcatgaaaaaagaaaccccgagagagcctctgttgttcctatgtgtcttgctgaggtagctggctgtctatgtgcaatgagcaccatgaccctgcgggaaagatctggaacagagatgaagaacacaggccataataacttttatttttatttttattttttttgagacggagtcttgctctgtcacccaggctggagtgcagtgacatgatctccgctcactgcaagctccacctcctgggttcacgccattctcctccctcagcctcccaagtagctgagactacaggcgcccatcgccatgcccggctaattttttgtgtttttagtagagatggggtttcatcgtgttagccaggatggtctcaatctcctgacctcgtgatccacctgcctcggcctcccaaagtgctgggattacaggcgtgagccaccgcgcccggcccataataacttttagacagacaaagtcaaagtcttgaggctcaatagctggtttaaaacaaatgcacatgtgctcatatcccattcttgggagatgtggttaaaataagaaaaactaatgatgagaggagccatttttgaattacttggagtctaaattatcaaatattttgcaagaaaagcatgtttttattattttcagtcttttatggtaatacgaattaagctctcataatcttgacagatgtgttttaggacctgctttaaaacagcaacaggaatgatttacaattagtatagaaaattgtaatgtgcgaactgatcatttcaaagtgatttctcagtgtgctcagctttttataataatctctaattgtatttatatacttaggatgcttttttgtcctcccaagagccaaaacctatcttgagtatagctctctaccattaaataaatcctacatgagtgggctctgcaataatgagattactatgtaatgactttatgttatctgaaactctaagttaaatataaaatctagagcactacacttagcaagtcacctgtttttatattattattttctcataatttagccttggtgcactagctgaatatcacatcattctttgcctattatatcactacattaaaatatcacaaattcttcttatgtaaagcatcacatgcttccttctagaactttggtgatcaaccatacttagatggtttactgactcatacaacatttcaggaagagctaccaaggtattttctttctactatcagaatgaaacactagggctaaaattctataatcaaatttacatttttatggagaaaaacatgaggtacacagagaccaacaaggttattcatgacttaagcattaagtgccaagtctctccctaaatatcttcctcattcacctttccattgggccctgcatgcctgtgtgttgaataagtaaataataagtgctatagctgttagagtgtcattagaatctccagaaccatgtaagacatgggctaaggagctgaaagaatactttgaggggcactgaagtgtttccaactctggcatgcctcggtgcaccctcaagctcagagatggattgaaaggcaccgttcaaaacaagtctcccagcagcctgctatctacagatcattgaaatgatatactgcaataacttcccctggaacgcttatggcttattgcgctgatgtgtaattaatctgctgagcagtgacaggacccagctgaagagtgcttctggagcttttaagatctggcatgccaaagaacacttggggagtccttggtccacgctttgttagcacaacagactacaacgagcctttaatctgtgattgcacatatgctagataactttatgtattaaaaatcatggctgggtatggtggtcacgcctgtaatcccagcactttgggaggccaaggtgggtggatcacctgaggtcaggagctcgagaccagcctggccaacatggtgaaaccctgtctctactaaaaatacaaaaattagcctggtgtggtggcgggcgcctgtaatcccagctactcaggaggctggggcaggagaattgcttgaaactggaaggcagagatttcagtgagccaagattgtgacattgcactccagcctgggcgacaagagcaaaactccgtctcaaaggaaaaaaaaaaaatatcacaaagtggttttgctcagccttggtctaatgtcagcagcacctgtaagtgcatgtgcatttgtaacctgtgctcaaagttgagaggatggagggacagcagactcttcctgcggagaacaactgtgtttttgtggcttggtcaggcttagagagctcattaggctccagccctgcaaatctgtgactgcagtgcacttctgacttgcagtaaacatggatagaatatagggagagcttggatggaactggaattgtcagtgacagaatgctgactaagtgaccaatgaatcaaaaaaaaaaaaaaaaaaaaaaaaaacagataaaaacaaagaaacatacaaatgatgtctgaaaagagcaaaatcctatttaaagatatgaatgtttttctagatattcttttgtacatgatactgaaaatattttcatttgaatatcaaaaagtggttgatgaagttggatgtagctgataggctaaacatacatatcttggttctttcacaatttcaaagcagttggtaagggacagatatatatgtaggtaaacaaaaaagttcaagcttatcagcatctactaactcgagaaaagcatttcaaaaaacatcttaaatgttgaaattggggagttaacagttaatatgtagtggaattcagaaattgatttttttctcacatataggactaataaagattctccccatatttctacattttaaaatttaggaatgccatgacaaacaagaatagctctctttgaattttctgttaaaatatgtaatgggcccggcgcggtggctcatgcctgtaatcccagcactttgggaagccaaggcgggcagactgtgaagtcaggacttcgagatcagcctggccaacatggtgaaacctcatctctacaaaaaatacaaaaattagccgggcatggtggtgcgcacctgtaatcccagctactcaggaggctgaggcaggagaattgcttgaatccgggaggtggaagttgcagtgagtcgagatcataccactgcactccagcctgggtgacagaacgagactctgtctcaaaaaaaaaacaaaaacatatatatatatatatatatatatatatatatatatatatatatataaaatatatgtgtatatatattatatatataatatatataatatataacatctatatacatcaaatatatatataatgtacttaattgataagaaaacagataattaaactatcatataaaaccacacttaaatgactaaaaatctgatgctttttaacaaaggctttcaaataattggtcagtacaaattcaaggtcatccaatccctttatgctttatgaagactagaatctgttcctctcatactttttgatgtcccggcattacagggaatatatatatatatatatatatattttttttttttttttccttaagctcttttttaaaataatcttttaatttcgtttccatgaacattttgaagtcccttcctccgtgactaaaatatccccacatgctcagataagaaacatattactcatccgaagtttctaggatattactgtgcgtacaaatcacctgatgatcctgctaatatgcagattttgattccctacttctgggatgggttgagatcctgcatttcttctttttaaattttaaatccaggtggtacatgtgcagttttgtacatgggtatatcgtgtgatgttggggtttgggctaccattgaatccatcacccaaatagtgaacatagtgcccaataggtagtttttcaacccttgcccccttctttccctccctactttagaattctccagtgtctattgtacccgtctttatgtccatgtgtacccatcgtttagttcccacttataagtgagaacatgcaattatttgattttttgtttctgcattaattcccctaggattatggcctgtaactgcatccacgtcgctgcaaaggacaggattttgatctttttttttggctgcatagtattctatggtgtatatgtaccacattttctttatccaatctaccattgatgggcatttaagttgatttcattactttgctattgtgaataatgttgcaataaacatatgagtttttgatagaatgatttcttttcctttgggtagttacctagcactgggattgcagggttgaatgggagttctatttttagttctctgagaaatctccataatgttttccatagaggttgtgctaatttacacgcccaccaacagtgtataagcactcccttttctctacatctgcgccaatatatgttattttttgacaatagccattctgactggtatgagctggtatctcatgtggttttcatttgcatttctctgatgattagatgttgaacatttttaaatatgtttgttggctgcctatatgtcttcttttgagaagtgtctgttcatgtcctttgtccccttttaaccggtctttattgttgttgttgttgatttaagtttcttatagattctagatattagtcttttatccaatgcatactttgcaaatattttctctcattctgtaagttgtcagtttactctgttgattgtttcttttgctgtgcagaagctctttagcttgtcaatttttgtttttgttgcatttgcttttgaggatttagtaataaattacttacctaggtcagtgtccagatgagtttttcctaggttttcttctaggattttaataaatcagtgccttacacataagtctttaatccatcttgagttaatttttgcatacggtgagaggaagcgttccagtttcacttatctgcatatgcctagccagtttcccagcaccaattattcaatagggtgtattttccccattgttgatttttatcaacttaccaaaggtcagttgcttgtaggtatgaggctttatttctgggttctctactctgctccattgatatatgtgtccatttttgtaccagtattgaaatgggaaaggttcccttgtccccctagcagggcatgcggtgggggtgtggcttgcttcttcagagccctgctgctccaacctctaggtgaacatacagacgggcaggctgtggggctcccaccccacagcagtgtctcggggtgactgtttacagctcctaaagccccagtgggcgtgtgttacagggtgttctcttagtttgcctacgggcaccttgtgttaatcaactcaattagagcgtctaccttgttacaaggacagagggctttctgtatccccagtttcttgccttggtgtaccagaagaatcagatcacacgttggcttggcgaatgggtgcaaagttttactgagtggaagtatctctcagctgatggggcagcaagaaggaagacggtttttccctggagtcgggctgcttcggggccagggctctcctccgaccgccccagccaaactccacgtggttctgctggtcgcctgccggtgtttgtcggtgtgctcttctcctagcctgctcctctcctcgccctctccacgactagcggcttgcatcttcttccgccgatgtgctcctctccatgtctggccgtctgtgtgtctgcctgctagggtatcgggtttttagagacccaggatgggggtgtggcggaccagggtggtcttagaaaatgcaacatttgggcccgaaagcaggactacctgtcttcacctaggtccatgggggtggagccgtagccagggaccacgccctcctttacccagcacttcccttccctccctatcatttagaaggaccatactcttccctttccagtactcctgtattagcatcatgctgttttggttactataaccttgtagtatagtttgaaatcatgtaatgtaatgcctctggctttgttctttttgcttaggatttctttggctatttggactcttttttggttccatatcaattttagaattgctttttctagttctgtgaaaaatggcattggtatattgataggaatgacattgaatctgtagattgttttgggcagtatggtcattttaatgatattgattcttccatccctgaacacaggatgttttccagtttgtttgtgtcaggtacgagtccctcccttcctccctccctcccccaaccctttttttttttttttttttttttgacagagtttcactctgttgcccaggctagagtgcaatagcacaatcttggttcactgcaacctctgcctcccaggttcaagcaattctcctgcttcagcccccaggtagctgggggtaattgcatgtgccaacatgcccagctaatttttgtatttttagtagagacagggttttgctatgttggtcaggctggtctcaaactcctgacttcaggtgatccaccggcctcggcctctcaaagtgctgggattataggcgtgagccacagcgcccagcccacttatttctattttaaatttttacatttaccacttttttgttaaaaattaaaacagagttttgtagttctccttaaagagatctttcatctccttgattaaatgtattcccaggaatattactttttgtgtgtaaggctcttgtaaagcgaattgttgtcactatagtgaacaatttttagactcaggaacttctaaaaccacatagatgcttcagttctgaactctagtgaccttggtgcagtcccaaacaaagatctaacttttacacctaagaatgaattttgagttcatcgaagacctgaagtatttgcaaaaacaaagagaaagcagtcttataaattagactaaactgtaagcatctcaaaaataagtccagtgtttcattcctttgttgtttatagtcagcacgtgcaccaaataagtctttttttatattatgaaacatttattacatatttttatatatgtatataacttctatacgtttctatgttgtgttcatgtccagattgtatttttttttttttttttttgagacggagtctcgctctgtcgcccagcctggagtgcagtggcgcaatctcggctcactgcaagctccacctcctgggtccacgccattctcctgcctcagcctcccgagtagctgggactacaggcacctgccaccacgcctggctaattttttgtatttttagtagagacggggtttcaccgtggtctcgatcttctgaccttgtgatccgaccgcctcggcctccgaaagtgctgggattacaggcgtgagccaccgcacccagtctgtatttttaaattatgtattatttataaataatttcagaagattagtatactctcatttgaccatcaaatctgcaaaggtacttttgttttcttccttcctgtgcagtacagaaagtgagccttttctaatccgtgtcatgtctctccctatatactgtccaattcattccatctttttagtgacttccttctattgactaccctttcttgcagtgtcaactttttaaggaaaccttgtcagtgaattctgtgatctcccagtggccatatccatggtgctttttttttttttttttttttttttgagacggagtcactctgttgcccaggctggagtacagtgccacgatctcagctcactgcaacctccgcctcccaggttcaagcgattcttctgcctcagcctcctgagtagctgggaccacaggcatgtccacacctggctaattttttttcatatttttagtagagatggggtttcaccatgttggccaggctggtgttgaactcctgacctcaagtgatccacccgcctcagcctcccaaagtgctgagattacagacatgaggcactgcccccgggccatggtgtgtttaatgtgcttttaaatacaggagcaatcaaggcttggtagatagggagatgagggccaaacaagcagttgcaaaccactattgcagtcaaggaaaggttaacaatcctttcttagcagaacagacatgggctcgcaggtcctgtcaaatgaaattacttgtcagcatagctacatgcagaatagttcaacagcctggaagccagaaatctgagcttcttcatttcttagttctttcagtgaattgctttgaaatatgttgacatctgtgtaactttgtggactatcacttccgcaactccgtgaagacagagaactcttatatgtattcgcgtattcatagacacatgacaaatggaaggcaagttggctttccctaaaatgcggaggcacacgtgtgatgccttctgctaacactgcaattatgtactcataatctctcattgtaaatagaggcagatgaagccactccagctctacgtcaactctcctggaaagaaccagaatgtaggtcctgtaacctactgagttttcattggcttcatgaacacgtatgtcctgcaatcttgtggacctgtaagctcttcatgcattaagacacattcactttcagccacctcaactttcctaaaagagatgcttttgctgtaaatattctaaagctatttcagtcaagatgttctgaagctatattacttagaaaaatgcttttagtagggaaagtggagctccctaaaggcatcttaatatgtacttatctgctttgcttttttttccccccacaaatggcattcatcaaaataagttaaatagtaatggcttgaaacgtaattgtgctgttgtacgttctccaactgtgtacattcaacaaaccttggaaaatttcagatcacatgaagagcaaattattggtatgttgttggcaatcaggattaagttgccagagtcatgttgcttaatagcttgcttttcataaaataatgatggtgagaagttaatatttattgagtctaccgtatgtgtaatggactgtacttcaggcattttctcatttaatcatgataacaaacctataaactagaaaccactttgaattcctagttaatagataatgaaactaaaaaagagagataagcaattttgcctgtggtcacgtggtatgctgcggtctagagctgggattcaaatctgggcttctaacttcagaaccctcacttatgacctctctacaaattctgctctccccaaaacccatgtcaatcgttagtgtttcaagactctaagcattattctttctatatcaagaaattgactgtatttttagtctccatacttcataggaattcatcttatgattcctatgtttttggatatcctcctctgtatgtttaaccatgatattaatcttgacatgtttcaatgttataatcacagaacaccctaagttgatgttttgcaccatcctcataaagtaaccatgtttgtggtccctctgggcatctatcctgtcagagaattgctctgatttccacttattttcagttcctgcgagtgcgacaaacctctgtatattcttgtgtagaaaaaccagtcctcaggcaaaagtagaataagtaagcaatacctttatcctgttacaaaactaaagaaatatcagcaatttcttcaagagcaagctcatgtcacttcatctgttaatccttcctgactatgccaggtgaagttaaccacgcccaaatttgtgtttccagatatgccatataacactgtaagtgattatactctgcaatgttttaatacatctgcctttctcataagacaataaatacttgctggggggtgggaaggggcatgcttatttctatattcacagatcttagcacagttgctgaggttgcctccgtgcttaatacatggttgtggaaagtagggagaaagtggagaggaggaagaaggggcagaaaaggagagagggagggaagaaggaaggtggggaaggaggaatagattaattacattaacttggagtgtggtttatattcatactagatgttttgatttttccataatttcccatattgccaggataaaaaaaaatcacataagaaatatactccgaatactgcctctgacccagattccaaagaacagaaagaaagatggtcagaaacactgagaactgtcatgtcattaggctttccaggagaattctgtacagcttcaactgtgctcttttagaaaagccaggtgttataaaaacttggttgtttattgacgtattttatctaaaacatggttttaaagtgtgtgcgtgtttttaacctgataggtagaagctagaacagctgccatttaaacattgccatcagttttctatcttctataatgtggaggcttaaattcccctttggaacaagtatgtcaatgttttcagtgaaccatctaaatggacattttagttaacacaaagtgaaagcaaagtctgtgctctgaaacggagaggtttggggcgaggcaggggaagacaagctgcaggtgcatctttgctggttctatctccattgatgacggagccctgggccggctgctgtgtgctcctgtggaggtgtgcgtggaaacttccgggcacggaaatctttctttaggaaataagcagtaggcaagagatggaagaagctgcttcctttgagagactctgaggagctacgggcacaagcattattgctttagggagctggctacaaaatggagcagtgaatggagggaaggacgctgtccaaagccacacagagcccagcatgtctgggcacccacaggcattggcttgggaatattgggagctactaacctggaagtggatattggtgttttcacatgggggacccgtagcaaagccaagagggtggcgtttgactggcttcagggtgacagcaaacagtggacatcgcccaggaggagagctcaggaatgaaacatggcacaagccatgtggaaaccaaagagaagagggtgctgtgaacgcacatttcctgagctctttggagagtcccataaattattactgtggtgatgtttagaatgataggatggaatgtaccagaaattcaggtggaacaaacatatgtcattggaagtttagcatcaaccattaaagtgactgtatttgtgcccaaatacaatcagaactcctgtggcaggccagttatttgccctgcccttactagtagctcccagttctccctgcacttcagaatcacccaaggagctctgcagaaacaaacccacccacctccacccccacacatgatacagagaaattcagtcactgggtctgacatttctattttttaaaaaagaaaactttccaggtaattctgtcttacagatacttttattaaaaattgggttaaagtttgcagaaatcaattggggatacgcaacatcaaatatttaccatgaaggacctttcttcaaggttgtattttatgtctctcaatcattagtaaggcaagttcctgaagttaagggatgtggctttcacatccttgtatttcccacaggaggtaatgtgtggggaaatgaaatgcgtacttgtgctgctgaaatggcctatttgctcatcccagtttcctcgatggcaccgtgcaccgcactctagttcatccatgccagcgctctttgctctgctgagcaaagttgttcatgaggtttggctccctctctgctgggattttgcctcatcctttattctcaaccttgaccctgtccaatttgttcccactaaacgccataactttgtatttgcttaattgtcctggattatcttgggcattatttttgttgttgttatcattggaaggtgttaacaactccttcctagtatacaccataatataaaaacacattaattatgacatctcagtaatttatgaaaatagcaaatgctagtcccatgctttgtgacaggatcttgctctgtcacccaggtgggagtgcagtggtattatcatagctcactgtaatctcagactcctgagctcaagccaaccttctgctttagcctcctgagtagctgttactacaggtacacgctatcacacccagctaattaaaacaaaaaatcgtagagatgggctctctctatgttgcctatgctgtgctaaaacacctggcttcaggcaatcttctcacctcagcctctgaaagtgctgagattacaggcgagaaccaccgtgcccagccgctgcacctttctgttccatgtttttctcagaaccccccaaatttcccagacagctggctgaaacttttaatacatccctacaactaataatgccactttcttcccactccttgacaaatgatgttgcctcccatgttactgcagctccccgttatctgcccatctccactgatgaaatcactgctgggaattagaggtactctgaatgtaaaacggccccagttactggaaagatctcagaaactgtcattagtcatggctgcctcatgctctcatctggctggtcttcttaatgtcactgtaacatgtcacagtgatttgcatctttgcacctttgcaggaagccccttcctttcctggaatcaagccttctttttacccttgtacagttacaagccttcctccaaccttcatggtttaaggcctttccagcacttgccaaaacccttccctgcacactccctgttctaagtgcaactttttctgctgtctcagaatttgggcagaggctctgagtctgagaatcattgttcctaggcagttacagagaatgaaatgagagacctgagaccctgggctcacaccctgaagacaagggagcaaggtgctttaagaggaccgcagagagagagctctaggtactggaatttgtggatgtacaggtgatggacaccctcctggagaattaacgaaacatctctatcaagagcagattcttcaagagtgcagtctatgaatactgttcctgatcattacctctcctcagctcactccagcccctccaccctaattctggaggagccacgaaaggagtaaatggggaaggaagaatgagagaacaaagaaattaaaaagaaactatagcgcatttcctcctctaagataagactgagtggtgagagaggaagaagttgacattacataagtaacactttgatgttggccaacttgacattttgataatggaaaataaacaatgcagctgagatgtccagctcggatgtcctccaaggcctgagaaggacaattctagagtgatctaggaatggtgagaaagcctttggcttctttctgcacacacctttccaagggcacctattttttttttttaatgataacaaatggtgacaagaatatatgttatcattcaaattagactgcatgtttgaaataattgcccagagtgtccatctgctgctgtgggtatggaaggtactcgatcattattggttgagccccatcctccacatccctctcaacatctaatccttttttttatctctcataggcaagagcagcatttatagtcaaagcttatttacaaatattatgatgcaaaagtaagattatattcaaaaggctgccaaaagagtcacttttctttttcttttctttttcttttttttttttttgagatagcatttcactcttgttgtccaggctgctgtacaatcatgcaatctcagctcactgtaacctccacctccaaggttcaagcgattcttcttgcctcctgagtagctgggattccaggcacgtgccaccatgcccaactaattttgtatttttagtagacacaaggtctcaccatgttggctaggctggtctcgaactcctgacctcaggtgatccaccccactcaacctcccaaagtgctgggattagagttgtgagccatggtgcccaactaagagtcacttttttgtggatcgttgcatgtcctgaggatatatgaagtcaggcaacagaaagaaataccatgtcaagataattcagaacccagttagctgaaagcttgttctactaactacatgtgaagtaatgttctagttatttcagctgtaattccaaattcaaaattgtttacaccctctggttgcctttgtactcatggataaaacataactgtgtcatcaatattatctggctcataacagcttgctactaatgctgcaaggttttcaaacagctttagccgacagcacaagcagcgcagagtttcttaagggttaatttaaatgtttatatttaagaagcatattcatctccccttacaatatccatcagccatcttgcataaatgtatttctgctgctgtcataccactctttggagaattttatttttaacaatgaaaataataatattttaaaaccaccaagcaaaaacaaggcaaatatgatcataagattacctagtcatatacttttctctaaaaaccatacctattttgttctgtagaaaaggaattctaaggcagagatgggagtgaaggagagaacattttaaaatcaggagacaacagaaaacatgtctgaatcttgaggcaaagtgggggccactttgcagcctaggccagtttgtctgtcaaccacctctagagaggacaaaataatttcatgtttactagctactatctgctggttatcttacgtatataacctcattccttctccttgaaaatactgcatgattatcgcttcatatcgatgaaaaaagcgaagctgagagaggttaaagtaaaatgccaaggttctgcagtatagctaacggtcactgctcttggctcctttttcagagaaagcatggctagaagatcttgaaagttacagaaagccccatgagacaatgactcatctctgatgtgtggcagaatgagaaaccacacttacagtggtatcctcatcactcttccattgaaatgaacccaatgctcccacatgcaatccaacgagagataaatatgacaaaacaaagaaagctgcatgtttgaagtgctttccaagatgtcttaccacactcctgattgggactgtaatatccaagaagcttgacccaatttctctgagatcctggctttcccctaacctgacactcttgttttattcttggtttagagaattcttgcccaatctttctgcctcttttattccagacactggctcctctctcagctgtctcacatgttatgaatgatctcgcctccatcacttttcacagctctttacaagtgctgaccatggatcatattcgagtgtatcagggtctaggacaatgtgtttacattacagaaatatgactggctttcacccttctgaaacatctctttttatggaagacattcattgataccttcagtcttaaaaacttgttggcatagaagaacaggaaactggaagaggagttttttacttttatacttttatttgctaaatgtgttaaacccttaaatgtgctacatatgtactataaggaatgcacaccattggtcaactatcataatttatgctctgtaattcacaatgcatactttatatatatgtgccttagttataactaatatgcttctttttttctttaaaaataatatagatcaatgatatttaatgtttaaaggaattttaaagatcatctagccccaaaatatcatttcgtaggggaatttggtcaatatctctttaaagaggtagaatggaaagccaggttcctgagttctaatcattcccagaggttctcttgtagttaaagcatgattttttaattaattagctttcatcttagaaatcgttttttatcataaagctaattttcagacatttggaaaactgtgtgagttatcaacagatgaaattatgctgttcactcatttaactgttcattgtgtgttttccttccatcttttctatcttgtttatttattaatctccagaatttagaattatgccttgaaaacaaatatttgtagaatgcatgaatcaatatgcaaagtataagaaaggtctctctttgaattctgacatagccctatgaaatattataacatggaagctgccctttgatgtaactggtcctaattaaatcaattcagataatgtagtataaacgatctttgggaatacagtatcataatgtttgaaagttatgaaaaataaaggggagcagcaaatatgcatttttaaaagctatacacaaaattggcctcgctcacagggtcattcaattgtgtgtgtgtgtgtgtgtacacatacatatatatatatatatatagagagagagagagagagagagagagagagagagtgtctactacatgtcaggtactatattagttactttatatatttagcacctcagagcttgctgaaaacaacccttatggaagatgctattattattccctatgttaaaagtgcagaaactgttttcaaggtcactcaaaaagtagtgctggtaaaacagctagaaactgggtgtttcttgctccaatgcctttaaggctatactgtgctgtcttcataaattgatccacaataggtagagacaagtagaaacaagcatatttcctgcagtttattcatttccttcctatctgtttttgcataaagtttcacttataaaaattacacaaaacttgaaaggtgaacaggagatattaggcttagaagaattccttatgatgaagaacactttggtactgattttgttaacacacttttccaagtagccttataaatcaaatagaaataataattttaaaaaccctaatgactcaacatacttcattccaattgaaacctactggatacatgtaattcagagaacagattcttctcagttaactttatccaagactctaactttttcagtcaggaaaaatatagcccatatggaatgttaaccttttatcacggaattatgatttcatagcttcaaattgctggtccatgaggaataacagccgagagcttacatatggaggtaacaaaatgttaatgtcttagtccttttgcattgctataaaggcatatccgaggctgggtaatttaaaagaaaagaggtttagttcgctcacggttctgaaggctgtacaagaagcatgtcaccagcacctgcttctcttaagagcctcaggaagcttccactcatgatggaaggtgaaggggagtctacatatagagaccacatggcaggaagagaaagacagacagagagaaagagaggaaaggggcccaggccagagagagatatatatatatatagagagaggctaggctctttttaacaatcagttcttgcaagaactcatcaagtgagaattcactcattaccttgaggaggcaccaagccattcacaaagggtctgtccccatgactcgaacatctcccaccaggccccacctccaacactggggattaaatttcaacaaaagacttaaaggggacaaatatccaaactgtatcaactaaagaattaattttgggggtgctaggttttctcagaaactaaaaaatgagatataacttgccattatatgatctgtgtttaaagtacattctctctcgtccatatttctccaggatgatatgcttaacttaggtgttaaaaataagtccatctgatttattttcaaacttcataaaaaattatagatcatgtagaaaaattaatctgtgtgactagtaaaagaaaatgtgacagcaatttggagaatttactatagcagatattaaatatgttacaatgtattaaatgttagagggatcaaaataatacagttttcagggcagaatgagcagaggaatggaatagaacagactcgagagataagaccctcaaggttaatataataaaaagatgagatttatttcaagtcaatggggaaacatgttttattcaataaatgatgcataaaaagtaatttgtagatttttggtgagaaataagtaacattagattcatagaaacccttcacactaaaataaaatctgtatgaatcaaatatttaaatgttttaaaaagtgaaactgtaactagaaaagattttcattaaatatctccaagtgtagagaagatcctcctaataatgataacaaagacataacgccataaagaaaacaatacggccgggcgcggtggctcacgcctgtaatcccagcactttgggaggccgaggcgggcggatcacgaggtcaggagatagagacgatcctggctaacacagtgaaaccccgtctctactaaatatacaaaaaattagccgggcgtggtggcgggcgcctgtagtcccagctactcgggaggctgcggcaggagaatggcgtgaacccgggaggcggagcttgcagtgagccgagatcacgccactgcactccagcctgggcaacagagcgagaccccgtctcaaaacaaaacaaaacaaaataaagaaagaaaacaataattacatcaaaattatagtttaaataattttgttttgagatagagtttcactcttgttgcccagggtggagtgcaacggcaggatctcggctcactgcaacctctgcctcccaggttcaagcgattctcctgcctcaccctcccgagtagctgggattacaggcacctgccaccacgctcggctaattttttgtatttttagtagagacagggtttcaccatgttggcctgacttctctggagcttctgacctccagtgatccccctgcctgggcctcccaaagtgctgggattacaggcgtgagccaccacgcctggccatctgaaataattttgaaacgccttaaaaagacctgaaaattaaattacttactggtaaacatattttcaacatgtatgacaagaaatggtttcatacaagaatatatgaaatggtcataagaaacaaactataagaaataatttcttatacttactgtaagaaacttttatctataccgtgcaattataataaaagaaaataaccataatagtaagcaataaataatgaaaatgtattcaagcttcctagtaattggagaaaggcaattttacatgagatgtcatgtttcacctaaataattggaaaaattaaaaagaataaaagcacccagtgttagaggatgcaaagtaaccatactgacatgtagtttgggggaaagtggaaattgatggaaactttccagggtaccttttggaactaaggactctaacacattacatgtaaaatattttgccctttgcaactctactcccaaaattatatttcaaaaatgtgactagacaaattactagagatgtgtctaaggaagatcactaatgtgctgtttttataatgaaatgtagagcagcctataaacttatcaatgcaagactcttcaacaaaataaatgggatgcatcaccaaatgtgctcatagagacctgtatctcttgatatggataatgagcacattatatgaagtaaaagatgcaagttataaaataatacgtgagacacaaaaacaggtgtatgtgtatgtgtccgtgtgttttcatgtgtacacacacacacacgcacatggaaaacagacttggaagaatatgcacccagtgttaatagtgattatctccaggcggtttgattcaagaggttttaccctctgctttttttttttttttggttttgagacggagtcttgctctgtcaccaggctggagtgcagtggcgtgatctcggctcactgcaacccctgcctcctgggttcaagcaattctcctgcctcagcctcctgagtagctgggactacaggcacacgccaccacacccagctagcttttgtatttttagtagagacagggtttcaccatgttggccaggatggtctcaatctcttgacctcgtgatccacccgcctcagcctcccaaagtgctgggattacaggcatgagccactacatccggccttaccctcctctttaggtgaaagtacgttggctaatttttttttcagccaacattatgtttttataatcagaaaatgcaacatttattatgaaaataattcaatgaaaatgaggtataatagttttaaattacacatctagtatgacatttaaaaatgtgtggtattctggtaataatcatactggcacacagttctgaaaaaaaaaatagaaaccaataataaaacttttcctaagccattatgaccatgttattttttcctccagatcaactggtatagattattatctatgtcataataatctgttatataaaatgcaaattaagtacatttttatttaagaaaattacaaatgttacagtttggtacaaagttattgtcagagccacttaatttgaatacatgttatttgtagaaacggcaattgactgtgtaggaattatggcaaattgattgtagtctttgtggaaaaggctggagaatgccaccttctgaaatcaaacctagtaaaagtcaacacattataacaactatggtcataataactacaatttattgatcccttacaatgacaggctctgaagtaagcactttataccctttatcagataatgcttaaaacagctgtgtataatagtcacctatacatctgtatcaaaatatggaagctcctagggttgcaaaggtttcatctggggccaccagcctgtaagtatcataacaaaagttcaaatcaagtttctctactgtctgagctattgtctactaggctacatactaagcttcgtctcttttagaggaaaactacagaaaaataaaccatcagataaaatcatttgtaaatatgtcactgatgttgacttgaaaaatatgtacttagaaacctaagagaccagggtataacctcaggtagacatgataggatcacatttgatagatatataacttcatttcaatgccttgggcatgaccaagttgtgcaattagtaaccagcaagaggtggagttgacttgaaagtccttgctggccgggcgcggtggttcacgcctgtaatcccaacactttgggaggctgaggcgggtggatcatgaggtcaggagatcgagaccatcctggctaacagtgtgaaaccccgtctctactaaaaaaatacaaaaaatgagccaggcgtggtggcggacgcctgtagtcccagcgactctggaggctgaggcaggagaatggcgtgaacccaggaggcgcagcttgcagtgagcagagatcgcgccactgcactccagcctgggcgacagagcgagactccatctcacaaaaaaaaaaaaaagtgcttgctactgtttgtctgacaccattcaatgcaaagatatactttaaatatagaaataattctagccctgcctgaatgaactctctttcaagatcacataactctacttcggatgctttgatcattgctatggtttggatatggttcattcggccccaccaagtcttctgttgaattagatccccattgttggaggtggggtctggtgggacgtgtttggatcctgagggcagctccctcatgaatggcttagtgccattctcaagggagtgaatgacttctcattgttggttctcctgagaactggttgttgaaaggagcctggcacctccttctctctctcttgtttcccctttccccatgggacctctgcccagaagactcctcttcaccttccaccatgagtggcagcggcctcaggccctcccccagaagcagatgccagcgccatgcttcttgtactgcctgcaggactgtgaactagataagcctcttttccttataaagtaagtactcaaccttaggtattcctttatagcaacacagactaaacaattatcattgtctgttgctaatttgagccccctttcaataaaactatgacgtacacacacatatgcacacaaacagacagacagacagatgtatatatcaaagtgtgtatagtcttctgtataacagcatgatcacagagaacactgtggaaggtatgcccgtcatctactgctattcaacaaaccaccccaaatgttagtggattaaatattttttagttcttaaaaattaattttactggtaaatttaaacaggattaaattaaagcagcatttggtgggcactgcttgcctctgctctgcttgacaacagctgaggaggtttaaaagctgggaggtggaattgtctgaaagctcacttgttctcaaacacgatggttgtcgatgcaaagactcaaactgctgggagctggtacacctgggttccttagccatctctctccatttccatgtgcctttccctctggtctctccagcacagaagcggtaggaaacctgggcatttacaatgttgtttgggggctgctagtgtacaggtcaacaaaagaggaagttagatgctactttgccttttatgatttagcttcagaagtaacagcataagttctactgttttctgttcttagaaacaagtcactaagtctgacctaggtctgtggggagggaaattagaaccacttttttttttttttttgaaatggagtttctttcttgttgtccaggctggagtgcaatggcacggtcttggctcactgccacctctgcctctcaggttcaagcgattcttgtgcctcagactcccaagtaactgggatatacaggcgcccaccaccatgcccggctatttttttttttttttttttgtatttttttgtagagacggggtttcaccatgttggccaggctggtcttgaactcctgacctcaggtgccacccacctcggcctctcaaagtgctgggattacaggggtgagccaccatgcctggcctagaaccacatttttgatgtatttatgaacctgcagacatatttttaaagaaccacgcaaggatgaatagcttggtaacattgagggaggtcaagttagtggggagctgcccaaggagaacagtagtgaggaagaaaaacaacaagaatcagacagggacagagtggagggcaggagggaaagtcatgcagctgagagggaagatatgaataccatggaacgttgggaagccgaggtgggtagatcacctgaggtcaggagttcaagaccagcctggccaacatggtgaaatcccatctctactaaaaatacaaaaattaacccagcatgatggtatgcgcctgtagtcccagctactcgggaggctgaggcaggagaatcacttgaacctaggaggcaggggttgcgaccagctgagatcgcaccactgccctccagcctaggtgacagagtgagactctgtctcaaaaaaataaaaaataaaaatgaataccatggaattggagctgttcccagagtataaaccaataaatgaacatcatggttcatagtctactgtgtattagatagctcatgagttcgtctctttaagaactgagttgctaaaatttagttcctgaacctgtaaacatttggactcatggcaattcttaccacttggtggccattctcttcaacatgtctttagccacaaagcactatttgatggagagagtaaagacattccatttcttcagctcctcttaaagctccaaatgcctccaggccccacccattcccccacctctctctctttctaaacagagattggttctcaccatttcaaagggtttaggttgttactgtggtttagtttagctttgctttgttttttgaggtccacctgtcgtatctgtgacagaatttgcaggaggtactccagttgtgatcactgggaagaaaatgcggtgaaatcagactaacccatagttctcagtatatcattgcatggcttctaaggaaccacaatttaaacagtgcatgataaccagtattaatggattatagcccctaaattgtaacaattgtgactttgtagactcctaagtatcttctggtttgggtaacctttctattatttgctttcttgggatctgtcagttacagtgtgcatttagtcccgtacgtgtggctgacatatcctatcctagagtggccacttgtttagaacagttctattgatcctgcatgttccctaggaggaaacacaaggccttgctgagaaggctctcaagcttcactcccatgcagtatagtttacatttctagttttgtgatttagttctcatggagccataggccataattactcagctgtaatgaacctcacaatgcatcaatgcattcttctccatttatatttgcttttatttgaatgaaataaattcattcaaataaaagcaaatataaatggagaatacattcacaagatgttcacaagaattataataacataaatgaaacaaacatttattttattgaaataaaagcaaacataaatggagaaaaatgcactgactatggttcatgactgaaccatagtccttatttatgagacacagtcttgctctgttacccaggctggagtgcagtggccaatctcagcccactgcaaactccacctccggggctaaagcaatcctcccacctcagcctcccaaatagctgagattacaggcatgtacccagctaattttttttttttatttttcatagagatggggtctcataatgttgcctaggctggtctcaaactcctgggctcaaacaatactactgccttggcctcccaaaatggtggggttataggcatggtccactgtgcctggctgaaccatagcccttttaagcattgaatgcatttaaaatattttcattgttctatcaataaaatatccacatttaaatgcaggccttataataattaatactactcactattaaataccaaattagaattgattctctaaagtgtcttcatatattgtacattgtgctaggtaatatgagttttaattgcttaatataaaattacttaatggcacttataattcttgtgaacatcagtataagttttaataaaatggtagaagcacatggagaaatggttctttgattgttaaaatagttcatttttataaggcaggtaagaaattagtaagttagataactacattagtccatttgcatgctgctgaaaaagacatacccaaaaacaggaagaaaaagaggcttcattggacttacagttccacatgactggggaggcctcataatcatggcgggaggtgaaaagcacttcttacatggcagtggcaagagaaaaatgaggaagaagcaaaagcagaaacccctgataaacccatcagatctcgtgagacttattcactgtcatgagaatagcatgggaaagaccagccaacatgattcaatgacctccttctgggtccctccagcaacacatgggaattttgggagacacaattcaagctgagatttgggtggggatatagccaaaccatatcaataaccctgaggaaaaaatcacaatgctgggatccagaaaaatatagatgtttttgaataaggtttttgaataagaaaaatctccatatatacacagttagataaacccaacagaacatccttcagttttgaaagccaaggaagcttcattgaatcctgtgtctgcataaatgatcagtgaaatttcaaaattcactgatgtgcagtcttgcttcacaaatggacaaatggagatgaacagaggccaatggccatggacatagaaggagaaggagttacagacagaatcccaaactctcaatccagtttctcaaactgtccagcatgtagttgctattgactcaattgtcctttggaaaggatgaagtctcagatagtctcaaagttcactttacatagtaacccattttgtctcccctctaatattttgaaaaggtaacggcaacagaaaagggtcctcagttttctaggaagattgacaagaaggaagcagcaggaagagaaaggcaggaaaatcttcatactggatcatccatttctagcgattatagataacagagttgctgataaagatagaatttcagtcaaccactaagcagattcccactgaggaacaccctggagaaacacgaacagtcaagacagaagaccaccagatggctgatcttaataacccaataaatacaagaaaagagtggcacttctacccagttctaaacgaacatctcatttgtatgttgtgttctgagttttagggaagacaaaaatgccaattctaatttacctttattcacactttgccagggattcaaggaaggcagaaaaaattgtacaaaataatcttttgtttttgttcccttcaagattctcttttactctttttgttccttatgccatcactccaccacaaccatactacagacttcgcaactgctgtctcagcctttgaaacacctaaacttcaacatgctgagattacgcctattacgctaatgaacttctacaggaacgaacaaacgaaaaggaagtaatgcaccacctcctgtttctcagccatcaccacctcccaggtgcttcccagagcagttccctgctgccacggggctcctgcaggagctcctccctgctaggcatgtcctcaacccctagtcatcaagtctagctcagcctctgcatttcagctcaacgtctaatttcccagcgtagattccaggcagccgccctgtttcatgtcctcttaacatcctctgcttttctatctcatcttccttcttgacaagttcaaagtcatgaggactggatagagctccatcaaagcagggaatgttgattttatacactggagctgagtgggcagtctggcacagagcaagtggccagtaggattacggaatgcatgaaccttaattttctattcctttattcctgtcatttcctgtacctcacaaaatgttcccaaccatgccaacatcaccacctgtgaaaatcccaccactcttcccttgggcctcacctccatgaagtcctctttgatcacctttgtgttttctgaactccataagcactttctatgcgtgtttcacatcactcatgatatactaacttgtgttatttcctctgccctattcacagagggaagtccttgcatggtccttcacatccaatcttattagcatttaggtcatggcataaaaatcatcgtttgcctacacgtctcactccatccccaatttttcccaaactatgaaagcagtgaattcaatactcgtttttctatcttagtgcttggcacagaagagatgcttggtaagctttttacttgctctgcggaatctgaattgcagccatttttgtgaagtcttctctactcggctagattcctacatcctgaaagtcagtctttgttttctgcatagtgactagcacaacaaatcaatgtgttataaaagttatctacatttctttcaatggaaagatgcaaattttaaaaacgatcttttgcttttccactcttgaaacataaacattttctctgtaccttgtaaataatacttgcgtaagatgatcaccactgaagttattttcccaaaccctgagtattaaggggaatgatgactgcctacttgaggaagctcagatgatccgaagatcccaaactatgttcctttctccaagaaacattagtggaagggagtgtttcaccacatgtgggtcaacagtacgtgacatcgtctcagttgtgatttgattctccatatgcttataatttccattctaaatctcaagtttggtaaactggctttaagggatttttgccacatatatcttaaaaactaaattttactgtggctcttgataactttttgagagctagcttgacctgagtaagacagatgatagctccttaatgaccgccatcaaggcatgatgaagtgcgggtccctgggagccatcaatcacctgctggaaggactaggagggctgtttcccggccgagaagcaggcctcaatctcttggcccattactctcacgtcttccttctattcttctcactccattaggctcctgtgtatctgcactgaggctatctcagagtgacctcccatctctaatccttgatatttccatttgggtctaatgtaccatctcgattgaaacatttgggaaagcttacagcggtatttaatctttctttgctctagttctcagaatctcatttataaatctatttgaaattatcttttttgtatctattactatcttttccagtagatcgatatgtactctctcctaatctaaaacctagtggtctagaagcacacctctttctgagtaattgtgataaagtgctttgttgtttctttgttttcagggcctttgtctaaacctgcaatgcaaccatcaacacagcctcggactgacacgtttggcttttgaatcattctatggaaaggcaaaaaacgaagtaagacttttgaagcctctggggtttataaaccggtataaaattcctcatatttgaatatgttgtagtaatatgcatgattttgttctactgcacataaagtgcgatacaaactatagaacagaagatcgcagatcatcaagtgtaaaaaacagctgacattcaccttgactaggagtttcctagaacagggaagcaagaagtatgtattttggaagctgcatattgctggaaagatggcgtcatagactaaaccaaggtcatgttctgtgatagcagtgtgaacactgttatttcacacgtgcagattctctgctacagccgcactggttctggcacctggttttcttcctctggagattattttttcatgtagcagtttacaaggaatctttaacactaccatgaagaagatggctgttaattcaattttccaccaggttataaaagagccctgatgaaaaagaagttatgtcatggttatctcacagaaaaaggagaattaaattaagcttagggttcataccatcattgacacttttttccatgggaaactaatgcgttttcatatacaaacgaaattttgattcaaatttgcaaaatttaagctaattctgtaataaaaatctatcttctaattttaaccttaacaattaaaaaaaaaaacaagaaattttttgttatcaagtattcaaaacttggtttagaaataagctgtccttgagtctgaatgctggattgggtttttgaaaaatgttctaagaaaactttctagtttgtcaccccaaattgcatgtcagacaacagagaacactttgtcacgcttagacaccattcaatcataatctgagtttgacttcaaagttttcacaattcaattttgtttagaattaagaaaacatgactgtggggaccaacgtaagggcaggcagagcatttctcttcagccaaacaccagggcagaaggaaaaggggagtgaatgagtccatttgtcctttacctctgttttcattttccactctctacatttaagtgtccagctgctctttgaccacagtgggacccctcaaagccacaaaggctggaattgcttaaatatatatttggagatgcttgtgctgatagttattgtacagtgcagacgagcatgggcaacacaagaatatggagcccacggctctcatgctgtgcaaatgaagaccgtcatttgtgactatctcagggacacttttcaatccaagagcatttcttaaaaacaaaagcaaaccaaccttttattgttattagacaccagaaaaaaaaaaacccaaaacatacagttcacacatgaaaccatcctgagaaattctgagtctcattttctgtgattctaatgaagtctaaaacaacaataaaaacagacaaaagaaatacagattccttggaggatagtaatttgatcaaactaaaacattattaagaaactttttggacataaaatacggaaatgacttctgacataaatcacaattgctcagtattaggagacttatttgctattaattttgtttcagtcaacatctctcaacaacatgaaatcagaggtgcagaccatgaatattaactttcattcaaactaacgttccagttggcatatactgagcctaagagggggaaagtgtgaaaaatagattgcatgttgagtaagatgaaaacactctatttattatactgagtttaatagttacattatttattatagttcaggggatagttttaagtatctaatttcatttgaaataaatcttggagttattgtaagaggtgttacgctacttgttctgataagaaaaaaaatgtttgatgtataagagttgaactccagtcaaaatcaaataatctaaaaaagaaaatgttattttacataacacttcaggtaaattctgcctctcaaaaatagatgatatataaaaaatattatagcttgtgtaataggaaatcaacacccctcaataagaatttctttaaaatgaccttggtcatttattactttaaagagatcacttaaattttctttcttttttatttgagtaaatacccccatcctaaaccctactgtgtgactgtcaggtgtgagggaacaggcaaggttcttgcagttggctaaggggcacctcattaccagaaaagcaccactgaaaccacaggtctcggaggggagcgttggatgacagtggacctcagtgttacgagttaggattcggaactcagaaataatgctcaggcactaggacttcagggttttccttagcctatgtgtgcccaagtaagagaaacacacatcccccagtacacatacaaacacaaattattgttttaagtttttaaggccagtgtgtccaatcttttggcttccctgggccacataggaagaagaataattgtcttgggccacacatataatacactagcaccaaaaatagctgatgaactaaaaaaaaaaaaaaaatctcataagagagtttacaaatttgtgttgggccacattcaaagctatcctgggctgcatacggtgccgtgggttgaacaagcttggtttaaggtatcataggtaaattataaaatgaagatcgacacagaataactaaagtcttatgccatatccaaagttgagttaatttcactaacggagaaaatcctaattgatttcatcccctttttaatctcaagcatatatcctttgagctgaccggaattctttttataaaaaggtaagaactaatagtatgctccctcctaaaataacagcgattagcataaagctgaattaggttcaggtttctctgtctaaaggagagttagggtcaagtttgtatttgtactcttaaaaaccaagggtaaactttactgctatttaaaactatctactaagattatctttaagggtataaatattaattaattaagaatatattaggaacactgctattttaagttctaagtacatggatattttgtctaagtgatagaaattcaaaattttaataaacttaaaatatataaaataaattatatatagggtccaaaatactgtcaaaaccttgactttagaaaatacaggagtcagagtttatatttagctgcattgtgaaaatgcaatccagaaaaatggttttaagagagagtgaaagagttgagctcacactgaacacttaacttgagctagctattgtcatggttagtgctcaaaccttcagtcccttcacttaacaggcatttagttggtgtttattaaatacagaagaaaaaatatagttggatatgatgcttccttttcctaccttgataagaatatctttgggtatttatgatccttaattccctgttcaaatacaaatttagctacactccaaatatctgctatgtggtaccctttcattgttgtttgttcccttatttccatttagatcttaacattgactcagtgatttgaatgtccacgtgtaacagatttttagagttatatttttgctattgatagttaaatttcttaatgtcctaaaacacgaccagttgttgatatcctccagttgccgagtgactctctcctgatgtcgtgggctcactggtggtacgaatcggacgcgtccttcctaagcttgtactgcaggagccctcaactccacagagagctgtgttactctctctcccaccatggtgttaaatttatccacatattttgttaattctgacaatgtttccttagtacattttgaatccgtgttactaagatcataccattttaaactgctttatcttcctgcgttactaaacctttctaatcctcaaaacctcaaaagtctccttttcctgggatgctgaacatatttttcctcaaaacctcgcatgtctccttttttagtaatgtttccaccctctcctgaaaatctattttatgtgcaattaaaatggtatcaacagcattcttgagttaatacttgcctggattattactttccattcttttactttcgatgtttttctgctcacatgttttaggtatgtcttttgtaacctgcataaagccagattctgttcctttaacccagtctaagagtcattgtctttcacatttcagttagtgcatttccatttcttttcatttctgttacatgaggttttacttgtgccatttttgtgtgcactacttaagttgtcccattttcctatatttcaccccctctctttttttttcatctctcaatttggcattttgtatttcagttctatcccttgaatggttatactagacaatgtaggttcacctctaactttgagggtttaatgttgacaatgactagactgaccaagtgactggtccaggaattgcttcccaggaggtcccaagcctgaggttccaataagggcggggaagataatgaccttggcacagggaccatgacctttgaggacatgactggctgtctctcctggagaaggggcttcctaccaggcccagaggagcgtggtccatgcggagcactgaagacctttgaactcgagccctcgctgggacttgaggccactcccacctccccccaatcaccgtggccacacagctggagttgatgagaagccagggtactgaacagcaaggactcgaatccagccaagacagggaggcccagctctgaacctataaacacatggtgttcggaaaggcctggagaagcagcagccattatttactgccagaaaattcacgaggcaagtcccatatgtgttaggagtgtgaggaaccacacacgtcctacaagtgctgcaatgacaagaaagcatccaaaattccccccatttggcaccaggatctcctatgcaaagaaaggtcttttcagtgcagggaagatgaggaaacctggagccaaagctgtcgcctccttcagaattccaaagtccacactgcagaagggatttgttggggaagccaggctgagaaagttcccactcactcagcacggagaattcacacccaggagaggccgtctatgcgagattcttcagccacgctcaggccttaagcatcccgaatgctcacactggagagatgcccggtgagtgtaatgtgtgaagaagcttcatttgtcacccggaacttcacaggctaacgggcctcatgagcaaagccagcgtgggggactttccgccgcaggtacaccctcgggagtgcacatcagagatggtcttagggctgctgtgcacgcgcctccgcatcctcgttcaggaacaatgtgttcctgcctgagaggcgagcaggagcgtggcctttgtgagaaaggcttcggtcatgatgcaaccccatgtccagagcacccatgccaagggccacagagttgtgaggccttcgggggcgatgatggactttctgaccttccctggaacccagggtgagttgtcacccccagggctgatgggaagaagccttccttcctctccatcctggtggggcagctgccgcccccacatgatcaaagaacgcagcctctagtgtcacccacactaccctggagcaaatccagactgtcctgtgcacagaactggcctaatctggacaaggggacccaaggggtgtcagctggaagcttctgggcaaggcttccttgtcccatggattttaaagtctctatgtgacagctgtgatggcttcaaacagcctatgagtccccttatttgtggactgtggtatccaaagtgggcagaagttgccctagaacaaatcccccaaagataccaggaatgactgtgttattagatgagatcgggcacgttcagggtggtatggccgtagacaggaatgactgtattatcaaactctatcctccatgttttttaagttctcttttattttttaaatctattatgttctggctgcatttaggataatttttttcaggtcaaatttcagatctaagttctattttctctttttacctatgtcttatctgctgttcagcccatttagtaaactttgtgtcaattattataatttatatataattctagaatttcaggtgtgtgtgtgcttgtttaatttgactggatatttccaatcgttttgttttgtttttttaatcttttattttttaaacatattaagcatccttatactctatccttgatgatttcaatttctatgttctttactgttttgaattctgctcactcttattcaccatggcttgtttccacatatatgttgtgatttttctgattgttaatttatgttccttgaaacactgagaaaattatttcaggactcctttgaaagtacagggctcctagaggatttgggctactctcagcccagtacccaggactacaactcatgactgactacattaaacaacattctagacccaggactttctgtgccgcacaggaagagtgaatattggccccaaactcaggtttgagttatagatataactctaacattatacacataatgttgtatatatgtataccatatacatacatagaatgttgaccctaaaaacttgtaagcataaacccatcggtttgtacttacaagtttataggggcaagattctatgtatgtatatatgtataacacatatgtatatatggaaacatagatgtatatataattatattattagatgcaattatatctacatattatgtatgctataatatatacatattacatttgtatacatgtaaacgtatgtaattacacttaagaattctgccctatgaaatacgcactctaatttcatcctggtaggaaactggcaagactgtgtgatacctcaaaaatctgtgagtgacatacaagtcattatctttcttcaggatttggatgaataaaaatctgttcgtagtccctagccctaggctggtggagagtgactgtttattgttgcccactgccatcctggtatccttccgatcagccagcagattggcaagagaaagctcctctcatgattctcgctcaaacgctgtacctgttgctgttgacagactctgttcctgagagaaggtattaactgccagctggctctgacagtttgggaactaaggctgacatttgtgctggcagcataacagtatttacaactcaggaaatgtatacagttagattacgacggagccagcgagttttgaggttaaaaaaatacaacaatatacatgtgaagcatgaccataataacaaaattaacttaaaaataaattcagagcttaggggttctttcaggaaatatctgcggtctatgaaacatatggcatatatgtgcaaagagagaaaggattacaaagaacagaggatggtaattcaattacatcgccggccacccatactatattttgtaatagtccactatgtcagaaaattactaaagaaaggtagaagtagataaagcagaaaaaaaaatcaattttgaatgatggggaatataaatataaaatatcactggagcaggagagaaggtgaatctcatgcttctgtaatttttcttttggaggctctgcactggctctccttttctcacctctccttttccttctatggatataactttgcaatgagtttaaattggcacatttccacacggtccccccaaatgattaagtcactaggaaagtgaccctgaaaggcaggggcacaggttggaattttggtgaatgtaattaacctatttaaatatcataacacttttggcaaacattattagatggaagaacagtcagttgacattttgtctctaatttcctggcaaacagtgaagatgtcatcattttcttgcaataagaggaatgaatgtgaccaggtacttactgcactagtcccagggcagtgtggggattggcattcaccactcatccggtttggaattaaaacatcatcccagcaagatggaccctttgggaaaaaacaacaatatatgcttatatgagttataatagaaatgtactccttaagacatgtttccacttatgttataaaataatagtgaaattagtgtgtagtccaatgattttcaaagtgtggtctgcagactctgggggtccccgtgaccctttcaagggatgtgctaggtcaaaactatgttcatcaacatacaaagacgatatttgacattttgctccaaacctgttcgttttccacttatagcctccccctacggctgaggttaaatgcaccttactagaaaggccatccctgactttgctccacttctgtgtctgccctttcaggcttcctttgcttcataataattattactaccatccccacccaaccccaccatgcagtggcccagcacagagcaagggctgtctgtccctagtcaccacagctacacaaaagccaacttggtctgctctgttccctgaggcatcccagcacctagaggagggcctggcatcgagggggtgcgcagcaagcttccctaggcatcaaagaaataaaaattcaataaaagcaacacttcttttaaattagagaagatcatttaaaatgaaatatcagtgtcaattattgcattcctcttggaaagcaaaccagtaaaaagcatcacaagcattcaactggttcataactttttgactaaattttaagaaatcgggctgtgcacggtggctcattcctataatcccagcactttgggaggttgaagggggcggatcacctgaggtcaggagttcaagaccagtctgactaacatggcgaaaccctgtctgtactaaaaatacaaaaattagctgggtgtggtggcacgcgcctgtaatcacaactactcaggaggccaaggtaggagaatcgcttgaatgcaggaggcagaggtggcagtgagccgagattgtgccactgcactccagtctgggtgacatagcaagactccatctcaaaaaacaaacaaataaagaaacaaaaaatcaaaagcaaaaggcagataggggagagggcacaggggatcaggagcagcaaatttccagatcctcaaatcttctaaacagaaagttcagaccatctacttggaaacaaaaatcaaaatagaatgtttaacttgcagcaataccttcaatttcaacctaaaattctgtgcctgacctaattatcaattaaatgggagaatgggaaaaagtggcttggggagatgcaagttggaaagttggcttgtatgtctgtgagggctcagggttcaggaaatgatcagatgcctgaggaaagccccaggtggcagcctggacctcctcaccgtgggtggagcagtgaggtggccacgggaggggcggagtaagaggtgggttgtctccccagctgtgacacagaaaggaggaggagggagggtggcatcaagggctggaggggattgacagagcttccaggagacgtggtatgaggccactgcccagtgcaaggcagaaggttaggactcaggggcagaggctgtggtgattttactaccgacgacgtttggacccagctagtgtttaagttgtaggagctaaatcggtcatcacaaggcccatctctgcttcaggaaccagtgtagagccgccctggcactttgtagcagatgctgaggaaaatgccgtgggaggtgggcaggggttcacagccacccctgccagtctgcaggagtgctccctccctccctcctttaccattacatgtgtgcacacacacatgcatgccacacactcacatatacatgcacataccacacacactcaggcatgcacgcacacaggcatgcacgcacacagcatgccacacaccacacatgcataaacacaccacatacatacacgtgcacacacatcccacacacctcacacaccccacacacatatacccacatgcatgcacgcacaccaagacacaccacacacgcacgcacaccaaaacacaccacacatgcataaacacaccacatatgtacatgtgcacatgtatccctcacaccccacacgcctaacacaccccacacacatacatccaaacacatacatgcacaccaagacacaccacacatgcataaacacaccacgcacacacgcacacacacacaataccacacagcacacaggcatacacatactacatacactcacacactcatgcatgcacacacgcactattctagagaaaagtcggggacgcagagcagttctccaggcctgagccgtacctgaaagagactgagccttttgacggaggctctttaccccagacttcaaaaggagctgcatctgggatccaccgatcattaatccaaaggccaccgcttaatatggaggtaaatttgcagaagagttctagcaggactgaagctgcgatggtttgaaaagcctgctttcaagcttggcccttggctggcatctgggaatgtgaattttggaagcgtccacatcattcccttactgctacgggtggtgtgcagagcctgaactgtctgcacaaaccatggctatgcacaacatcttctcaccctcggcaaggctggaattttgataagccccaggcagaggtgtctgcatgaccagttcccactaaaatcgctgggcactgactctccattgagcttcctggcagacaacacttcacacgcgttgtcacaactgagtgcctctcgagtgaccactgggggaggactcagagccttgcctgcggtttcctctaaactcctccccctgggccttttcccctcgcttcatatccttttgttgtagtgaatcttagctatgtgtgtgacaggacagcaagtcctgcaggctctcctggtgaatcactgaatctggaggggggaggtggtcttgggggcccaggacatgacgacataggattggtgatcaaggcaatgttctcccaggcacataggagggtcggggctcatcattaatatcacaccagtcacaaagaacaagccgtttcattttctttgcacatcccactgtgttcacgataatggaagcacttatgtgattttcaactttagagtaacactgttaaaactgaacagaggatgttaattatgattatgtaaccaaatatatatgttattcagcttggacaatataaaagcaaaaacagaaatgtgaggacttggaaggcagaagtgaggctggagagaaaacagaaaagtgctgatgaattccctgacctgccaagctgtttttattagaaggttgtctgcacctttgatttttaaacatgagcatatattcactcgataaaagttacaaatgtatagaaataaaagagaggaaaagaaatgatacctacgaccttgatcacgttcatcagcctcatttttctggcttaaagtgagaaattcagtggagataaatgtggctagaatgcagtctgctacaatgaatacactttttaacgtgaggacctttcttactcctatacaaaaactttgaactatagttgctttagccatgcaacttctggaacactgtgtacgacgattaggcaatttaggttttatattttctaaaatatgacaggagcaaagttaaacgtgctttgtaatggcatagattcactgggacatttgtttctattttctggatagtcataacattcatactaatagtgtgagtagtgtggataaattagcatgtctattttattatattgaattcccatattcaacagaggattttaattatgattattaaatatatatgtaatgtacaaattacatggcaaattgcaaatcctttgaggggaacccagagggcacatcttgcccctttgtttgttttaatgtctgtttctctgtaggttgtgatttgttctacctttacggacactacaaatcagatttctctcttttttagacaattaggaaaactttagagtcaaatttgtggaccagctcttgcaattttacataaatcataatacacacttcgtttaccaaaattacccttggcttcatattactttcctttgatccctttcctcatctaatttaatttttcctggttttcatctgcatgtatccctgcaaggttgtcacatcattctgaaacgagtcaggggataattaggtaattgtcgggccttgtgatgtaacctgactgacagctctaacaggagccgtgctccctgggatggtaggtcatctcgcctccagggacaaggtgatctctggccagatgcctgtgccaagctctggctctcatactgtggctggtggcaattcccagtgaaccacactgtgcttgaggcaccgaaaagtccctgcgtttaaaagaaatccatttcgctgtggttaaccattaactaaatgggacaacattgcttctcttctctggaagttttttctgactgactcatgacacatgcaatggtcaataacacacctacgtggcaacagccaagaaggagcactaataggccgggcatggtggctcatgcctggaatcccagcactttgggtggctgaggaggatggatcacctaaggtcaggagttcaagaccaccctggccaacatggtgaaaccttgtctttaataaaacacaaaaattagctgggcatggtggcgggtgcctgtaatctcagctacttgggaggctgagggaggagaatcgcttgagccagggaggcagagattgcagtgggccgagatcacaccactgcactccagcctgggcgacagagtgagactctgcctcaacaagaaaaaaaaaaaaaaaaaaaagaagtagcaccaataattaaatgcaggaattagggcccagttatattttgcttcacagagtaagacttcttacctcaaagtctagaattcagtgagacttttctgtgcatatcacagatgtttattttttcatatttaaatttttactgccctaatagcaactaaaatatttatggaacaattcccgtaattgccacatcaggtactatgttatctgacaaattcgtgttctacagagacattatagaaaactcattcacacattcttcttgatttcaaaccataacacaatggtgtaagtagtaaaactgaatggaattcttttgaatctgggactttaacacagtaaaatagatgttagtttatgcagctgctcacactaatagtgtgaatgctatggctatcctgaaagcagaaacaactgtccaagtgaatttatacccttacaaagcagatttaactgtgctcctgtcaaattttggaaaacataaaactttaattgcctaatcattgaacacagtgttttaagagttgcatggccaaaacaattatagttaatagtttttaaatagtagcaagaaaggtcttcagattaaaaaggactgcaaaaatgcatggcagtagaagggagctatggatgataatacgtcaattagagaagcaaaaccactatttcatccctcaaatctaccgaattagagaaagatatctgaataaaatgtcacatagtctaataggaaaaatttggctggtttttagagaacgttctctttttttttgcctagtaatgacgataaccaagaaaaatatataaattattttagcaacactagcagggtgaggaaaccatgggctgctggccaaatcccaccttatacagactctgtgctaagaaatgttttcatgtttgttaatagttgaaaagcacaaaaagaagaatgtttcgtgacacatgaaaactatgagaaatttaaaattcattgtccataaagttttattggcatatagccacataaagcatggttgcttgtatgctacaatgagctgttgcaacacagacctcatgaaccacacagcctatcacgtttactgtcgggccctttatagaaaaaacttgccaacccctgatctacagcaaattaaattttccaaactcatactgaaaagtactcttttatttttaatattgtggcagcactttggctaacatataatcgcatatgtttgtatgagtaggtatgtcctgggtctcaagtgagaaattacaatgaaaaccttagtgctgttgacctgagaattccgagaagacggtgatagagaagcagcaattgaatcctgggattcatcaaattgtttgcatcagtaagtggaaaatgacaactagagatggcatttgaggactggtcctgactaatgttactgtctatagaaaagcgtgaagcaaatattacctaaacacgtctatatgatgcatgtaaatcagaaatacagaaaaatgaccccacagagggaaagcattgataaaatctgtaacatgtgggttttaaaatttattttcaaaagttctagaactcataatctgaaagccattttggctatgtctttcaatgcccagaaaagtggaaaattgaagtatgtaactgactatttcatatccaaatattattcagacacagtccagactgacaaaacaaaataactatttttcttgagttatctaaataaatgctataatctgctcatcatatgtgagtatatgcattgatgcttaaaataaattgctaattctattttccaaaatgttaatagaaaaccatggcatttacagtttttgaaaaatgttatttaatagtaattttacttaaactatacttaccctattatctcatcttgtcatcgaatatgaaggatttcaaatattctcttgaataatccacaaacatttaagccacataattaagtgtcagggactaaaataattttgtaaatcatactaaggacataatacaacaacagcaaaactatcttgaaaaagctgtacccagaagcttgagtcctcccttgatgtttttctatctgtgtctgcaacaaaatgatacaaagaaggagctttgaagttcacaaacctgttgtatttcatttctaccaatgactagctatatgttcccgagctagttgcatggacccattccaaacttagtactcttcatctgaaaagtaaggaattaaatacctacttcacagagtgtgcatgaagattaaatgaaacaacacaaatacaaacaacactgtgcaaaggcaacacaacaaacgcctttacacagttgctggcacatagagagttaaaaaaatggcaactgttacaagtattatttcttatttctcaaaatagaactgcctgaagagggttatttttggtttagtaaaaactgagcagtaagaagccctttccaagggacctggacccacggcccagtgggtttctgaatttatcctttttctcaatttccctattatccagccctccccaggatcatgtcactttctacagcatgctgtttataactcttctaaagcatgtatcgccctctgtcatatagtagacactgacactgttctgagcatccatcttccttcatttgatttaaagatcctacactgtcacaaagccaagcacagtgccgtggttagagcagcagcataataaatgcaatcattaaatagtaaccaggaaaaagaacgaaaaaaattcgttaaaccaaaatattcatccacttaccaagtatttattgttgctcttaaaccctgagactgcagttataaaaaagggagaataatcgcttttcttgtagactttctatagtagctacaaaaaaatggtattacaaatgaaccaatcacatccattaaaatgagtaagatttttgaaaatgcccatgtaaaagacaggcaagttggaagacaactggaatatacacactgttggtgcaaatggaaaatagtatagtcactgctgaaatctactaggcattctttttttaaagtaaacataaaagtaacatatgactcagttattctactcttaggtagtcatgtgagataaatgaaaatatatccacacagaatgttgcaggcaagtgctcctaacaattttattcatagcaaatgtaaactggagggcacccacatatctatgaaatatttcatctgactggatagacaagatgtagtatgactattcagtggatgaccactcaagaataagcagtgtcctgttacctataaatgcaacaacattaacaattctcaaaatcagcctgagtgaaagaagccaaacatggaatatgtggcatgattccatgtatatgaaatgcagaggtcgcttggggctgggagcacagagtgggaacaagccacataaacacataagggttattttgggggttatgggctgaactgcatcccctcaaaatttatgtttaagtactaacccccagttcctcagaatgtgaatgcatttggagataggtcttgacagaggaaattaagttaaaatgaggtcattagggtgagtcccaatccaatatgactgatgtccttaaaagcagacgaaaggccatgtgaaaatatggggagaaggtggccatctgcaagccaaggacaggggccttggaaaacaccaagcctgctgacacacgttgatctcgacttctagctgccagaaatgtgagaaaatacatttctattgtttacgctttccagtctggggtattttgtcatggcagtcctagcagacaaatatagagggtatggaaatgttctttatcatgactgtgctggtggctttacgttgttatgtacttgtcagaactcctcaaattgtacccttcaaatagagaaagtctatttacacaaattattctcaataaagtgggtaaggaaaacaatgaactgagcaattgacaaggaaactcaataagagacagaggctctctgtagcaaatgttgcttgaaaaactgaatataaatatctcactcaatacagaaagcaaatgggaacttctttataaccttggaacaggtagaacttccttcttgtaaggacacagaaggctctaatcccacataaaggaatgtataaattgaatttcaatgaacattagagctcatcaaaaacactaaaatatgactatgcaagccacagacttgggaaaatattagtaatacatataattgtaaaataagtaatctcagagcttataaagagctaatataaaggacacattaataatacagacataaacacaccagttaaatataagcaaaaaccttgaacaggctattcacaaaacaagacgtataagtggccaataattatataaaacgatggtcaacatcattaataacagggaaaatacaagttaaaatcacaagatacaatttcacttgatttcacattttagccactatgataatactaaatgtcggtgaggataaagattaacaaacgctctcatatatcattggtggaaatataaaacaaccactttgaaaacggttttggaatttctttctttttttttttgatacagagtttcactcggtcgctcaggctggagtgcagtggtgcgatctccgctcactgcaaactctgcctcccaggttcaagtgatactcctgcttcagccttccaagtagctaggattacaggcatttgccaccacacccggctaatttttgaatttttagtagagacagagtctcaccatgttggccaggctggtctgcaactcctgacctcaaaagatccgcctgccttggcctcccgtagttccgggattacaggcaagagccgcagcgcgcagccctggaatttcttattacgttaaacatatagttaaactatgactcagcactttcactccaaggtgttggtccaagaaaaatgaaaatacacacacacacacagagcaacatagactcgtacaagcatctaacatcacagccttactcatgttaacccaaacctggaaacaagcaaatgtcctttgacagtgactagaataaaccatggggtctcacatagtggcagactcagaaatgaaaagagagctactgagtcacacaaccacatggatgagtctcgaaacaaaacaccatatttaccaaaaggagctggccatagaaaagtatgtattatatgattccatttatatgaaatccagcaaaaagaaagattaatctatggtgataaaaatcagaagaggttatctttggaatggggaggtactgactagaaaaagagataagggaactttctggaaatgttctacattttggttggggtagtagttacatgagtgtatgtaactgtcgaagcttttagaattgacacagtgcattttgtagagtgtaaattgttctataatttaaaataatagactgaatctcctatcccatccttcagtgatttcctcttagcttttggaaacaatagtctgtgatttctgttataagataatccaagtcactgccaatcaacacaaaagactaaccagtcctagggctttgaactggttactaaccttcatcatcaggctacaaaactcttaaagtcaaggactgtgtcctacatatatctatgtgctttgctgtgaatagataaatgttttacctaaacatagtgaatacacaagaataattaagtcagactttaattttctcatctgtaaaataatgaaaactgaaaaatctgtattttcaaagttacattttcttttaagcagggtactttcattacatgaaattgtctatagtaaccaaatacataaaacaaataaagctgacccaatgtggttgaagaagaaggacgagtccccagaattctcattaatggcctcttttctctttgtcccatgtgatgcccttaagggccctccccacagaaaacaatttgaaatcctaaaagtctcttacaataatacaccatgggtatgctcagagaaaagtccacagtggtaaagaatctggcagaatatggttgaatcaaattgtattagggttcttcagaggggcagaactaataggatctatgtgtatatgaaagggagtttattagggagaattggctcacatgatcacaagatgaagtccaaggataggccgtgtgcaggctgaggaagaaagaagccagtagtggcacagtccgagtccaaaagcctcaaaagtagggaagccaacagtgcaggcttcagtctgtggctgaagacctgagagcccctggcaaaccactggtgtaaatctaagagtccaaaggctgaagaacctggagtctgatgtccaagggcaggaggaatgaaaacatccagcatgaaagaaagatggaagccagaagactcagcaagccagtttatcccaatttctttggtttgctttgttctagccatgggggcagcagactggatggtgcctacccacattgaggatgggtcttcttcacccagtccactgactcgaatttcaatatcctctggcaacaccctcacagacatgccttgaaacaattcttttctttttcttttttttttttggtcaatttttaaaaaaattatatgttaagttctagggtacacgtgcacaacgtgcaggtttgttacatatgcatacaggtgacatgttggtttgcttcccccatcaactcgtcatttacatcaggtatttctcctaatgccatccctcccccagccctccaccccatggcaggccccagtatgtgatgttccctgccctgtgtccaagtcatctcattgttcaattcccacctatgagtgagaacacgcggtgtttgattttctgtccttgtgatattttgctgagaatgatggtttccagcttcgtccatgtctctgcaaaggacatgaacacatccttttttatgactgcatagaattccatggtgtatatgtgccacattttcttattccagtctatcattgatggacatttgggttggttccaagtctttgctattgtgaatagtgctgtaataaacatacgtgtgcatgtgtcttgatagtagcatgatttataatcctttgggtatatacccagtaatgggattgctgggtcaaatggtgtttctagttctagatccttgaggaatcgccacactgtcttccacaatggttgaactaatttacactcccactaacactgtaaaagtgttcctatttctccacatcctctccagcatctgttgtgcctggaaacaattctttaccagctatctaggcatccttcaatcgaatcaagtcaacacctaatactaaccatcacacaaatccttaaaaggccatcctttattttctctctctctcttttaaggaaacacatattagctgtggctaacatatatgttcattagaacacatatattatgctctttgctatggtctagatatgtcccctaaaattcatgtgttggaaactgagttcctaatgcaacagtgttaggaggggggcctaatggaaagcgtttaagtcacaagggctccacctgcatgaatggatcaatacccctaagaaaggagcttgcaggagtgggttctctttctactgctcttcgaccatgtgaggacacactgttcctccctactggagcacatagaattcaaggtgctatcttagaagcaaagagaccaggccttgacctgctggggccttgatccagaattgtgagaaatagatttctgttctttttaagttactcagacccaggaattctaatatagcagcacaaaaagaactaagacattcttaaaatacttaattgaatcactgatacagatcacatgacattatccaggtgaaacagacatttgtctttatgttgtggcagaagctttcagttgtctcctctcttcttttatggtaacagaatttctgatttatagctgagcatatgactccctggaaaaatgactctacctcccagcttcccttgcctgactggccatgtaagtgatgaccaacgggatataacagaggtgtcctgtggaaacttctacttgtccttttcttcatccatttttttttctctcctgtttgtaatatacatagtgcatcttgaaccacaagttcaaggttatacaacgtagagcaacaatatagaaagagtctgggttcctgtcatcatgaagtgccacagcagccttgaaccacctatctaaacttttacatgagagaaaaactgaactctcacattacataagtcactgttactttgaatttttaagatattcactgtcaaatccaatggtcattattattacaattaaattaactttgttttgatagaaaaatcaatggagcacacaaaacagtagcaatattctatgatctaagaaaccaacaagaattttcttttacatacatgaggatgttgacataggaagataaataagtcttttggaagacaaaagtaaaatattacttataatacatcagggaataagaccttatttatgagttcatgagtttttacaattacagaagttgaccataaaacccaaacttttaaaaaagcattgatcattttgatgaaaatctttaccaaatgtgttctatagtccatccttatttcagcagattacacgcgacatgcacatgatgacttagctttctaaaaagagcaatggtgtaacgaatatatgccacttgccagaagccatagttaataccatatgtacacctcatccctagtgacctataaacaaaacaaggtgggcagtgccacagccttttttacagatggagagactgaggcttggagatgctgagatatgtccaaggctacaagtttacaaagtaacaaagtccatttatcataaaagtatttgttgttttgttcacttttcagacacagttttaaaaaatacatgtcaaataaataagcattttttatttactgttttaccatgaactacagtgaaatccttgctaactgtatctctttccttcagaggccgatgtcggacagatgtcaccgtcatgtcaggatggtggacattttcctatctggtgggtaggaaatcagtaactacatttactaattatgaaaacaccaccaagttaagattttgttacaagaaatgtgtacggacatacatttttagaatatatgtcaatatctttatactcctttggcctctttgctgataacctgcttttcatttagttatttcctgagttttgtaggtgtttttcttttaaagtctttattatcgacaggtttttccaggtacattacttcatttatctcagaaatcatatgagacattatacttggcatttcttttctattgctgtgtaacaaataaccacaattttgttgcttaaaacaacatgcttttatgatctcacagtttctgtggggcaggcctggtgtgacttctgctcagagtcccatgaggcccagtcaagatgtcggctgggctgctctcttccctggagactccattacagcaaaactagcttctaagctctctcaggctgttggcagaattaacttccttgcagctgtcattacaagggcctcggctttctgctgcctgttggctggaggcctcctgccgttccttgccatgtgagcttcctcaccttggcagttcacttcatcaagtcaacaaggagagggtctgctccagtctccactgaatccatcataagtaatatcgtcaggggaagtcttagataacataattggcacggtcagggaaatcaaatcacttttgctgtattttcttggttagagaaagcaatttcacatgagcatgtacaggaggtggtgggaggtcactgggccgggggggtgggggtcatcttcatgtctgtccatgccccgtttaacaaattaggagaaggagctttcataaaattaaagtttcagaaatggtaactcaatatataacattagttgtcaagtactcaggctatttttcaaaaatataaacacatgtttcagtttaggtacgtgaatatttgaacacttccttggagtcctccttttaaaatttcaaataagtcattttatagcttgggagatgatatggtttggctgtgtccccacccaaatctcaacttgaattgtatctcccagaattcccacgtgttgtgggaggcacctagaaggaggtaatagaatcatgggggctggtctctctcgtgctattctcatgatagtgaataagtctcatgaaatctgatgggtgtatcaggggtttccacttttgcttcttcctcattttctcttgccaccaccatgtaagaagtgcctttcacctcacgccatgattctgaggcctccccagtcatgtggaactgtaagtccaattaaacctctttttgttcccagactcaggtatgtctttatcagcagtgtgaaaattgactaatacaggagatattaagaaataaataccagatgtaaccagaaactgagtttctgtttattctggcatgttaaactttacaagattagaatatgttacacaaacagaaacatgtcttgctttaatgagtgtatatattcctttctaacttgaatttattccctatgatttcttagagcaagaacgtattatagaagcagttaactaaaaggctcactacggttaattctgcagaaagaaatagaagtttacagaagttaattctgcagaaagaaatagaaaggattaattgttcctaagtaagccaagttatctctacaaattgtttaaaacaaatattagaaggaaaacaataattaagagaagatcttaagaagacacctaatctagttcttattaatatttttcatttctgattttgatattatatgaataatgaaaaatccctcatttgaaaaaactttatatggtatacaggacgcaagagaggcaaaaatgatttttgtaaattccagccagtctccaagagactatgatcataataaaagcaatggcaatggcatcaccttgcattagtataaaacaggtttgtctacaaatcgctttcacatgtcccaagccaaccttgatttccagtgaaaatctgttaatgctgtgttctatagagctctgagccacacatggattacttggtcatgtgttgataatttgttcatgtgtaactgcagaactgtttcccaacaaaaccctggccccaagcccaagtattcactgggttctcacatgtaactacttgggtatatcttgatgattacatcatgcattttcataagagtatccattttatctaacgatttgttaatcatcaaaacaaggatcttccctcattttgtaatagaacaactgaagtccatgcttttcttggaaaatatagtcatattttagtaaaagtgtgatcacaaggctgggcagagttagctgggtaagtttgactctgctctatgtggggtcagctcggatggttcagtgggactgaatggtttcttttcaacgtggctcttttgcatggccgagtggatgctgaatataagctgaggtcagtgggctggtgttcttagttcttcttaacaagggggtgccctagagcagtggcccccaatctttttagttgtctgtcattgtcaacatgcacaggtttgacggaagacagtttttccagggacccagtgggatggtttcaggataaaactgttccacctcacatcatcaagcattagattctcataaggagcgtgcaacctagatcccccacatgcacagttcacaatagagttcttgctcctaggagaatctcatgctgccactgatttgacaggaggtggagctcgggctgtaatgctcgctcgcctactgcttatctcctgctgagtggcctggttcctaacaggccacccctgctggcccagggcttgggcaccgctgccctagggcacagtaggtgctttctaaaggtgactaccctaagagagaggaagtagaaacttccagtttcttaaggcctgagcctggaaatgggcagagtgtcatttctaacatgttctattagtgaagcagtcacagagctcagatgtgctaaaagaggttggtatttaaagaaaataattctaacagcacatcgtgtcacgttttcatctggcatttcactggacggtattcgacatttgcagtttaatattttgtgcccttgagcactgccacccttaggaaggtgtttggtgctgtccatgccctcatctgtgaaatgggggcagagacagcaccaaacaccttcctagtagatcagctcttcttagcctcatctcttgtcactctattcccagcattttccccactttctgacaatgtggcccattttgattttcctttattgttattcaaagtaccttagtaatatatgctttattaaaggcctttagataatttaaatatcatgaaacagtaatgtatctcatggaatatagtttacagacacctaaacaatacaacagcactaattcttctggttctccaaaagttccaataggatccctcttaaatttccatcaggtcatgggcatgggcagacagtatctgtgaacttatcagtggattccaattattttactgaatttaattttttttttttttttgagatggagtctcgagctgtagcccaggctggagtgcagtactgcgatcctggcaaactgcaacctctgcctgccgggttcaagtgattcttgtgccacagcctccgagtagctgggattacaggcacatggcaccacacccactaatttttgtattttttcagtagagatggggttttaccatgttggccagcctggtctcgaactcctgacttcaagtgatccacctatgtcggcctcccaaagtactaggattacaggcttgagccaccgcacccaacctattttacttaattactctagtttctcaaagacactcttcatttctcctagtgtttggaatcactaccaaacactatcataaagttctgaaaaagcattcattgttgctaattttaagtcattgattttttaattcctttaacaaataatgagcatctaaaaagtgacacacattttgccagattgtggggatggaatactgaaagagacttttgcacgtcaggaggataaaagtgattacacaggctgggcgcggtggctcacgcctgtaatcccagttgcttgggaggctgaggtaggggaatcacctgaaccagggaggcagaggttgcagtgacccaagatcacgccactgcactccagcccgggtgacagagcgagactccgtccaaaaaaaaatattaaacaggcaattaatactgagactctttgagggtatattggagggatgagagacctcgacttctgagagagctgggttttaagctgagagcagaggaatgagtagcagcagtaggttttgcgggaagaagtagtattctgagcatggagaacagaagaaaattccacaagccctgagcctgattcttggaatatcgatcccaaacaagatgatttctcagatactgacaattaatccataaataatccatttttattcgtgcaatttcctaaatatctccatccataccactagtcttgataacacaattcaattgtaatatacatgtaactgtaatgtacacaagttcctgatttcaaagcaatgaggatgtcaagatgataaacagtggttttgtgctttggtatcagaatgactgggtttcgaatctaatggccactaccagccaagtcaggatgggggtgtttctgaacatcaattttatgatatgtaatgtggaaataacaattgcacgtaacaaacaggactgatagttaaatgagataaagtagttagcaaaataccacacgcatagtgaatattcgataaacgttagtgggtactgctgaataaccacagtagaacaatatcatcatggaaagaactcagtagagaaagactcagaagatctaagttcaggatgcaatttcacttgagtatcacctcatcgatttaacatcctcatgcttcactatcttatctgtaaagtgtgggtacaggccaaaagagctcagggtcaaataagataacaaatgagctaattaatgtgaaaaccattgaagctacagcaaacaggtcacacagatagtagtaaatgaatgaatggagcaaggggtagtcttgaaaccgtctgataggagagagaattgtactcacgcttactcactttataacaaccccaaacctgggaccactttcaagtaaaagtgaacttaaaacacaatgctgcagctgctgttggcctcagcgttaaccagagcaagtgtctattcctgtatttattactcagtactgccaagttaactcaatggctgcctaaacagaacatctcagctggtcttgaaaattttcccaagtactacctctatagctttgggtttttttgttgttgttttttgtgtgtctgttttctgagacagggtctcgctctgtcacccaggcttgagtgcagtggcacgatatggctcactgcagccaaaacctcctgggctcaagcgatcctcccacctcagccccctaagtagctgggactccagacgtgcatcaccacacccggttaatttttatactttttgtagagacaaggtttcgccatgttggccagactggtgtggaactcccgggctcaagcaacctgcctgccttggcctcccaaagtgctgggattacaggcttgatgccctgccctcagccctctacagcttttaaaacataatttggcagataattcacttccaatacaaaaacgtgtttggtatcataaaaagcaagcatttcataatctaatactcaataccataatttacccactctgagaaaattatcacaagaaaaaagtcacatggagaaatgcaaatcaaaatcacaatgagataccatctcacaccagttagaatggcaatcattaaaaagtcaggaaacaacaggtgctggagaggatgtggagaaataggaacacttttacactgttggtgggattgtaaactagttcaaccattgtggaagtcagtgtggcgattcctcaaggatctagaactggaaataccatttgacccagccatcccattactgggtatatacccaaaggactataaatcatgctgctataaagacacatgcacacgtatgtttattgccgcattattcacaatagcaaagacttggaaccaacccaaatgtccaacaatgatagactggatgaagaaaatgtggcacatatacaccatggaatactatgcagccataaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgttgtgtggtggggggagggggagggatagcattgggagatatacctaatgctagatgacgagttagtgggtgcagcacaccagcatggcacatgtatacgtatgtaactaacctgcacaatgtgcacatgtaccctaaaacttaaagtatatatataaaaaaaagtcacatttcttaagaataattctcattagtgtaagtgaagtgactcgtcctccacgaaaatgcagctccgctgggttttgacacagtcaatcaccatcattacttaccgagtccctccatgcagggtgtacctatgttaaaccaatgaaatgccaacaacgcgtttcccccttcacaacttccagtcaccaaactattcctgaaccacaagatgccttcagttatattactatgtgttgacagctttgctgtaggtacatcacagggatagcagaattgaaacagcagtgattttttttgttgttccgtttcatagaatttaaacaatggagacaataaagccttacagatctggtgattcacatgaacgcactcttaacggatttaatttaggagaaccatatgattatcttcgtctgttcaagcttcctttactaaaaatagtctggctgttgcatggaggaaagtttgctgtagctcagattagaggcagtttcaggcagcaaaatatgtttctagctgttgagatggtagcactcatttcaattcatggcatgtaaatctatttgaataatatttatcatcatataaagattcatagttacctcagctggctttatgatcttgataattatgactggaactcaactatgcttattaaataagaagtttattagatttctagtgaatgctcagataccatcatcatcatagaaatattattatttagttctcaaaattaagctttatgaataacacatcacattttggtgtgtagtatagtactctaactccccacataaaacttaacttgatcgcctgcatttatttttaagaaagggaaaggtacaaatcacatcggattatggttaaaattataaaaagtccacattgtatttaattttctattgcttctatataatgtactgcccgtgaatatgtatcatcaatctgggctgactatcttgaccactggtcaacaactatcttgaccactccaacaacgttttggagtggtggaggtgagaaaggcatgtatcactgaagtaagaagctggctagataaggacttagcaaggactataaggaaaagtgcttttcaagggtcctaaagggcaacagaacttaggccccccagtgaaacattaaacacgtatgtaacgagcaggcttccaatcatctgagagctaatgatgctaccatgtatttataaggtacatttatccccatcttttcactgaaccgtacacattgtgggcaggggttcctattcttgccccttactgtcctggggtttgtagacatgaaaaaagaaaggcttgcttttttttttttttttttttttaagacagagtctcactctgtcacccaggctggagaacagtggcatgacctcggcttactgcaaccttcatctcctggcttcaagtgattctcctgcctcaacctccctagtagctgggattataggcatgtgcccccacacccagctaatttttgtatttttagtagagatggggtttcaccatgttggccagactggtctcgaactcctgacctcaagtgatcccccagcattggcctcccaaagtgctgggattacaggttgcaagccacctggcccagccaaggaaggccttcttaatccaaaaaaaaccaaataagatttggccaaaagaagagtcactttgtccttggacaagtatgttggcaaagacatacatattttttaatttgttttaacatggtctggtttaatacacattgtatagatgttctagtctataaatttccctctgagccttttcacttcaagatattccgatgcctctttcttgtttcctctcttctatctttcccccgattgtgttataatcaaagtccaatcacctctaaaaatcattcaggcctgtttctttatgatctaatcagagagaagaggaagtcttaattttaggtgaaaactaactaaatttgtagtcatctgggcattcttagcactgatttaaaccagctacagtttattctgaaacgttttaagtttctcacaggtttccgcaagaatttccccaaattattattttatcatttatcctccttttagatcgatgtttttgacttaataaaccaacttttcttaaaatttgctcttgcaatgtacatggatttcatcaaatgaagtggaaaagattgttgctgaagaacaaataagctcttgattataaatcattgactttcttaactttttgacataataatattttcaggggaacaattttcttcccccacatgcctgtcattgctcagagaactgcaactcccatcttcttcactcactcatccacaacgccgtccacacactctctgcatgatgagtgtgtcacttcagtcagagggaagagagtgggcaggctgttgggactgcaaacccgtgctcagattccccagactaccttcaccaggaacgtggcagacatggaggctggtgacccaacatccatttccctcttggttcaaaagatggaaggatacagttcattgaaaattgttcaaatgcacaaataattaccactgtattactgttacctacagcattcaatatagtaacatgttgtccatgtttacagcctcagagcaataggctgacctattctcttgctctgaaagcctaggtgtctggtaggctacagcatctagctgtgtctaaacacatgctatgatgttcgcacaatgacaaaatcacctaacaacacattgttagaacctatcccaccacagttcagcaatgcatgactgcacttctactgccccatgcacgtttgccactttatggctgtttattttgttgatggagaaaaattagtgcaagtaaaatagagggacctggaggaggtctcttataaattgcttgtgattattagctgagtattctttcaaaatagcccatcccaccactcccactactaattttatctattccatgaatgattaatttttaacaaaaatgaaaaatccaggatggtttaggtaaggaaaaaattaagagttttctttaaaatgtttattttttattcatggctgggcgctgtggctcaggtctgtaatcccagaactttgagaggccgaggcgggtggatcacctgagatcagaagttcaagaccagcctggccaatgtggtgaaaccctgtctctactaaaaatacaaaaattagtcagtcatggtgacatttgcctgtaatcccagctaactcagtagggtgaggcaggataatcacttgaactcaggaggcggaggttgcagtgagccaagatcacaccactgcacagcagcctgggcaacagagagagactctctctctaaaaaaaaaaaaaaaaaaaaaattattttttattcacaatactagcatacacctacatttcaactgattatagcatatgggataagttgaaatttgatattccataaacctttgggtcttttatgttaacagctcaaactggcttcattaaaaaaatgtatggtatcagccaacagatcatgggttctcagcatctgaagaaattcaacgttctctcatttttcacggttttaacttctcatgactttagtgcatggatacacttgttcagttgtatcccatggcttctaacatctgactatgcttcttgagatcagtctgaaagctgaggcatgttcatacttgatcttgaaacatgccatattaatacatttattcatagaagtattagtaattgtgatattattcaggaatcaaaaaacaaagggaaacacagagcttgcttgttatcccaaattatgctctggtttaaggaaatctttccccgaaatcatgttacttaattttagctaatttagatgacatttaccattctcttacctaaggccaagaaaacagttatattttaattagaacttagtgtcaaacatttttaagtttgataaaaaagccacttttctgggcaattttgcagggcctcattttgattccctgttacctcaaaatgactaagcaaaggagagctgtattgggtatttatcaagaaaactataaataatgtattgggaataaatgcgtgtgccacaaaccataaacttgtaaaggctttctgttctcctggtgtgaataagatagggacatcacaactcggagccattaaatgaaaagaatagggttactaagcaagattattaatacttaataattaatacttaataattaataaatactttaaaaaagattaggtaagatttaatttaatagatcagaccctcctttacagtctgtcttcacacaaaatcacaaagtcttacgtgactcaaatttcttttgaagtcatcagaggttgccattctggaactcataagcggtgacagctgatagcctcacagtcatgaaggaggtagaaaagttaacatgaaattcccaaagctcagcactcgagccttttcagaagctggatggaaatcgctgttcacagctccacagcccctgacagcatcattctatgagaacaaggtcaagtggaaggtgtagcggaacacgaatttgtagtctgagatctcaaggaaatgaagcaatctatttggaaaagcaaggacgatagttgggaaccattagcaacactacagacagaataggcagatactccgttgcccaactcaaaagggaattcatattctccaaatcctgacctctagctagctgttgttcttgtaatttgtaaatcggtgtcctcttttctatacccaaagccagcatcttattttgatacatcatactcccttttggatgactgcagtaacttgtcaactaattttgtgctgtccttctcagttctctcaaatgtattcacatacctgccggaggaatatttccaaagaaaaacaaaaccctgcccatcccctgtttaaacccctctcatggttcccccttatttcaggacagtttatgctccctggtccctaacacagctcagggagtcttttctcatctgcccacttccctccttccccacctctctccacccaccttattgtcaccctctacatagaaatccacaggcacacctataaggaaacatagagttatgcgtgattttgaatcttcctggaaactttctctgcttagaaaatttttttactttctagggtctttcaatcagaaggtctcaggaatgtttaatgagagtaatgcatttacagttagtataatgctgcatttaggttatgtttattggaaaaatgaattctcaactttctcaaatattcctcacctgctctgtgctattgcctactacaagcacatatatcttaaggtccaggttgacacattttgctttcctgctggacattttctggtgactgcatttccctaggattcttccccagcaactgagactgatggaaacaagtttctcagtttcaaatgaagattcagaataatgactatcatcctgtgtgtttattagaacccggtgaatcgagatgatttctaaagagagagtgcaatagaaaaatacagaatttagaagaaaagtacctaagttcaagattcattatttatatatgaaattgtacccttgggcaagtaatttcaattctacaatgctcaggtttgtctaggtgtaaaataagaaatagtatcagctctcgatatcctgtaagattttggtgaggataaaacaaacaaaacacatgaaaagttcttttccgccctaaaacactgtaatgttagttacaggcataagttggagatactgtgggttcagttacagatcactgcaataaagcagatatcacaataaagcaagtcacacaaagctgaggtttctcagtgcacacaaaaagtatgcttgcactatactgtagtttgttaagtatgcaatagtcttatgtctaaaacgagaatggacatgtcttaattaaaaaatacttcattgctaaaaaatgttaactctcatctgaaccttcaagtcataaccttttttgctagtggcaggtcttgcgtcgatgctgatggctgcagactgttcagggtgatggctgctgaaagctggggtggatgtggcaatgtcttaaaataagacaacaatgaagtttgccgcactgatggactcttcatttcataaaagatttctctgtagcatgtcattctgtctgacagcagcagaaccttcaaaactggagtcagtcctctcaaaccctgtggctgcttgatcatctaagtttatttcatgtctgaaatcctgtgttatcatttcaacaatgttcacagcactttcatcaggagtaggtttcatcttaagaaaccactttgttcttccataagaagcaactcctcatccgttcatattttattatgagattgcagaaattgagtcatgtcttcagcctccacttctaattctactgttcttgctattttcacctcatcttcagttacctgctccactgaagtcttgaatcccttaaagtcatccatgagggttagaatcgacttcttccaactcctattaatcttcatattttgacctccactcatgaatcatgaagttcttaatggcatctagaatggtgaatcgtttccagaaagttttcagtttactttccccagatccatcagagaaatgtaatgatctttagtgatctatgagagctatagcatcatgaaatttttttaaaatagtaagtcttgaaagtcaaaattactcattgatccatggactgcagaatttaggtgttgttttagcaggcatgaagactacattcacttccctatacatttccaccagagttcctgggtgaccaggtgcactggcattgagaagtaatattgtgaaaggaatgttttttcccgagcagtgggtctcaacagtgaccttaaaatatccagtaaaccgtgctgtaaacaggtgtgctgtcatctaggctttgttgttccatttatagagcacaggcacagtaaacttagcataatcttaagggacctaggattttcaaaatggtaaatgagtattgtcttcaacttaaagtcacccactgcattacccctaacaagagagtcagcctgttctttgaagcattaaagccaggtattgacttctctctagctaagaaagtcctagatagcatcttgttccaatagacggctgtgtcatctacactgaaaatctgtagtttactgtggccaccttcatcattgaccgtagctaggtcttctacataacttgaggcagcttctccatcagcactcaccctgaacttgaactgtgatggagatggcttctttccttaaacctcatgaatctacctctgccagctgaacaacttttcttgtgcagcttcctcacctctctcagccttcatagaattgaagagggtacaggtctttgatctggtttggctgtgtccccacccaaatctcatcttgaattgtaactcctacaatttccaagtgttgtgggaggaacctggttgggggttgttgaatcatgggggtaggtctttcccatgatattctcttgaaagtgaatgagcctcaaagattggatggttttataaggggaactttccctgcacaagctctcttctcgtcgggcaccatgtgagatgtgccttcaccttctgccatgattatgaggcctccccagccacgtggaactgtaagtgcattcaacctctttcttttttaaattgcctagtctcaggtatatctttatcagcaacgtgagaacagactaatacagccttcctctggattaggtttttggcttaaggaaatgtagctggtttcaacatctgtctggactactaaaatttccttcatatcagcaataaagctgtttttctttctaatcatttttgtctacactggagtagcacttttaatttccttcaaggaattttcctttgcattctccacttagctaaatgttttccacaagaggcctagcatttggtctatattggctttcaacatgccttcctcactgagctcaatcatctctagctttgatttaagtgagagacgtgccattcctcctttcacttgaacacttagagcccatcataggactaattggcccaattttcatgttatgttgtctgaggaaatagggaggcccaaggagagggagagagatgtggggatggttggtcactggagcagtcagaacacacacaatatttaccaatttcatttaccatctcatatgggtgtggttcatggtattctaaaactattataattgtaacactaaagatcactgatcataccctaaaattattagaataaatttcattcttttaaaaaaattattctgttttgtattgctcaggctggatgcagtggcgcgatgtcagctcactgcaacctctgcctcccaggttcaagggattctcctgcctcagcctcccaagtagcttggattacaggtgcctgccaacacgcccacccagttttgggacttttaatagagacggggtttttccatattggccaggctggtctcgaactcctgacctcaggtgatccacccgccatatacttttgaaagacaaagtctgaactattaactgaaaacaaagatccccaatcactctaacagattaataataatgcaaaggtttaaaacattgtgagaatttccaaaatgtgatactgagacatgaagtgggcacatactgttggaaaaatggtgctgctgatagacttgccgctcaataccgggtttccacaaaccttcaatttgtaaaaaatacaataccagagaagggcaatgaagtgacatgcaataaagtgaggtgcgcctgtactgttttcattttcatcaagccaaaccataagaatcttgcacaacatctgtattattagagtagcatgaataatgctttttattgtaattttgtttttacttccaaaaagagaaataatttttttttctgattatgaactaaacaggtcctcctgtctagtaatagaacatcaaatcatcaccatagagattcaacttctctttttaggaattaaaaatagtcacaatccacttatcaattacacagttaataacttgatgccagaaggattttgacaaaacacagtacccttcattctcttttaccttagaaatgatttacatttcaggttaaagaaattctgacactcaactaaaaatacctgcagacagatatctgtaacccatatatgaattgacagcattttaaaaatagaaaagttggtatttcttcatttttcaaagatttaatgttaagaaggaatggttactagaattaatatttttccagggacactaataatttgattataattgaaaattaaaaaataattttagaaagaattgaaatacacatagcattctcataaaaatagaaattataattataatgttgatttagtttttgacagaggtaaaaactattaaatgcattagatacatattattgaaaatatttgaaggggtaggtcatagtttctctttccaaacataaaatataatattaggttggtgcaaaagatttttaccattaaaagcaatagcaaaacctgcgattacttttgcaccaaaccaatgtgtactgtaaagccaaatcctgtaatctctttaaatttgacttaacatttgcgacctacatccactcatgcattgaaaaggcagctccgtggagtcaacatctgtacatgaagcccgtgaagacgctgcctccatgggaccagaacaagttaaagaattcaggttgctggtttctttcaataaagttgtgggaagtaagtttcactatatgtagaacattctgaggaattgtagttttggtatcatttagtattatttggatattaagaacaggacttataggagtcttcaaaaataatcataatacatttatgaatgtaatgaaataattgtgttatactgttgctatagctatgcagattatctgagagatacctgagttatttatgtttctacaaacataagttacactactgctatattcaatgaaagtatacattagtaaattttcctatactctgtgttactaagagtgtactgtagttacaggaactgtggcatctctatagtgtgtatttaaaaaatactcaagcaaacttcagttataaggcaattatgatccaagcaaagttcaattataaaataggtaatgataatatagaaggcacaattaggacaaaatattcctgtctctgtactgtcagatagcctggaattacaatcagtaacctgaacttcatttagtgtgaaggcagagtctccaaaatccaattcaaacaaaaaaggttaaagtgacatgttattccattatcactcattgctatattgatacagactagttgatcagtgtcctaccacaaacacacacacaaagagagagactcactcctcatgcagtgagacagtggaaatagggaaacagatgtcttaagaggaaaaacccaaatgggacatacgagataggctttttaaaaaaccctacataggcctgcacaaagaaatggatgtaattctagacaaatcccaccatgttgtataaatggaggtgaaagataaggaattacccctacccctaaaaacaactgagttgaaattaaaagtatgattatattatggattgtctaacttcacaagtattatcaacttactaatttatattaatgaatagctttcaatctagatatgatttcaaataagcaatacatatttgactattcagttattgaaatgattttcatgcatctactgtgtgttaaactttgtattaaatgttagaaatcaaacacgagtgagattcaggactatattctattattctataatttaatggaggacataaagagcagatatttgacaaagaaatgcataacatactaagggagttcatttaatggcaagaccaattataattttgtttccaacttggtatgaactatgcttaccaactgtgagagaggggagttaagatactattcatgtattctcaaattagtcaattccaagaatttgttgagtgttactcttttcaaatcaggtgggtggttggctcaatcagcgctggcaggttacattcccatcttactgttctcaccaccacccactgcagtgaaaaacacttttatgacagaaatttacctgttttaaaagtacttttgttctcagaactgagagattttattgttaaataaaagtgacaggggaagcaacataaagtatcaaagatggttctgatcaagtcatgtaacagtgcctatgagaaagatttgccattctactctatccatcctattagtccccctaatatttccttcttaaggctttgaaatctccccatagaactccttatgttacttcgagaattttaatagtcatacggcaaataagcagagagcagctcacaattaatgtactaatgcccttttcttttaataaaaattatactctttcattatcctattaacaaatgattctttagggagcatttctttaatgttcacagtgctggcaccctagttggcactcaactatcttaaatttttaatgaattcagaattagtctgggcatctctcaaaacttagagtctctgagtgcatgagtggactctttatgttatcagatttattgttttgaaagcaaagaagactaggaatataagcaaaagaggaaacaagcaggtagtttgagagtgtagaaaactccatggcacacaagcacattgtaaggtaacacctttttcaccaatggagagaaaagagaggaagagatggaggagcaaaacgactcgctgttaccatactagcagtgtcagcactacaaaatacaacatttaaaaatgtgttaagatgtttttctgtatttatcaacagataaacccacagccagcccaaatcaggtactggagattaaaactaaatccctggacaaagattagcatctcaaggagaggctgtacaacattagagaaaaatgtggttgagcaggttgaaaaggacaccttcacagacacatctgggagaatgctagcagctcttcaaatacttctccttagtagcatttatctccatcttaactacatcactgatgcattaattataggacatttttctctctggttagaatgtaagttccttgagagaacagaccttttttgtctgaattccagtgactagtctactgccatgcaggctcacagttcgtatttgtggaatgaaattgctgaagaattaattatacatgaaggaaattcaagcgtaaattgagccattaatacaaatatgaaaatacaaggaaatatgaactttagaaagcaaataatatgccacagaggttcccaattgcatacttcactggactcacttcatttagggacctcattttctaaggtcccccagctgtccagtgctcaggtcatcactgacatgggctcagaaaatacagatacatccccaaggcagagccagtgtttgttttatttttgttttaatgtaagcaccacttacctttttcacctatgggtagactctctcattccatgatattagaaaatgtttcaaatgaaaatgcccctggttgtaatataatgactaaaattacattaagatatcaatataaagagtatcaaaaactttcctaaaaatcagttttaataaaagagttgagaacatgagaatgcccttaaggaaagggtagtagaaagaaaaatcaaatatacatttgaagttcatcaaaatagatttggagttggcacagattagaattttattatttttttaaaaattgggccagaaacgagcacctactttacgctaggcactgtgcttccctatgaaaggaagcatggtttctgcttcaagtgggtgagtggagggcctacaggtgcttagagaataatttctttttttttttttttttttttctgagacggagtctcgctccgtcaccaggctggagtgcagtggcgcgatctcggctcactgcaagctccgcttcccaggttcaagcaattctcctgcctcagcctcctgagtagctgggattacaggcacacgccaccacgcccagctaatttttctatttttagtagagacggggtttcaccatgttggtcaggctggtctcgatctcgtgacctcgtgatccacccgcctcagcctcccaaagtgctgggattacaggcatgagtcactgcgcccggccaataatttctaaacaatagtaatgcaaatagagtatgcacagcgtggacattccagcttcctaaacgcaggagcactaacgctcctctggcttgagagagagtcatcagaatgcaaagatagaaagagatagacaaattaggggatgcaagggatgcaatccagtacaggctccaatttctaaccctgtcccacatcaatgaggacctttagagagggcacaatattatccacagtctcataattcaacagggaattgggcaaagaaacaaaaatagtgactatggactaaattgattctgaacccatattatgattcagtaagataaatgtccctgaaagtttctgaagattcttagggcaccctgatgaccaaaggggtgagagctagggtcatcacgtgacctcattatccttattatctctcagcagttaccgagttaatggggagctagaaaaaattgtttttctcaatcactggaaaacagtaaatgaataacagatagctagttttaaaatttactggatattttgtcaattttctaagctacttgttatatctttctaatccttaagataattgcatttattagaaaaaattaaattggcttagtaaaattttagtcaaaattttgtgtatttgtttaggaaatgaacaaagagattacaatctggatcctgatagttcactggtaaaagataagattataccaacaaatagataacttacacgaaacgggtaaattccaagaaagacacaacctaccagaactcactgaagacgacatatcaaatctgaatagacccataacaagtaaagacattgcgttactaattttaaaactgccaagaagaaaagtccaggtccaggggataccttggtaagttcaaccaaatatttgattcgttttcaacagggtaacaagatgattcaatggggaaaaataatcccctcaataaacggcatatgcaaaagaatgaagctgagttcctacatcacattacatataaaaattaagtcaaaatggataagaggcctaatgcaagggatacaactataacagtctcagaagaaaatttaggagtaaacctttgtgaccttgggtttggaaaaggtacttagatctggcaccaaaaacatgagcgaacaaagacaacatatacacactgaactacaacttttgttcttcaaagaacatcatcactacagtaaaatgacaacccaccaaaaggaaggaaataaatgcaaatcacatatgtcataaaaaacctctgtccagaatatataaagaacatttacaacttaacaaggagaagacaaataacccaattaaaaaatgggcaaagaatctgaatagacatttttccaaggaagttatacaaatggcccaataaactcttgaaaagaagatcagcatcattagtcgttagggaaatataaatcaaaattatgagatgtcccttcacacctacaaatattgctaaaatttaaaacaaacaagaaaagaataacgggtgctgtcaagaacataggtaaattgtaaatctcattcattattggcagaaagggaaattggtacagccacttttaaagagtggcataccttaaaatagtgttaccatatctccagcaacttcccttctaggtatatatccaaaagaaaagaaaatgtatgtccatataaaaactcgtacatgatcagtaacagcagcatttttctaatagcaaggaagtagaaacaacccagatgcccatcaattgatgaatacataaacaaaatgcagtatattcatacaatggaatattatttggcaataaaaaggaatgaggtaccacaagtcgcaaatatggatgaacttttaaacgtcataagcgaaagcaggcagtcacagaagaccacgtattacatgtttccatttaaataaatctcccaattaggcaaattcatagagacaaagtcaatttgtggtagccaggtactcggggaagagggaagtgagcaggggcatggggtgtgactgctactgtgtacaggctttccttttgggaattatggcagtgttctaaaatttgatggtgttgatgattacacaactctatgaatacactactaaactgtacacgtaaagatggtcaatttaatgttaggaaaattaagtcaatcaactgttatttttttgaaaggcagataaggtggtatcttagattccataagccagcctaaaagtgctgaggaaccacgcagtatttgtgtgtgtgtgtgtgtctgtgtacaggtgtgtgtgtgtgtatcagatcattataaggaaggatgtatgtctagagaagtcgtgttaggcttcacatacttttaatacattgttaccctaatgttataaaaacttatagtggatttatattttagacacaagtaacatatagttggccagttgaagtttatttctggaaaacttctgtttacattttattttaaaatagttatccctcaatcagcatgccctacattttcctagtggcagaaagtagtgaccagaataaaaaagcaattaaattaggcaataacattactgaagaggtcactggttctgcttacatttcacttgttttgcctatatatattatccattgaactaaatacagagaagccacattttctcttaatattctcttatggtctagtgattttctttcttttttacatatggaaaattacaaaagctctagctacacaacgacatcaaatatacaagtgtctaattgcaatacaccgggatattttgactaaagagccgtgataactttgcaatgatgtaggacgatgtttcagacaaaatatgaagccaaaaaaggcagaatataatctgaactgacatttcctatctagaatgacagaaatgtaaatgtgtttttctctagtgctgaaggtttggaaaatgctagaccctaagatttaccatggaatttgatgattcatagtgaacatgaagagacagacgccacagtctgagttctatttggtaattcgtggccacaaaagtgcacccctcattgctttccagctatttacacttgccagtataatacaagattcttaattagcaaccatgtggcttcactttaaatagccttgctagctcccttgggacctcttgaaatatcattcatattagtagaaataccatcccattttgttacagatttatttatttctcttgctatcctttttttttttttctgttaaggcatattactgttacatgattataagcattttttaaagttatgggcagggccatgatctaactatactttgtagttacatgacatctaaaaatgtgctatctgattaaaggatgcattttagtaataaagatgatagctatttacatccgataactgcctacaaaaagacagaaatgagctgaaaaatggaagaagatggaataaatacagtttactaatagagcttatacttctcccatttggtttaaagaggcttttaaacacttaagctgagatttactatgaaaatcagacttacaaacatcaccatcaacacagaattattaaaatgtagaaagtgtggatatgtctaggattgcgatcccattatgcagggacctacgacctactagaaatgctttgcaattcttactgaactattttttcatgtaaatgaacatcacaaggacaggtgaactctctgcaggcaccgatcgtctggttttctaaaagtatacagggcagacagggtattcaccttgattggaaacagagaatccaggtatatttgaatcttctgcctccaccatattgtgtagcactatgttttgtttaattttatcagtagaaagaaaaaggccagacaaatgccgtgactcaatcctgtaatcccagcatgttgggaggctgaggtgggcggaccacttgggcccaggaattcaaaactagcttgggcaacaaagtgagagccgattctacaaaaattacaaatattagccgggcatggtggcacatgcctgtagttcaagctagttgggaggctgaggtgggaggatccattgagcccaggaggtcaaggctgtagtaagctgtgattgggccactgcactccagcctgggcaacagaaagagattctgtctcaaagaaaagaaaaaggtcatacaagtttaccactaataggccaggtgcagtggctcactcctgtaatccagcactttgggaggcagaggcgggcagatcacctgaggtcaggagtttgagaccagattgccaacatggcgaaaccccggctctactaaaaataccaaaaattagcctggcatgttggcgagcgcctatagtcccagctactcgggaggctgaggcaggagaatcactgaacctgggaggcggaagttgcagtgagctgatattgcgtcattgcgctccagcgtgggtgacagagtgagtctaatgaaaaaataaaaaataaaaaaatgaaaaaaaagtttaccactaacagttgaagcaataaattttgttttgacgaagtaacatttatagtcggtgattattataaaaaattttgttttaaatcattcacaattgagttcccatcctattgtaagtctactgctaatctattaattgcatgcattattatgttggtcttatgatactacctagtaaataaatatacatatgtgggtcatactccataagtctgaaatacacagtttaaggggctaataaggtatatgtaactaagaaatacactagtatcatcattatctgctgttttatgttttaataacttctatttctgatatttcaaagtgatataaacgagcaagttctatacaaagctacctcatagattctaaaatcactggcctttcaaacatgtttatgggttctttttaaaaaataaacattcggatgctgacgaagtagaaaattagtcttctggagacatattatgatggagccttaagatggatgaaaagtataaactgcatcatccagggctggatttcctgtgcacactgcagaaacgtccttgatgttactgatgtctgcctcacgcttagctctcagagccgaagctccatcaggacagattggaactgccacccagaggcatttcacaatttgaaccaaaaggttttcaggcttgcgttctagctaattctgtcgcttctaattccagccagacttaaactcttatctttggatgccaggcctacagatagggctatcacagtagccccaattcccagaaaatacgcaactccatgacccaggtgagattaaatccttccagatagcctaaataaatggtctataacttgttcctgtcactcccactaatgcctttgtactgtgaaacagactaggaaaggtgtaaatatcttcaaattattagctgcacttcctcttccttgcctctaccaggaactctagcatcacgctcctcatggggcaaaggaaacccagaggcggcagttcctgcactttcttctcctgtagttattaaccaatttgcagatctccgtgtattactggtaatagaggcacactcatatcttttctctttaacaccttgccagtaaaattctcccgcactaacctgtctgcccctctctctctaagaaagatacagacccaattatacaatttagcccattactttggttcaaacagatttcacctcaaaacagatgtacttgaatgtaaaaggaccttcttgtcagtgcgtggggtagctgtgctctcctgtaccccctaaacatttatgtgaagtagtcacatctgaagaacacacacatatataatgggaagtatctcttaagcagcaccgcaggcatttgctttaaaccccccgtaactcataacggcttgactgtgcatccatgcttctcagcagctaggggttccctgaaagcagggacaaagccgtggtcttccttgtttcctctgcacctcacctcgtgctgagcacatgcagactcagaatagatgttcactgaataaaagaaaggatggacacatgaatacattaaatgaacctcaaacgttatctactatgctctgtgcagaatcagtcagaagacaaggtgtctcgggaatgcaaaacgggacaaagaaaacccagctcaagcaagataagcactgggcagtggttccatttgtctgagcgaggcagcacgtcgagatgagacgaaaacacagacactgactgagtaggtagagcaaggggtggaaatcaagaaccaacaagcagcccagtgcccatctgtgagctggggctgcaggaagaaaagttggaaaggtggctgggtgtggtggttcatgcctataagtccaacacgttgggagcctgaggtgggaggactgcatgagcccaggagttcaagacaagcctgggcaacaaagcgagagcccatctctactaaaaaagtgagccgggtgtggtggcacgcatctgtggtctcagcgacatgggaggctgaggcaggaggattgcttgggcccaggaggttggggctgcaggcagctgtgtttgtgccactgcactccagcctgggtgacagaggaagaccctgtcttaggaaataaacaaataaagtaattaattaattaattaatttaatttaatttggaaaggcaaggctatgttgggagggccctgacatagtgagaggaagtatcattatttgaaggactttgaatgtttctcatgtgactggaaagactattcatattcttaccacagcaagatctgaatttgtgaattgtcaagctctctcggtaacattgtttcattttccattattagttttaagtcactttaaaacaaattgtggtaaaattcaactcctgtcccacgacttagtttgcccacatttaaaactattcctgaaataaactatgtaaatttaggagggaaattttaatctgttaaatgtatttagacatttcctattcagagaaacattatgaagccttctattttgtgtatagtctagatttttaactatgaatatgtgtgtgtattcatgcaaatagtattgatggagatgtatagatagatagatgataggtagatagatgccagatgggtacatggacagtcacacagatggagagatggtaggtggacagactgacactatgaagaaaaacaaagaaggctgaagatggctggggtgaagccatctttctactgggtcttcaggggaaggcttttcgacaaggtggctttagaattactacaagtgaattctatccatacaggaattttgacttttctggagttagagatgatcaaatatattttgaaagaaataaggtcctggtcacaaatatgccactacagagataggttagtcctcacgaggcctacacctccccgactctaaaaatgaacaagatgagcagattgtggaactctgggtttcattcttattgccctttgaggggaaggtgcttagaggtaaatgttggcttggagctgactagaatgaactggttagctttgaatttggtatgcagcacaccatatatgttgagaggttatttaaatgtttttatagtttacatggagagattaattattttatttttatgtaaaaattgctgagatttcagcagttacgatcgctgacctattaatttaagtaataatgtaatgaattttatatttttacatctgcagaataactcacaatcctgtgcaatgtttctgatacctgcctaaatatctgtatttactcattttgcatttcttttcaaaggctctcatgatttcaggaggtatactgatgcaaacttaatatccagaaagaattctggtgcaggaatggtttggtatcaagaacgtgggctccagaggtggacaggtgtgtgtctccaggctaccttgtatcctgcatagctttgagatcttggacaatttatttctctcagagggccacagtttcctcatctgtaaaataaggacagcgatactaagttcagagtgtcatcgagaggataaagttaaagaagatcctggacacacacccacagtgcctaacagcattccatctgcagaagaggtcttggttatttgatgggattgagtgcacagagtgaaaaatgtgtccatacagggaacgtacttactcctttggagcacttatttcatatgtggatcagacaagttagcaagatggtaggtatgctgccaactataacgacagagatatctacacatgtgtagattgtaagattggtgcttctggagcattaataacagatcagaacccgaggatttgttttaccacagattaggatgcaccccaaacaccttctagaatgtccaggctgcttctcactctgttccctaaactctaagaattagctataaattagctattaatcctccattcacatccaattttgtgtagttttaaaagtacaagcatataaaaatagataagccaacctgttccattagccctttaatcaatattttagagaagatgaaaatttgactcacattgtatgtttcacttacaaagcactcctatttcaaggactaaccgtactatagctggtgatatggtttggctgtgcctctacccaaatctcatcctgaattgtagctcccataattcccacatgttgtgggaggcacctggcagaagataactgaatcatgggggtggtttatcccacactgttcccctggtagtgaataagtctcacacgatctgatggttgtataaggggtttcccctttcgcttggttctcattctcttttgcctgccgccatgtaagatgtgcctttgcctttcaccttctgccatgattgggaggcctcccagccatgcagaactatgagtccatttaacctcttttttttttataaattgcccagtcttgggtatgtctttatcagagtgtgagaatggactcatacagctggaatttttttttttttttttttttttttttttttgagatggagtctcgttttgctctgtcacccaggctggagtgcactggcaggatcttggctcagtgcaacctctgcctcccgggttcaagccattctcctgcctcagcctccctcagcctcctgagtagctgggattacaggcacatgccaccaggcccagctaattatttgtgtttttagtagagacagagtttcaccatgttggtcaggctggtcttgaactcctgacctcgtgatctgcccgccttggcctcccacagtgctgggactacaggcgtgagccactgtacctggccaaaaattattatttaacatgaaaagagcacgtatagtatgattttttttaggaaaaaagttaaaactgtctgtcaaaatatagctaatgtgtaccatttagataaatgcaatttaagagaatattatgctggaacacatattatgtgtcttgtgttcaagcacatcacatacatcatccacatgagctgtcccaaagtctgtaagagcagagtcacacactcatttgacaaatggatgaccgaaggcttagaaagttgaggtaattttcccaaatacatacacagcaagtggtggagacaggattcaaatgtgagtcaatgcaacttggagaatttccgtaatggtggttaaggaaataaattttgcctgctgaatagttgtaatgttcattccttcacctctaggctaaccatttcacttctctgcctaaaatctccagtggttccaccttgcatggttgtttccacgtgtgattgactaggcatacttactagtaaaaaatgtgagcacacagcccccaaagcatcttgtttattcacaaattttatatgcattactctactaagagattaagtacaccataaaatacacactgcttagaatttaagaacagatccaaatgagagaattacaatgttgacacgtggttatttgtttttcactattgagtaggaaaccaacgaaaagcttccaatggtactctaatgctggtgaaattttttaattaccgatgacttcaccaaagtttgtcttcaagttttaggtgatttcttggtaagagcgttgaccatggtctcagcctcacactgttagcagtcagcatcacattgcacaacactccctgaggacaaggctcatggttaatagtggtggatatgaattcttatttcaaatagtgcttaactcttgtcagatctgataaaaccatctttttcttttctttttttgcttgttaatgtggctggtgaagtgccttagtatagtcttcaatactatttcattttgtaagagttgctttagtttaaacgaggatcatgtcaactgcaaaacactattatgtgctacaggagacaaatcaatgctggcacacaggaatgtccgcttttcccaaatgttacctgtgaccatcagaaatattcaggcaactgggagtgggcataccatgagcaaagtgaggggtttttcctatttgctttgattaaaaattaatataaatgaaagtcctagtattttattcctgcacactgatggtatgtttcgcatccgttgggatgcatcaactgattttggagcccaggaaaagtctaagctatttggacactaagctgctacttaggactcccagaaaccccatgcctatgctcgcagctacatctctcaatatcttcatcaacatttatttgtagtttactgtgcttacgtacaacctttcaggtcatggctgcactcaagctgagttccctacctagaaaatccttccttcctatattttactcttaatctaaaatttctacattattcctacttatcctgtaaaagtcagattcggagtgattggaagacatttcttccatgtacttgtgagaattaagggttaacttgtccagtactcattcctcagtacgttggcttgaaaaggacttagccttgcaggctcaggaaagagaatggtgtttccctatcaggaactctaaagcagcaagtgaagaggggtggatggatgtggaatgagatgtggacttgtcactctgccaccaggacgaatatacaaaatctggagtccgttacacttgacattttcacacacagaagccatgcatttttcaaggtactatagcttttaataaaagctctttgtgctttgaagagggtgttggataacagtacatatacatacttgttttaaaaaaagaagaaaattaattgaggccagcatacatttttccatgccatttccaactttaacaccgttgaaattcctttaaattcagcttgaggttcccatggaatcacctctggccacgggccgtcaggtacaatcttgggattaagagctctctgtgaagacctggtgaccttgaccattcagggcatttcagattattctaaggcatatttttaaaagtagggttttttcctacatgactagttttgttaaacttgtaatttctttttaacataaatttcatactgaaacaagttaaactgttttttactgaaagtcagcttttgacagaagcgtacccctccctggagaaacagttcttcagaacctatgaatatgtaacaccaatgacttctagcacttttaattttacaaattcccttctaacggctttaattgtaattcctggcataaaagaggcaacaggataatactttgttgaaatgtttaattgaagtataatacatgtatgtcttttatgaaacaacctcaaacttagcattgcaagcacagtacaaataactatttttaaatcaacaaaaatgatatctatttattgtatataatgttgttttgaaatatgtatgtgttgtggaacagctaaattgagacaatatgtgcattacctcatatacttattttttgtggtgacaacaccgaatatctagtcattagtgattttcaagaatgtaatacattgttattaactacagtcaccatattgtgcaatactgtgcaatacatcactttttcctcctgactcactgaaagtttgcttcctgtgaccaacacctccccgcccacacacagccccaacttccagcccctggcaaccagcattttaccctctacttctcagatttcagtgtttttagattccacgtatacgtgaaaccgtgcaatatttgtttttctgtgcctggctcattttatgtaacatcatgtccttcaggttcatccatgttgtcacagatgacagggtattgttcttttaaaaggtcctatggtatcttattgtgtttataaatataacacattttctttattcattcatcagtcaatggacacttaggtaggtccctacctgggctattgtgaatagtgcggcaaaggacatgggagtgcagacatcccttgacatgctggtttgtttcctttggatacgtacccagaagtgagaccactgggtcatatgacagttctatttttaacttttgagctgttttccataatggctgtaccaatttacattcccaccaacagtgtacaaggctttccttttctccacgtccttgccagcgcttatcacttattatctcttgtctttcttgtcttttttttttttttaagatagatgtcgctttgtcacccaggctggagtgcaatctcatctcactgcaacctctccctcctgagttcaagcgattctcctgcctgagcctcctgagtagctggcattacaggcacccaccaccacacctagataacttttgtatttttagtacagagagggttttgccattttggccaggctgctctcaaactcctgacctcagatgatctgtccccttcagcctcccaaagtgctgggattacaggcatgagccaccgtgcccggccatctcttgtctttttgataacagccatcctaacaggtatgaggtaatatctcattgtggttttaatgataattttttccctgataatttatgatgtggagtattttttcatatacctgttggccatttgtatgacttcttttgagaaaagtttattctgtttctttaccccatttttaaattgggttacttattttctaactattgagtttttgagttccttatctattttgaatattaacctcttatcaaatgtatggttggcaaatattttctgccatttcataggttgtctcttcactctgctgattgttgcgtggctgatacagaagttctttagtttgatgcattcccacctattttcccttttgttgcttgtgcttttggagtcatatccaaaaaataactggccatatcaataccacgcagcttttcctctgtgttttcttctgtgagctttacagattcagttcttacatttacagctttaatccactttgggttgatttttgtatatgaggtcagataagggtctcatttccttcttctgcttgtggatatccagttgttccaacaccacttatggaagagacagtactttccccgttatgtattcttggcgtctttgtcaaaaaccaattgactgggccaggcgcggtggctcacgcctgtaatcccagcactttgggaggccgagtcgggcggaacacgaggtcaggagatcgagaccatcctggctaacgtggagaaaccctgtctctactaaaaaaaaaatacaaaaattagccgggcgtggtggcgggcgcctgcagtcccagctacttgggaggctgaggcaggagaatggcgtaaacccgggaggtggagcttgcagtgagccgagatcgtgccactgcactccagcctaggcaacagagcgagactccgtctctaaaaaaaaaaaccaattgactgtatatgtgtggatttatatctgagatctagagatactataactctctatatctctagagatactctaactatgtggtatatattttaaggcaggtagtgtgatgcctccagctttatttacataactacttttgggagtaagttgctgccatgatgctccatcatccctgaaaactttactgtgtatttcctaaaaacaagacattcttctacacaattggtccattcaccaaaatcaggaactcacattgatacactattagcatttaatccacaggcctgatgtaagttgtctcaattatgttctttcttaccatgtttttcatttttctaattttctcttttttaattttaagttccagggtccatgtacaggacgtgcaggtttgttacataggtaaacgtgtgccacggtggtttgctgccccatcaacccatcccctaggtattaaacccagcttgcatttgttattattcccaatactctccgtccccccacccatcccccagtaggccccagtgtgtgttgttcccctccctgtgtccctgtgttctcactgttcagctcccacttataagtgagaaggtgcggtgtctggttttctgttcctgcattagttatgcaccagctaagactatgccttgcatttaggtgccatgtctcttttggtcctggctacatttgcatataggaaaacaataacaattaatggcaatcatcaatactttcctctatctagttaggttaatctagacatggtgtataaaaacaattacattattaatcttaaaagataagtaaagcgctcatgaaaacggggaaactgatacataaatattttcttcgactgctcatgctgcattctggagacgaccttcactattttttgcacaaatatttgaaaaacatacgcaggtattttatctaaaagatccatgccttcttaaagcatgaaagttggaaaagtggttgtgggtccaccaaactacaaagcccaatttctagaagaaatagagggcatggcacactgctgatgaagaacacacagggcagaaatacataacttgcccgggcgcggtggctcacgcctgtaatcccagcactttgggaggccgaggcaggcggatcacgaggtcaggagatcgagaccatcctggctaacacggtgaaaccccgtctctactgaaaatacaaaaaattagccaggcgtggtggcgggcacctgtaatcccagctacttgggaggctgaggcaggagaatggcgtgaacccgggaggcagagcttgcagtgagcagagatcgcgccactgcactccagcctgggcgaaagagcgagactctgtctcaaaaaaaaaaaaaaaaagaaaaaaagaaatacataacttgaatgaaaatgtgtattagctaaaataaaatggttttaaaaaaaacaggatcagagggttttataagtgagttccactaaactctcaagtaacattccaattccttcatgtttaaaaaaaagaaaaagaaaaaaagctgttcagttttgtttaaattaatttctaaataaaacaggagcaataaaagaaaatgaggatgaaattccatttcacttgtaagtatacatatgaaacagaatccaaataatatcccatcatcaagatttatctcaagaatgtgaggatggtttatcatctgaaaaatccccatcaatgtaatttaaaataggaagaaactgaaaggtaaagcacttattatctcttataatacggacgcaatgacttaataatagtccataactttactattaaagcaaacagaaaagaacaacagagtaaaccaggaatggaacagaagtctctaacttgataagggcaatatatcaaacattgcaaaaatatttaaatttctgggagaactcttagctacattttaacttctgaaaaaaaaaaaatagaggatgatatcagcaaacaaaacaaactccagagatgagaaattgaaactagcactcagaggaacgccagggcagtgggccttctgagcccagaaaggcccggattcacaatgaagggacctagcctcagacggcagatgagagtggcagtgtttagcactgtcccttaggagatgctcagtaaaatgcctctgccagctgcctcctcttcctcacctgtatgtagctgtgaaatcctgggcactgttctcgaaagagcataagatgctccgagagggtcggccttatacgatttaagctgggccaagagggcaagtggagtctcaggggatggcagcctgtgctgtggaggtgagggccacagagcaaagcccctccatgaagggctcaaagcaaaggagaggccttctgcagtgcggccattaagatcatggtctgggaagccaggctgcctgggtttcaatctcagctctaccacttactgcatgactcagtttgtttgtcttgtgccctgcactcctcatctccatgaagagctaatggcagcacctacttcaaggttggttggaaggggtgaatgagttaatccaggtaaaacatgagaacagtctctgttcttcctcaagggaagcctcctgacgcctgaacacacacattccactggtgtatttccagcacaagattctggtgtgcatatgcctccaaaatgcaatagggaatctatgtaaccttccaatactaattaacatattgtttggccacacatattaataaacaagcaggaatcatctgattttggaggtaagtaaataacatgaaaaagaaatgccaagatgcacaaagacaacaactaatcatattaataggactgtttaatggaaggtacatgaaagaagaagaaatcaaagaaccggtgcttctcagactctgacgtgcaagtggattaccaggagatttgttattaataaataaataagaatgaaatgcagcctgcatcagcaggccaggcgtggactctgggattcagcatttctcaacaagcccaccgtgtaacaccaattgttgctggtccacgttccacacttttaggggtggggatcaaaaagataaagtcaagaaatgtttcaggagtaggaggaaaacgacaaaaatatacaaagaaagagatatttttaaagtaaatgcaaaattaagaagtaaaataattctaataggcatccttaaagaagatggcagaaatcagagaggggagaatataattttaaaaataaggatattttcctgggcaataaggataaaaggactagttctccatgctggctacatgctctgattttgggtggcatcaaagaataccaattgtttggccataatctatggaggcatagcttacgtatctgtggtttttaaaatcatagtgaagtgagaagcactcatcacgcattagagtaaaacagcccaaagggtatgcagcgaaaagaagacagaacccaccttgacatattttatggctctaaacggggatagaaaatctgagaggttttacaagaaatataacacctgaaacctacatatgaaacaaatgcccgaattgaattcaccttctcaatagtagtgccaagttttagaagagcagtgccttcaaattgggagagaaatgctataaacacagccaaaccacatcaaaataaagaatggaactaacaaataatgccttcaaggagaaaggagattatatgacaacaaattctacaaatataaataaaatattcattttttaaagatggagtctcactcttattacccagcctagagtgcaatggcgcgatttcggctcactgcaacctccacttcctgggttcgagcaattctcctgcctcagcctccgaagtagctgggactacaggcgtgtgccaccacctggctaatttttgtatttttagtagagatggggtttcaccaccttggccaggcgggtctcaaactcctgacctcacgtgatccacctgccttggtctcccaaagtgctgggattacaggcatgagccactgcacccggcccagatattcttaactataacataaaggcatatgtttcttccaccaataagaaaaataaaaatcaatttctctgagaacaatagagcagtaaaagaaaggcataaatctgaaccaaatatgaaacaaactaaaatatgataagatttttagtaactgatatctcctataaactctgaggtttggaacattattaatgattagtacaggctgagaaacattcaaatatcatttctttctcatggatccaatcgtcatacatacttgcccggccacataatacaatcttataaaccttgtcaatgtaactgtattactacatctgacagaatttaggaggagacaaaaaagtggtgaaaaatgtggatagaaaatgattggttgataagttccatcaaagtttgttgaatacatcagagttaaagtatgtcgttcaaagtaacaatgcacttgatgattacagctcccgtaagtacgggaagaggatggatagattaacaatgggaacaggctgggagaagagatgtggggcaaagaatgccaaattattaggttttcaaggtggggggtgaatgtgcatattttaatgttgataaatcaatagctccgcgatgatgataatccccaaaagaactaagtggagaaacacgtacaagtggctaactctggggaacagaactgaggacatgagagagtgaattccttttttttttttttcattttatgaagaaagcaggaaagcatgtattacatccataattaaagatattttaaatggtaatacaaccaagcagttgaaataacctaaacatttcaacttcattaatatctatttttaaaagcattttgaatcatctgtttctcttagatacttcttcattttacttaggaggagagcagcattctatcgtcatttcttctgggactttgcacaaatcagaagatttgcacaaggcaatactgtggcagcacagaacaactttaacaagttcacggaaaggaaaaccattcacattcgaaatagagctccatgcctctaaccaataccttcccctggcatatgtctgaccttgtcctggggactgaactagagtcatttcctgtgttactcaggacacaagtgtcacgatgttgtatgcactccagtcttgactgactagcccagaagggcaaaaaggcaatgtgaggggcttagtcttgctgcccagccctcactgttcactttccagaattcttatggtaggaaaatttctcagttcaaaagcttcaggttacctgtgcatttgctctttcaatacacatgaggagctcggtgtcactcaacctatccgtattccccatgctccaagagtctcactcagaggtgagcgtagggttagaagaaaaaaatgggaacagttatcatttaaacagtttctcacaacccccatcaggtacaactcttgagtgagtaccaagattccttgcttaaaaataaaaggttgaaggccgggctcaatggttcaggcctataatcccagcactttgggaggccaaagggggcgcatcacttgaggtcaggagttcgagaccagcctggccaacatggcgaaaccctgtctctactaaaaatacaaaaattagccgggcatggcggcaggcgcctgtaatcccagctactcaggaggctgaggcaggagtatcgcatgaacgcaggaggtggaggttgcagtgagccgagatcgcacctctgtactccagcctgggcgacagagcgagactctgtctcaaaataaataaatgaataaaaagttgtaccaagtagtggctaatttataaagcaaataactaatcttttaaatgagagagaacagaagagtttctcattttggagattaaagcatggcccagtcagcaactttataacactgaccaggagaggtacatgcctttgttaaccctggctgttgttactgttatatcactagggtgtctcctcaacaacactgttcctttttctcttttcctgttgctgtgaactaggcatcaggcatagttgtgtatgaagttatcaggaaaatcacaaagatgtgtctaccagggcaggcaaaccccagatcctaaggtttctgtccagcttttccataaacttttcctatttcttactcccaagtttgtcaaaaaacaccagtctttgactttttctctaaatgaaaaccccatagaatctaagttccaagcccaaaatttatttgcaaaagaaaggaggaaggaatgaaggaagaaggaaggaaatacatattatgtctatttaatatacactatgcacttctttaatatattacttattacatatggatgcatttttatctgttcattcaagaaaggatatgtcaaatgcctttgcttgggaacacctacgttcagtttgctccaaacatgtacctggttttcaaacgtcccacactcctgcttcacagggaaagatttgccattatgcttagtggtgggaatctatgcaaatggttccacatgccaatgccaagccaaaagagaaagacaagcctttgttccagaagacacagccctttacagccctttgaatccattcctctgggagcttccccatgggaggactgcttctttctgtgacccagcctcactaaatgcactaggaatcagcgcacttcactaaatattacatctagatcatgtgtgtatttactataattatgcatatttcatctgaactaattttcagaaaccctttccttagcaaatcgcacattttacgaaatgtcagtgtttcctaccaaccaccatgaaaacaacaacaaaagctgaaacatagcaggaactcaaatcgcagagtatttcaaatagataattagactgaattctaaagttctctaactaccatatatgtaatattaaaaaggtcattaaattgttggtgtgacagggttagttaaacataggcctagcagccagtaaagatgctgagtgcagtgacaaagaacggtgaacggaggacctgtttgtgaaggatgaggattttcctgcattcaccgttgagaagtcagtcttcataggatggtgctgagtaggactagatagatttaatcaccatcacaggaacaaactcactaattatagtagcagtgacacaggacaggtgagacccacaactggggcttagctgaggagggttcttgactttgcccaggaaggaactgaggggtaagtcagtggtgttaaaaagcaatgtttactgaagtggcggtgtacagcagcagcagcgctgccccgtaggcagtgtgccagggcagcagctcagaggcagcattgcatccatatttatacccacttttaatttcatggggtggattatgaagaaatttctagaaaagggtcaccaagttgttgtcgtgaaaaggggcagtaactcccaagtgttgccatggcaatgggaaactgacacagcaccctggtgggtgtgtcatatggaaagctgcttccagcccagccctattttagctagtcctcaatttggtccagtgcctgagccccacctccagagttgacttccaccttctacatcagtaagacaaagaaagtcgcaaagttggaagaatatacagagagagataaaagctgtattcaggaagtagatcctttataaaatccactagaaaatacaactgacttagtaatagccaatgacaaaacactgcatgtgcagaaattcaggactttatacaagtaataatgagtgaggacgcaaggcagccctggccaggacgatgaggggcagagatgatacagggaccagctatggctcttcggaccctgaccaaggaaggaaagctacagatgagtaaacagagttgactccatgagctcagcagaaatagggtgtttgtttatgtgtttgcagttttcaccagttcttagtgagaagttaggagttacagtgtgcactcctctgctatttatagtctgatatattaatacaggagctgtcttggccaagctcttcctctctacagatgctgtcccttaaacactttccaacatccaatgagcacttatacaaagattgctttttatttcatttaccgccttctcagctgtttatgagtcaaactgtttcctggtactgttgctgtaggtgtatattggacattactcaggatctgaagcatatacaatatccccaagcttaaattagtcattgtttcacttgtcaaattcaattaacatcatatgccaattgcataccatgaatcatttagtaaacactgtctagaaatattaacataaatcctgtgttttacttaacactatgttgaattctgttcataagtttgttgtttgcaacagtttaagttttagtcaatttcaaaattcttttgaatgtactatgtgtgtgtactatgggataaaagaaataaattaatatattgatgtttacggtaatgtgggttctcactatgggaaaaggtagatatgaatactgaaaggggaaaggcaatagataattctatggtattcctgaagttatatgaatgaactcattaatgcacacagacacacatacacatattctaccatatagtaaaatggtctagaagcaaaaacattggtagcaacgtttatgtctaaatgtaacagccagatcctagggtttggtaaatagaagatgaacctggaacttctgtgccaaaaagcaaggactcaaagaccaatgtggacatatcaaaactatgtaggagctgatttaaaggggttcatttttctcaaactgttctttaaagaagaatgctaaatggcaaatgtaaacaaacaatataattataaatctttctggttttttggaaaccacaaatgcaattatttatttgggcagaaatagaaatgaatccttaaaaagaccgttgaagaatagcatcttgacatggtctgaaagcagtatcccacatcttgtctactaattgcataagaaaaaggcaaccttgaaacaggggcgatgtccttttgagtatgaaactcacaagggagagactttatcagatcagatgctagtggggatcacaaacgccaccagatgagctggcgttctgtgttgctgatgggatgtaatgtaaagtacacaccctctaggaaacggtcttgccacacatgcttcacctgaacataccatgaggaaaacggcaggacaaatccagattctgagacatcccaaaaaaggactggcctgacgtctttaagtatgtcagagttgagacagacaaaaagtggcaggaagttgtggctgacatgaccagaccgccaaatgcaacgtgtgggcttcacctcaaccgggagaagaaaaacagatgtccacagaagacgttcggagatggatgggaagatgtgcacaagggctgcccatgaaataatatcactgagtcaacgtacaggcatggtgatggaacaggatgactttgcatttaagagatgcacgctggctggacacagtagatcacgcctttaatcccagcactttgggaggccaaggtgggcagatcacgaggtcaggagatcgagaccatcccggctaacacagtgaaaccccgtctctactaaaaatacaaaaaattacccgagtgttgtggcatgcatctgtagtcccagctactcgggaggctgaggcaggagaatggtgtgaacctgggaggcagagcttgcagtgagccgagactgcaccactgtgctccagcctgggcaacagagtgagactctgtctaaaaaaaaagagatgcacactacaactttcaaacaaatccaccaacacacacgcacacacggacgtgcacactcacatacatacacacatgtatcatgttttgtgtgagtgcggggtgtgtgtagcatgggtatttgtgtgtgagaaggaaggcaagtgggtcaaaagataaagaaatggtgcatagagtaaatcactgcggtactgtactagtctttcaagttttctacagtctcacaattaaaaaaaaaaaggtggagaaaaattttcctggagagagaaactaaacaaccagaagtttctgatgattgaattaaatcgtttttcagtatgccaagcctctgagcagctggattttccacactttagtttgttgccctggggcctcccagtcttgcttccataactcaacagaattctaccaccaattgttgaatccaaagtttcgttccaaagtctctgaaagcagaaactgtgttccagatacagagaatcaaaatgcgctactgaagtcatccagaatatcagtagccaagacatgatcagagagacctatgaatctaagccagttttctgatttttaagccaaattgtttatctccattcaacactctcaatacttgtatctacaaacatattggactaatgcagagagcacatttccacactggaacagttgaatagggatgtgaaaactcgaatatctttgcaaccttcaaacaacacttgacattaaaaatccatttacaaatccagctttatgctaaatattgtggtaacattcttaaagaccagacctcttcatgtggaaaatgatgtcccagtctaaagttttttgaaaggatttgctatgaaactgataataattttataggtattcatgtctatacaattactaggactttttttacacagaatacctaagtttctcctaccttattgaagattcttattaaaataccacatattaaaaaagataaagtaacacaaaaagtcacaaaagaattgaagtttacttttttgctttatttggcccaacacagtgtcttctagaagtccttgtcatcacaaaaatataaagcttcctttggatatgcactccccaacctgaattgtaagcactttgaagacagtaattaggtcttccatcacactttagataatgtcctaggccgggcgcagtggctcatgtgtataatcccagcactttgggagtctaagacaggaggatcacttgagctaagacaggaggatcacttgagccccggagttcaagatcagcttcagaaacatagtgagacccccatctttacaaaattaaaaaaaaaaaagctgagtatcgtggtttacacctgtggtgccagctactcgggaggctgaggtagggaggtcaaggcggcagtgagccatggtcgcgccactgcactccaccctgcacaacagagcaagagcctgtctcaaagaaaagaaaacacaccatgacgtcctgcatatatctgcctctcagagaactgattcaccgatttcatcgtttaaaaccaatgcaatactttcattttcatgaaaatggaagcaggctttcatgaaaacagtcttcaagttcatgttacacaaatcctacagaaattgtggacaaatgatctgacatcctcctataaaaggatgagaagaagctgtgcctcatgtaactgatcatttctatgtattaagccatatgaaatatcatgtctttgctgagcagaggctacaattagaaaagacccgatctaaaagaatgctcaaaggtcatcaagcatgattacattctgctgcacactgtaaaatgcatccaagtgtaaaggattattcaacaaattatgaatgattcattcatggcagatttttcattagaaggtaatgtctcctttcccataaagtcaacattatgatccaggatgccatttattagaacttatgctattaaacaagatatgaaaagagaatcttcttaagtgtctcacatcagttaaattaccctccacctgttggaaataagcactgtggtcaatgaagggagagggatatgtagtacatgtgttacaggatttgcaagagttatgcttatgtatatgtatacatgtacacaattttcattactgatctttcacttatgtctgaaagtcaaatacttactccttttgcttaaaattttggactctaaattatcccaggatcggtagttaccccaggacagcgtagtagttattaaaaagtcaattagatcccatttgtcaattttggcttttgttgccattgtttttggtgttttagacatgaagtccttgccctgcctatgtcctgaatagtaatgcctaggttttcttctagggtttttatggttttaggtctaacgtttaagtctttaatccatcttgaattgatttttgtataaggtgtaaggaagggatccagtttcagctttctacatatggctaaccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagcgtgatgcctccagctttgttcttttggctcaggattgacttggcgatgcgggctcttttttggttccatatgaactttaaagtattgttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctcgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgaatattttcacaacctactcgtctgaaaaagggctaatatccagaatctacaatgaactcaaacaaatttacaagaaaaaaacaaacaaccctatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaacggcaatcattaaaaagtcaagaaacaacaggtgctggagaggatgtggagaaataggaacacttttacactgttggtgggattgtaaactagttcaaccattgtggaagtcagtgtggcgattcctcagggatctagaactagaaataccatttgacccaggcatcccattactgggtatatacccaaaggactataaatcatgctgctataaagacacatgcacacgtatgtttattgcggcattattcacaatagcaaaaacttggaaccaacccaaatgtccaacaatgatagactggattaaggaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattcttactcataggtgggaattgaataatgagaacacatggacacaggaaggggaacatcacactctggggactgttgtggggtggggggaggcgggagggatagcactgggaaatatacctaatgctagatgacgagttagtgggtgcagcgcaccagcaaggcacatgtatacatatgtaactaacctgcacattgtgcacatgtaccctaaaacttaaagtataataataataaataaatacattaaaataaataaataaataaaaatttgacatgtttccaaagaaaaaaaaaaaaagtcaaatgagattttaaaatatttcccaagtgttatctgagagatcactttgagagaaggaaagcaagcggtgtttgtcatgagcttcgtccaaatcagaggccttgagtgttcggaggatcatctaaacccatgaaaaaaatcagctggcaggagcccatatgggtcaagatggcttctggagatagataaaagcggatgtctgaagtagactccctacttcccagctgtaactggcagtagagtaatcttgctaggaccaaatatcctttggtactgcatacatcaatagcactagctaaaaagattgatctgagttatccatttattttagagtttaaaatacactctccacagcatcttttttccactgggaatccagagatgttttacttcccgtctctataaaaagccgcctcacaatttacagggccactgcccactcttcatactttaaaagatatagataggaattcagaagaataagaatccctccttatttgcagatcaaatttacccttcagcaaacttcatgggctgacacattacccttgagcagggggtatagatatacaatcattaagaataatcaccaaatatttcaatttacttgatttaacaagcttttaaaatccattgcaagggggtaaaatttgattaataaactgcaggccacataaggatcttgtacaaggtgacttatttaactgactccacagaaaagtcaacaagcaatccattgatcacaacatgcaaacaattcctacttgagtgtcccactggcttagcggcagatttgggtctcaattgctgatcaatttctgcattatgattctggcatgaaacagctctctaggaaagggacgacatcataaagatgtgtataagagaaagaagatggctgagccctggcctcacggactttttgtcacgcccttttcaatcagctagaatccaatctgataatcatttactgtgtcttaagggacgagagcacgtgtgtacattagatcctgtatacgtttacgctgcacatttagattgagtgtgtactgtgtgcctgtcactaccataagtcactatgggttcagagataaaacaaatagctctatgtaaggtgctcacagtctagacaggcagagaataggaaatatagaacagcaatacactgaaataagtgaaattgcagagatatgcacaggcgtgaaagtcatttagagggtggagaacataggggagttttgagttgactgatggagctgaaatatgggcaaatgttggaaaggaatactttgcaccagactgcaaagatcaaataataacaaattcagggatgtgtgttttagtctgcttatattgcagagggactgaaggatttttaactgaatgacagcatccattccaaacttcatcagacaacaggatagaaggcagagtttcagctcagtgaagtatgttttatcaaactgtccaggatggtttctgagtaacacataaaaatgtaaatcactgtgggaaagcagctgtaattcacgatgacataaaaaccactttaaatcataaacacaaagcagggaaagaaaaagcttcttaaagtgggaagggagagaaagtggggcttaaaatagataatgaagaatgattttaaatcttgttatgctggcacgtaaatggttttgcatcagacaattctagagaaaggtatgtgattccaagtgggagtcatgttcaggatgagatacccaagcagtctgacatatgcttgcagtctactaggcgtaggctttcgccgaagggcctaagcctaggggaggcttaatcacagatcccacgctgtggccctttccctgcatcctggccatgtgaactatagtaaaagtgaaattgtatgagactgcgagaaagacctatgcatttccaagccaagtctccctcagcaggtggggaaaattggggggaaggtacagaccatgtccctgtaaaggctgctcagtaactcctatgctctgaccagctcttgagatggtgtcagaacctgttgatttccttctccactgcagcttgattcatccacactaatgcagttctgcacgaacaacagcctcaagatggaatcccaacacaggttccaggctccatcctttctggagtcaggtttgaggacaagccttttacctctatgcacagagagaaacatctgagtgaatgcaactgatggaaatcaaatatttaaaagtaaacatttttgggccgatgtggtggctcatgcctataatcccagcactttgggaggctgagatgggtggattgcctgaggtcaggagttcaggaccagcctggccaacgtggggaaaccttgtctctactaaaaatacaaaattagccaggcatgatggcacacacctgtaatcccagctaattgggaggctgaggcaggagaattgcttgaacctgggagacagagcttgcagtgagccaagatcacgctgttgcactccagtctgggcgacaagagtgaaacattttcattaacatttcaaattttaaaaatgagtatgattgggccgggcgcagtggctcacgcctgtaatgccagcactttgggaggccgaggcgggtggatcatgaggtcaggagatcaagaccatcctggctaacatggtgaaaccctgtctccactaaaaaaaattagccaggcgtggtggccagcgccagttgtcccagctacttgggaggctgagacaggagaatggttgtgaagccgggaggtggagcttgcagtgagccgagaacgcgccactgcactccagcctgggctacagagcgagactccatctcaaaaaaaaaaagagtatgatcacattaaaaagaagtaaacatttcagcttagagcatactacatttttaaaattaaatgcttcccctagttttcaatattatacatgaatgtatttgcttcatttttacaaacacatggcaggtatacatgaagctgtggctgctcagtcaatgccaagcaaaaggcctgaagtcctaaccttgaaatgcccaatgatgagttaataaagtcagcaacattaacatgtgctcttttacagccaaataaccaaccacaaccaaaagagtatttaatatttgctttcatttataaggtaaccagtgcattacaaaaaagttaaaaagcctacgattctctgaataacttggaactcctataagcaacacttgacaaattagcaacatgggcgtggaggtgtcctggcctttgaacacgaagatgatgatgtcttccttgtcatgctgccagtctagagcacacatagacttgcgtttctaattatgataataactcatctggccacatccacagatcatcccattgcatttgtgaccaacagcacacacgttcaaaatagctggttgaaatgaggtatgcctattggttatggaataagcacagggaagtgaactaatcagatagatattatagtagtaagtgagggtgaatttctacttcagaatagataccttcaaagatttcctttaacaagttcttgtggatcctggtagacccaaagaaaaagcacactttttcttcttagaaaggaagtgaagataccttattagttatgagaaaatatgacagactttgttccaaagcactgcaggaagtgctcggtaatcctgcaattggcacaaagtctacagggctttaaatcaaggggcctcgggatgatcagggaaaggactgtgaataagctgccaacctgtgttttgccttgaaggctgggcagggctgtcaggtactcagacattttctctcacctccaaactcttccacactctgctctggatgctatagacacaactgtgccaactacttttcccaaaatgttttgccagctggatttggtgagctgtcaacaggaggcaggaattcacaatgcaggagaagaggcaagggaacttccttattcctgtctgcttgcggtttgtgtcagcaaaatcacatgagctcaagttccccagcagtggcgcgctgtcccagaagcagctgttttttcccctcctctggcttcttttgccacttccaagaacagtttatcttgcccctctaaggagccagtggcaagcgggtctttaggtaagaagccttgaaggaagggagaagggctgctttctctgggaggggagaatcagagagatttggaaattcaaaatcagctttgtctgaatctatttagatgactccagtctcagggtccaatatcttgccaatcactctgactttcacacacaaggctgtttgaaggttcttgaacttaattgtaattctgtaacattttggatgttattttctgcaactcagccctatgactaagaggggagaaagttatcattatctttttagttcttcaggccaaaatagaagttctctgttttgttgttgttgttcttgttgttatttcaggtagggtcttgctctgtcatccagactggagctcagtggcgagactgtggctcactgcagcctcaacttctcaggctccagtgatcctcccacatcgacgagtaactgggaccacaagcacacccagctaatttttatatttttttgcagagacaaggtttcaccctgttgctaaggctggtatggaactcctgggctcaagcaattctcctgcttcatcctcccaaagcattgggattataggcgtgagccactgtgcttggcccatttattttttataaaaagtatcccgagtttatgatttcctatcactagacttctagccatttaaccccatagtccttgtcatcatcatttctatcatcacaggtaggtattgcaaggactttcacctaataggacaaccatgagctggagtaagggaaacatacatttctgctcaggattatcagctctgaactgcaaccaattcatggtaactaaaactccatgttggtcaccaaagtggaggcttttggtggtaaggtgataaatggatgaggcccacgtctattttacggagattgcagaaggttcagaaatgcatcacttggttatttttctagttcctgaatatgtaattagaacagacatttgcagcaactggcagaattcctgcatgtctctctgccccctggtgtgagcgatattaaaccagagccaggaggcttctaaaatatgaccttcctaccagaggatgttaatattgctgggggaagggcaacgattaatatctctgtcaaagatttgaaaaaggcaagtctcatctacttactccatactcatttaactcacctgtttggcccatgcacaaagcagttggacttagagaataattgtgaattaccataaatttacttagcttgtgattgcaattgcagctgctcttccagatatgatattttcactggaacaaataaacacagctcctggcatctggcagtttacaccttttgatcaggcaaattaattcatagcaactttcaaggatcaccaaaagccatttgcttttgcttggtcgggtccacatagcacctgcacttttctctgggtgatgtcaactctcctgctctttgtcctgactacatttgcagaaatgttgatcatgcttacctcaaactaactatactgacaacatgtaccacacagaccagatgaacagaaaatagcaaataccttaaatgtctgaataagatgtatgccaacccgtggaaaataaagcccatgaaaatgtaggcaccatcattttagtgaagttcttgggggttgaatgcttccgagcatgtgaggatataccctccaagttaaaaggtgagtttctggaaattgcaatgtgcttaccactaaaaaagaaggacagtacttgatgggcctccttgggcttatatgtcacttgtactgctttcacccatttatcaagaaatgtgtaaggctaccagttttgattggagtcttgggcaagagaggactgctgcagattcagatggcagtgcaagctgctttgccttatgacaagggccttatgatccaacagatacaattatatgtcaatgtctatgacaaacagaggttctgttgtggttagctgctgggtcctgatacagactaaacacctcattctatgaacataaagaaaccatgtggggtggccatgatgaaggggatgagagctggcctgctgcatctctgctggctcagctcatacctgtggactcctaggagagagaattttgaccaaatcacataggaatgaaaaacctcaggccttatttacagatgagcagtacaatatactgtcactaaaacactggttgatgcagcatgtggttatttacttggtcaagattgagacagaagtataggaaacagtgattatttggtgatcattaggggtctggttggaaggtaaggggcttggaaagaatgggattagaaggctgaaaacaaattgttcttactgaatcctcaaaactgagtctccagtgtgaagatatctgcactccatagaaatgctctctcaagggggttcactgcagaggaggctgtcagtaatcgggccaacaagacgacatgccctgtgaatgtcatggagcctctttcctcagcctctcctatttaccagatgaatcctgtggcaaagacagagctatgcttgggcagcatacaacctcctctcgccaaggctgatctgctaccaacactcctgtgtgctcatctcctgcagcagtgagtgctcagcatggaacagggcacagttctcccagaaggggcctcttaggagtgggttgattactttggacccttacattatgcaggaggcagcaaacggtcctcgctggaaaaggcatttattttgggtatggattcatcattcctgtctgccttgtttctagaaaaatcattgtccacaggtttatagaatatcctagtcacgatatggcactcacacacatgcttcagaacaatgaactcattttgctgcaaaggaagtatggcaatgggatcatgtctgttgatttttctcatattatcaagtctcccagaagcagctgggctgatggactgctgactgacctagaaaagccttagtggtggtgtcagtaggtgacaacatttggatagcctggggctcaatctgttctatctatctatctatctatctatctatctatctatctatctctgatatatatttgaattcttatatatgcgctgacccagcaaccaatatatggtgctgcttctctcactgccagaaaacacacctgcagaatcaactggatgatgtgggagtggctgctttcactactatatctaataacccattcacagaatgtttcattcgtgtcttctcagctctgggctctgctggtttaaatgtcttcgtacccaagagggcaaggtttccaccaggagaaacaaaaatagttaaaaaaaaaaaaaaaagttgagactggtacttgcccattttgagttccttaaacactgaagtaacaagaaaaaacgggggatactatgttgcctgggatgctggtcacaatttctagggaaaaactgaattgctactacacagtagtgagggagagaaatggatctcatttacaggggaattcctgtggcagctcatggtatttccatgtccaaaagtacaagttaatgaaaactatggcaaccaataaagattaaactgttgggtatttagagctttcaggaatgaagatttgggtcacattatacaatgggaaaaaaaggcaacctccaaacagattatggctgaaggaaaaggtaatagaagaggaactgtagaaaagagatgttataaacaaatataaacttatcagttatatgaatacagtgtaaatataggtatgtatatggtaactaatatttcatttcttctttaccgccactagttacttatatgtttgtaattttgtggttaactttatcatttaagttattctttaggttataagattctgttgcaagtaagaagaaactacaagagaaattaacatcttttagacaaggatagtatgatggttggaaattgtgtcttccattgctcaggagaggccaagagagtgtttgaacgaatagttattttttattaggtatacccatggagtatttactgttatgaaaaggaagtttgagtatgtgcaaagcagtatatgttctgaaaagatatggtcagtgtggacccaaagggttggtcaatatgaattacttaactattgtttctaacatcaaaaccctccatttgtattctattctctaatgttttgacattaaattactcaaaactcttaacagctagtttcttgttagactataccgagaggaggcactagagggagactggaaaacaagaggaagggagaaggggcttttcttcttcctgttgagttgattgccctgtaagtatcactctggcagcagcacacaacccgagcaacaattgcttctcccagaagcagcacttagtccaagcaccagctgttgtttccagcctctagttagttttaagcaaggagaactagcctcatcatgccattttgatgatccaaacccagctccgagaaaagtcccatctgtgagctttcagattctgacaaacctactctcttccacttcctttcaccaacaccagggctggtgggagcttcttactgttagcatgtctcaattcccttaatatttcatttttgcttttcagttttctaactctgtgtaatgaattctctacttaaaatttcctctgcaaaaaaccagtgggatctgtctttccctcgctgggaaagggacagagcagggttttaatcagtgaggttgggagttcactacactacattaagtacaaagttgtaaagagcctaagccagggatgaataacagcagacattaagcaagaaaagcccattgagctggaatctgatttgaaatgcaattgaaaagggagaaaatcaaagataaccgcaggctctgtggctgggtgaatggagtatgaacgttgaggttgtgggtgtggctgggagacattgaatttgaggtgtctggggagcataaagatgaacattttcacaagcaagtgagaactgtctaacatccaagaaaatgccacgggattaaaaataaagacttgaggagaatctgcagataagtctatttcactctgagggagtataagacagctggataggagagttttgagaaggaaaaggcagacgccaagaagtaaccttcgggaccatccatgtttcgggtgctgaggagcatggcaagtcagccagaacaattaatcagggttagtcatggaagaatgactaagaaggaatgaaatccctcagtcaagtgtcaaagaagtcagggaagtcttagaaagtgggagcctggagaggaagtcagggtcagtggtgccaaatgcttgcataggaagctctgccggcatcaagtacgattattatagaaagtgaggaattctctcaaatgccaccttccaacctgccagctgtcctgtgggaatgtgacacgtagtcctcagttctgatttaataagaatgacactaacagttagcaaacatagaaacgggaaaaacgctgccaacatcgtgtagcacatccctaaatacagcccatagggactgtctccacatgcttcagaatccagccccggagctccacgaataactgcatgtgagtccacgggcggcaccacacctcagagggagaaacacagccccccttacattctcaaggaggcgctgcttttgatcttttattttcctttgagttcttcactggcgcagaactttgttctatttgattgcaacatgtaaatattatcatcatgtcttcctttattagggacaatatttttttccctacaaaagacttgagctgaaagacataaaacactgtttcagtttcaggaattctagggaggattagaagaaagggttagaacacgattacccctgtggaaatctagggaaaagatcccatacctattttcttgtctttacccacccaactactcacaacccgtcacttatacacaaacaaatagtcactgtgcaacacatcttctatttctggtaacgtaccatggccaaagtcataaaagggtcaattattgaacctggtagagctggtggcaattttcaaacagaggcacaactcacatttaaagatgatacatggcaggtactcaataagtatttgttgaatgaaggtgtaaatggctgtttgatggctaagacatgtcttgtctaggtttgtgactccgttacagttggagggtgaattgctgtatttaaaacgggtagagaactgtcagagatattacctgctacgaagatcgtcagatctattagatatggatgatgtttcattgccagaaacagcttcacctaaaaattagcagccacagaagcagggcttctgtagattatgatgtctaacagatcaactccatatatgatacatggttgcaaatttgagcaacataataatatttttgggtgcctattaactgttttaacactgtgaaaaagcacagtgggagataaaggaagaaacaatggctgtgctatatgcatgcttatcactgcagaaacaaagaccgagacacagagttctcattctcattcccaatgggaagcagcactaaacacagagttctgcatgtggacgtgctatcagggcttagccagtggtacctggtcatttctgaactcatgaaatagatgatgcattaatatactgaaatttgtttttctaaagccctcaaggattgttacttatcctttaaccgtggctgcctaaaactggcttaattggtttcgattgatttaacaacccttcttcacttagtttatcgttatttaggaaaaggtcaaattatgtggtcattgttgccatggttcattttggaatagcaaagtcacacattttcacaagttttctcattgacaaattaaataaatgtccatttttagcaaggtttctcattgtgaggagcccctcctctcctctaggctccaaaccacatttaatcctcctgcagaccagctaccaaatgtttatttctcctgagcttttgcagctactcttggtccaccttgagttaaaattagaatttctctggatctatcaagaaatatctctcttctatgccccagtgtctgttcaaccaacagtctcctcttttactctaattcattttcctgtttgtttgtttgtttgtttgtttgcttttccctaggaagtatgagcattcccttgtttaatattttcctcatgttacattttacactttcccatgttctctcactgaactgcactttgcatttattcagttaaatgtagattgcttccagtacatactgtgacataacatgtttaataactgaaatccagaacagatattatctgcaccaatgtagtgtcacattcaattacaagctcccagttcttttcctttttacattattgatttctaaaccaataaaatggatacttattcaaagccagaaggatttcaagaaatatattgaaataactgtcagataatcttggtgaactttgtaacaaaatcaattatacaatgttcgtaccaagttgcaaaggcaaggcacgctgccgctgtgactacctgcctaatgcactcaatgccaaatgacttttctcccagacacaacatgaaaagcctgttactcaaaaggtgctagtctaccaactcaacttttgctttccaaatataatgcttttcattgctgtctagcaaaaaggagctaaagagtgagaaagatgagttaaaaatgcaaaccaaaggaaacttaaagacccaaaggttcaaaaatcagtaggcatactaaaataacattatttctcttctttgctatgtttctctagaagtagtgaaataagtgagtaccttataccataatttcacatcccaggaatcaatggccaagtatagccatagaaagagttgcggtgaaaaaactgaggaatcaaatgagaaaagaaacattgtaataaaatgtgcatcgttgagtcatagggaaaatctgccttcaaaacttttcctagaaattataaaaactgcccattactttgaataacacattgtaattttaaaatacttcactacataaaaaggcaaattaaaagaatcctttgattgttccatccctatggagccttatgaatcccataatccttgagaggtatctttactggcatacttataaatacacaattaaaatatacaatgaaaatccagtaggtattcatcccttcacttgcgggactccagctatggcagtatgagagctctgtactcctcacctcttcacactatttcttctgcatgatacaactcttctacttcagccctacttctcttgttaagaatgtttactcaactgagaggtcacatcctcagtgagacttcttattgccaaaaaactccactgggctcccttatgcttatttcctccagaactttctgctttccttccctcagctttactgcagtaactactgaatgtcttcagtgctagagtgtgggcctcctgagggcaagagccatgtctcttctgttcacaacagcattgccagtaccttactcaatgcctatcacataacagaaaatatgtagatgtcaaattagtaaatgaaagtgtgaagtggatggtaaaaagtcatcatagtaaatcactaaaggggttcctttacctgttttgcatatatttgtgtttttaaggggtcatacagcctgaagatacactatatatatttgactacagataatgcatcaaagcattggatttttatggtagaagaacaacatctagatcatagtatgtggcaaaaagtgagagagatgggaaagaggccaaacgtagacagcatctgtaagccatagcaccagccgactgtacaatctcacaccttactataggagagaaagcaagtccacattatcttttcagtagtgcatttatactacaagtatcctgataagaaaagttgtcttgggccctgttattttctgaatgtatgtatacctcccaaaatttatatatggaaacctaatccccaatgtgatagcattaagggtgggggcctttgggaagtgattaggtcacaagggcagagccctcatggatgggattagggcccttataaaagaggccccagagagctgcctcgcctcttccaccataagaggttgcataaagaaggtgcccatctatgagaaactcctcagaagacacctaatctgctggacaccttgatcttgaagttccagcctccagaactttgagaaagaattgctgctgtttctaagccacccaatttgtgacattcttttattagcagtctgaggtgactaacaagccctaattcacttaaatggtaaatgaatgctttaaaatgtacactcaaccaacattttgagaatcatctaaaggataacatcatatagggactgatcaaagggttttatgatcctaatgaatgtgaaaccacaggctacaaaaattctcaagagcaaaaattcctgatcagattttatcagaatttactgggtagctttatattaagtacttcatcatcattaatataccttaggtttcttaaatgagctttaattttatttacaatagataacattttgttggcatctacaaattctgggaaatattagagaaagtaacatgaatacagctttaattaaataaagattcaaatataaataagtgtttgcaactggtataaaatgtcatctttgtggaagcattttatcagcttaacattttgctgctactaacatagatgaggcagaactaatatggccagaagcaaggagaaacatgcatggaataagtgctgtaaatttttttctagagctatatattccttagtcagcatgcaaggaaaatggtaaacaaacaaggatgctaaataagaaaaacttggaacgttcctcaatgtaccaaacagagtgtgaatatgccacttcattagagggtggagcattctaattttataaaataaagttaaatatactaatttcattttcaaatatttaacactttactataaaatacttttcctgatgtgaggactgattcacagaactgcataaggttatttataatgttttataaatattatttgaaatgatatataatggcctacttcttaaattatagagtaaatatatacagtaagtccaaaactatttttacaacatctgagaaacaaattttcccctgtagagtgtttacactgaggaaaaaacagctagattatagaagttaaaaatatacgaaaataggaaataatatgtactaattaaagtaagaaaaaaatgagccttacagtctcagaggctttagaattgaggagtagagaatgaagcttgcttctcaattagctttggaaaaataataaagaacaaaacagctctccaacacaaggctccatcttattgtacagaccctaccaaacgaagaatgatctttctggcccccaaatacaggaatctaccactctgcagcctgtcctcacttctcttctgccccactgccccacaaacacctttcgaatgcccacaaatgcctctcacctcagaaatccttttttgtcttgatactgcttcttaaatagaaatatcttgttttagtcaaacccattcatttcatctatcacacaacagaaggtttctatttttagaggtcaaaaatctcagtgataacccaataaaatcaaacctcttcacgggtaacaactgtatacacacacacacacacggacacgtaattttgcatgcatttcaaggtttacagagcaggtccaggtctgatgttaaatcaatgtgcatcagaatggctcgaatgccagtaaaatatggccagggtccattttgattggctgtagtgtgcattcacattgggaggtgcccaggaacaaccagttgataaatatttagaatagcactctctctggggacatggatcccaacctagatagtagcagtaggaaatcaatgcactgctacatctatggtgactatccatcatacaggaagctatgtatgatacatactgaatgcaatttatattttgcagccaggaagagtctcacttctaggtttaccactcacttgctgtgtgatacaaggacatttatttcttcctaaacttaaattttcttatctgtaaaatggagataaataatatttttgtcacaggattagataaagaataatatgaaaagtatctagtgtctggtaaaaaatggatcctcaccaaatagatgatataatgacaaggacaacaatgctgaaatgtttatcatttagataatcttaacagctcaaccctcccttttgctctacgatgcccgagttcaaaatacttttcttaaaatttatatttcattcacaatcatttctatttcaaaatccttcctttccctgaaaatcacagcttcatggcattcattaatgatgaggcaattcccaccaccatgacagccttggtcatgaactacttgcagattcagcttaataatgactgactgagaatgcatcagatgctaggcattatatacacagaaattttaggagatcacatgatgacaccctctaaacaggagcctgaggaacagcagcttcaagtgagaaacttttcacagggcaaataacatctaaaataccaaccagaatacacagtaatgcaataatggccaaatgaattttagttgtataatgttctctcttttcacattgttttcatagcacacatttccaggtttctataaaaatcagccaatgatgaaaagcaacatttgttatcttagtttatattagtaactcgatttcccctaggactgctatagatgtggaaggggtttgggactgaattaatgaagctatttggataacagctgaaataagatccaggaatgaaataatgtatctataaatctttttctgtgtctttagattctgcaatcccttgagctactttcttggtacctggaggagaaaatgattattttaattttaaaaagccagtaggtgtaaatatatgctgagccttagaaacaagccttaaatttttccaaagatacttcatatatttcagatacaaaaatgtaagattttttgcactgccaatcttctaataaagacttaaagaaaagagaacatttaaaaatgtttattcatcatccatttcttcagcaaatgtaaaggtagagtctacaatctataggatcctatatggggtggggttggcaagtgcttcagtcatggtctgtgccttcaaggacatcacgggctgggcatggagtgtggacttgcacaccaacaccgccgacgtgtggtgatggttaactgatcacttacagataacatgccatgacagctcataggataaagcattacatagagctgggttttgttaccgaagaatgaggtttgagttgacccctgaagatgggaaggagtggacacagagaggagaaagaacatcatatgcagtgggaacaaacatttctgaaggtaacaaattctgctgagaagtgactgatgtgaaactttgggaagtagtcgtgaaaaggcagattggtgttggattgcagattcatactctgggtcatgacggctgggctctatttaagaaaccctcattgtttttacagtgcctgacatatgctacctgctgaataaaaatgtgaggaatgaaatggccagagcttcacctcgaccacggacaggccataccagaggcagcaaggcacacaatagaatactctgcattcagagtctcctcctaataattagcatgaccttgggtatatgcagtatcttgtctgagaaggaatatttcaatctacacgatggacataataactatcttatctaacggggtgtttgtgaggttcaaatgcaatcatcactgttgaaatgtactggaataataacgacgttgtaactagcacagaagagaccagtatgacatctattaattattccaataagaggtggtgaccacctgaagtggaaatggggaggcagggtctggtgtcaggggtaaaggacagttcaaagttgaaggcaacagggccaggactccagggcatctctatctctgaaatctactctgataagtgctgtggacaaaaatcaagcagagcggtgggatggcgggttataagagggtgggcagagaaaccatcttagaggagacggcttagagctgagatttaaaggaatgaacgccttccaggcagaaagaacagaatgtacaaaggtcctgatgcaggagctcagtaacgatactgagtgaacagtctagaagctcatttggccacagcaccgtggccattgtcggggcagcagaacatgtgcttggagagatggccacaatcacatcaggacagtcccatgggcacagtggacttagggttttactgtgaatgtgatgggcaggcagatggtttgtgtctgaaaaatgttagaaggatcactctggctgctgtgtgagaatcagctgagaacattctagacattgaagactgataggaataggactgggcaggaggctgctgcctggaggcaccatgagggatgatggtgtttgaacaagagaatagaagtgagggatctgtgaagtgatcggattcaaggtctagctggaggtagcgtcagcaacgctgctgatggattagatgggggcctgtataagaaagacaggagtcagataggacttgaagatatttgtccttagcaactgagagagcagtggtgctgtgctctggggtaatggtctcttcagggaagggcaggtttggcaggaagtatttagagttctatttgggacatgtaatatttgagatgctagttccccatcctactatccaatgggtagctgaatatacaaggatggagaaagggagagaaatagggctggaaatatcaattttgtagtcatccatgtataatatcacagaaagccatgggcacgaatgacaataatttaaaaggtataataatagagaagagttttaaaatgagatatgggtgctcagttcttgggttgctgggaagatgaggaagagtcgtcagggcagccaaagagaagtggcccatgtggccggtgtgcattcggcggactctgatgtcccagaagtcatgaaagaaaatgaccatgtcatttggggatgtgaggattcttggagtcgttttgaagagtggtaggaggaaatgacaggctagagtgggaggtgagcatggagagatgctgagcctagatattttttgaggcatttttagtagaaaaagaaagagagaatttgggtagtagatggtaagtgtgaagaaatatggaaggttatttacgaaataatgtaacttgggagatgctacaacaagattctgtctgatacgaatgaattacccagtatacgtcctcttattaaatatttacaaaactctatatggtaggtgttatcactattttagggatgagaaaatggatttgcaagggagacacatggtccaagacagcatgggaactggtggagctgagaaggaattccagctcaactgaacactacagtggaagcttgagtacatatacaatgtcaccaccagagtacatttacaatgtcaataaaatcattttttaactcacatctgggaagcaagatagcaccagactttgggttaaaggaaaaatctccaaatctcttattagttgaaaaaccttgctttcctttgttttgtttgtttatttggttgtttgcttgttttataagttactgatggaagagaacatcaaatattcgccagatacatgtgcagaacatttcagagctagggaggtggccaggagaagtttcagaagggagagtgaagtgaatgggcccagacacttcaaggacatggaatttatttaactagaatgtctgagtaggaataaatgaaggcagaagaaagttgaaaaattttggatgatctagttaaaggctttgaagcaaagagtgaggatttggacctgcttctctttagagtgaaagctactctgagatcaaagccataggtgaaaagaaaggttgacagcagcatggagaattgattggaaaaaggttttgatggaggcagagagtgccaaaaagaaagagtggatgtcagctcattcttctggtaagtaattacaataatgaccctatgctagcactgttgaaaactaaagattagagtccattattacaatagagctatttttacacgagaaaaaatcccaaggtttaatcgaaactgttcatactgaaactatgacaagccaattgttcctagtacttttaataagaaatatacatgttataacaaaacctatcactacaactgggaataacacagagcatcccaccttactgatggcatatcagtagcatcaccttttacataaagaaattctgtctaattcacaaaatatactatttttagggaataataaaatattagttttgttgttgttgtttggcttttacagactgggtcttcccctgtctcccaggctggagtgcagtggcctgatcatagctcactgtagtctctaacccctaggctcaagagatcttcctgtctcagcctcccaaagtgctgagattacaggtttgagccaccaggactagctaaaacaccgcgattaaaggcacagaaaacatttttacttttattcccgattagttgtcctaactgaaattttaaaagaagtcattgaatatggaatctgagaaattagaacaacagtaaattagatcctagctcttcagtgggttggaaggtgcatacttcattcacctattaagctgacatttatttatacctacagactgactgaggcaacagaaagagaaaaagtgctttttgataatacactgaggctcaaaattttaaatcagagttgaaatcatcacttcacaaagtctgctggagtgctgaggccatctgtctccttgccctgactcttgtctccacgtcagtgacagtgtgtgtagctgactgtggatctgcagatgagagggtctttgcaatgggctggtcagagaaggtagaaggtgaaaggtgaaaggtgaaaggctgaaggaatgggggaggggaggggccattttcagtctccttttctgacattactgatcatttctgatcacaaaagtaagggactccttgggattgcaaaccactttatttaaagaacaaaataaaagtcatattaggatgaactaagtaatatatttacattctacaaaagcgctcaaaatacagtctttattcaaaagcccaagtcagatggattttctcactgaagccttgctgagtccctcaactggagttcaccctcagccctgagtcccccagaatacattgtacatatattttaggaaagaaacatgttctactttctaaatttctgttaaaacataatgtatttatgtatatataaatatatataaataaatatatttttataaattgtagataatctacagaatttctataatatagaaattgtataggtataattttatatatattgtgtgttcatatatacatgcatatctcacacaggaacaggaaaaggaacatccaggaaaaacttcttcccctttagtaggattcacttaaggagaactcaacgatttgatgcatttcagctgtttgaatataacttagctactcagtaatacatatgcaagtattttaattctttttgaatcagcccaagtaagccttaggttctgaattctgccttgtgtaaatgtcacctcatttatttactaggtgcaaataatacactgctaagcgatatgtgttggcttccaagccatcagttatgggtttaaatttggaatctagaatttaccaggtatgtaatttggagtaagttaatttaatttcctaggcataagttgcctcatttcttaaaatggggtctatgcctccttggattgttgagaaaatgacatgggatgatatttggcaagtgttcattaaatggtagcctttgttttcagcatcatcactgtgatcagctgaattgctgattttcactttaactacaggaaacttgagtggaaaagtctgagtcatttatgtactcattacttcagcggatcaattccaagtaacaaagctagggcctctgcttattgtttattgtcagttgcctgaaagggaaatgtagaggaggccacttcatgtaacaacacagataactccaaaataaaggaattttatttatttatccacatttattaaaatatttactttgtaagtataaaaatatttaaaaataattaaatataattttatttatgaagtgggcagatgtataaagaggaatgtgtgaaaatgtatagaaaaaggatttatcttataagtacctcatttttaatgagactctaaaagaaacactcaatctattctaagaaaaatatagtaacatgactatcaaagaatcatttattaaaagccttcagcttcaagtgggttactttttaaaataaatgattttatttccaattaatttggaggtctggctgggaatataaaagaatattattgtgttgcacaggcttagaaatcaaacaagtctggactgaaatcatgacttgctatttaccagctactcaaactttcttggggtcagtgtccttatttataaaatggaggcaatattagtatatatttaagcaaatgtctgtagagattacaggaagcaggtgaggtacctaaaactacctgagacacctagttcttcactttaagggttatctgctttgctaatttctctcacactataagcagctagaaaaatagagaaacaactgttttctgactgtctcagtctgttttgtgctgctataacagaactcctgacactgggtaaattaggaacagaaatgtattggctcacagctctggggactgggaggtccagtatcaaggtgctggcatctggcaaggtctttgtgttgtgtcatgacatagtgaaatgcatcacatggcagaatggcaagagagagcaaagggggctgaacttgccctttcataatgggtccactcctgagataacaaacttactctaggacatgaatccactcatgagggcagagccccgatggcttatcgcctcttaaaggtcccatctcttcacactgttacaatggcaattaaatttcaacatgagttttggaagggacaaacattcaaaccatagtggatatatagaagttatatatataaaatacatatgattggactgaggtaatgcgggactgtgatcccgacgtgaaggaaacctacaaagatttggccttgttagctatagcagaggaagggagacaccaaacaaagcctagaagtctcggtgaactggggaaccacaaatcgaagtttagggaggttaaggaaactagaattttcaggacacaatacctaaaagaagtgacttgcacagagagagttctggaaatttgcggatagactaccttgaatctctggctgaatattatttttccgtacatgcatggggttaacaattctcaaagctcacacggaggtgggatattttgcattcccaccagacagagtggagagaccttatggtacttgaggcatctggtagagttgccagaagactactgtcatcatggtggggctaaattacccatagcattatggctcttctggatgccccagcaaagcataaaagcaagtctcaaaaggaattgatgtcgactagctcaactgttgcctgcataaagacaaactttttttaaacagaatgctacaaaatccaccacctaatgtacaatgtctggaatctagtaaatcactatgaatcgtgcaaagaaacataaaaataggaaccacaaccaggagaaaaatcaatcaattaaaaaagatccagaaatgacagagataatgaaattcatagtcaagaatatttagctactattacaaacatgctccatatgtccaaggaagtagagggaaagaggatcatgatgaggagaaaagtgagtgttgaaagtctcaaatgtaatatatggagagaaaaaaataccatattttcaataaagatacactagagagattaacaattgattagataatgcagaagggaaaaaggcagtgaatgtgaagaaatagcaagagaacccattcataactcatctcaccaagaaaatagggccagagtatcagtgacctatgaagcaataccaagtggtccaacacaggagaaattggtgctgcccatccaagcaaggaaataacaaggggagataaagcaaagcttgagaatttttagaagttggaaggtaactaagagaaagcaagagtgggggctaagaatgatggaagacatgatcgatgccttcagtccttccttgatacccagagatgggccattacctccttaaaaagaagtttaaagtaatgaaactcaatttgacacaatactgaaaaatggagttgtattcatgcatatattgtacattttgctgtcactattttaggggatggtggcagaaaccaaaggaggctcttaatgcctttggcatcaacaatggtgtttccttggcatctacactaacacgccttaattaacctatcaccatcttaagtccttgtagattaaaattgggtgaaaatttttagaataagtatctacaaaaatataaagccttcccttgaagagcggacaactgtggaaatatacaaagaatggaaaaatccactaacaagtgacgtgacacagaaagacgaatacaggcacagggaagagacaatttgaacagaggcttatgaggacgtcgggtgtgggaagggcccactgcagggtaaagagaatcagcatggcagtatgatggaaacacacccatagcactctccacagcatcacagtcatctccatgtatgggccatggtggtcagtttgcctaaaactagcactgggaatgacagcttgttctcagcttagctgtggactcacactgagagattaggtttcataaagcagaaacgtacatcagcctcagaggacatgagtaaaaagtataaaaacagacccgcacctatacataggaataaaatgaagtatctgtaggtaccagttgatctgaaatggcccactccaacgaacagaaggtgcctgcctgcaagcctactttgagttgttttaaacattatgaacctgacagagcgagactccatctcaaaaaaaaaaaaaaattatgaacctgccaggatactgaataaatgctacttagtacaaatgtccaaatataggaaagtccattatatttttggaaacttaatgtcaccaatgacttcatttattaaaaaggcactctgcatgtgagataaagttgggtatttgaatgattttaagtcactaaatagttctgtgaaaacagttcagcagaattagctattagaataaaagcattgtccttgataatatgattctgaacattcaattggggattgcattatgattcagttttcgcactctaaaatccaacttcccttttagtttcctgtttaaaattataatttctaagactaagagccacaattgcccttctagccttttgcttttcatgataatttagaaaaaaaagaaattgagaaacatatggcaggtaatcatttgcaaacacacgactctttcaatgcctgccatgttcaacttcattttatagcatctatcttggcaatataaattgtgtttggctgcagaggtatgcagtgcagtacaatgaagaaaagcaatcgtgacaactgaaaaataaacaacaaatgtgtgtttgtgagggagagaatgtgtgtgtgtatatgtgtgtgtggtttagacggcaccagctctctgcttttccggctttcttccaaaggggaatggtgttattttcgttggtttccttgttcccttttacagcaaagcaatgccactggaggaaagacaattgccacatctcagagggttgccaaatgacctcaaaccagttcaaaaggagcgccctcaccagttccacaaatgaaagcaatttaatgcaggtggattgggtcaggaatatttactattataaaggccatgttttttgaaacaagagcctacattatattaatttttaaaagtggtagcacaggaagactgtaagattatttatgatggccgggtgcagtggctcacgcctgtaatcccagctctttgggaggccgaggcgggcagatcacaacatcaggagatcgagaccatcctggctaacacggtgaaaccccgtctctactaaaaaacacacaaaaagtagccaggcgttgtggcgggcgcttatagtcccagctacttcggaggctgaggcaggagaatggcgtgaacccgggaggcggagcttgcagtgagccgagatcgcgccactgcactccagcctgggcgacagagtgagaccctgtcaccaaaataaataaataaataaataaaaataaaaataaaaaagattatttatgatatagtgactattcagaatgaaacatgctagcatactcacgtttttgtaaactttgactttcatgcaacttccccaaaattctctcaaaagtaagttttctgggtttttaataaaaattatcaaaagtatctaagattcaaaactttgaaagtatataactaagccttcaaaatcaaatcaaatttacctaatgctttatttttcaatgggttttgataaaccaagttaaatatatttggaatacttcaactgtgcaatctacagtttaatgtattcagagacattctagctcaaataagtgcagtcacttgtcttactgttcaattaacattcaaattaaccatttaaatttcaacatattttgctttattgattatgtattttaagacaacataaaaatgaaagaaaacatgcttgatttggaggcaatacatgcaaattacccatggcagtcaatattggtaatagagaaacttaaaaagcatccagttgatttcaaataaatgtagaatactgctatatagtatactttgcataagtggtatatactgttgggaagtagggggagcaaaagaagcttatgtacatggagttaacacacacgaagagcaggtataaagaaatagctgcccattgtcccatttgatggaagtagcctttttccctagagaagaagcattaaaggagagtcagtctaaccaggattatttgtgtgttatctgttctgaaaatagcgcactcaggcaagatgatcaccaaaacctttccataaatatagtctgcaatgcaccattgtaagctgtcccgtttactattttgactcatattaaatgccaagagtatgtaaacacatgatcacttatattaatatccatgcataagctgcttaaaagattttagttcacaaaactcagatacgaaactgcaataagtctgaaaagcagtaaggcaggagagaaggagagtagccaattaagaaatggatagaaaaaaaatgaaaatgcatagtgagaaggggtattatactggctaaatgtacaaccccaggtcatggggttacctgcaccagagaattccagatgctagccctggctcatgcagcacagatggcagcccagtggtgaagagcctgcatccggcagtcagacttcctggctccacatcctgtctctgccaggtacttgatgtatggctttggtcaagtaagttaaactctctctgcctcagtttcctcatttgaataatggagatgagcatcgttcctccattataggcttgttatggagactaaagcagttaatgatcataaaggtcttagaactgtggtgggaacatagtaagcgctatgtgtctcctagccgaatgaccatcctgaccccctggattttttatttatgcaataaagataacaacacagacctcaaaaggcacttataatcaaattatttgagttaatatttgtacagcattgcccacagtgaccaaaatagagtaaacaaacagtaaacagtaacagaatcagtattgctttagtgaagaaacagctaagatttaataaacacctaccatgctgagcactttacattattaattcattttatccgctaacaaccatgtttgaggtagattttatcatcatctctactacaaagatgggaaattggaaacaggtaaataataatgataaatactactagtctgaggaaagctactagaattgaataaaaaattacttataaaccaaggcaatcaacctaattaattagcctttggactttttctcagttaattcccaattttgtgactgaattggtcaagatgatttgcagtgttggcacgtaatacatggccaattgttctaggagatgttctttatttatttatacatgtgagaattactgaacaccttggcagaggccactagctagttgtcttggtgatacatatttttctccttcttccttgttgagtaatgagatatttaaggtggtaaaatggccacccacaacactagatttccaagtctcccttgcagctagaagtatcattgactaatttctggctaatgaaatgttggcagaaggttaaaattattccttaaatgcaaagaatgaagctggctggtacgagtctttatcagcaattctcctttcttcttcttgcttgcactatggacttgatggctgatgtgccatagaatgtcttggaccaagaggtgaccttgggaaaatagccatgcactataagggcaatgaggcagagatcctggttctcagtggtgatacatggcggctttagactacctatgaccagacttctactacagagaaaaatgtacacttctgtcagctttaaaatcactggaatttttggactttgttcctagcaggtgaatacaattcatgctgatatgagcagccatatgaactgaacatcaagggcaaacaagatacatttgaagaaaataagaatgcaaataattaaatgcaataaagcattgcacatattaggtaataaatagcacagggtataatgagattgcccaggagaaaagtgtttattctgtctgcatgggtttcttagaggtgatgaagcttgaattgagtcttgaaaaatgagaaggcatttgattcaagaagacaggagtgaagcgacgggctgcagccattccaggcacagagaactcatggggaaaaagtcacagagagatatgagtaattagatatttctgaatcaaactgttattagtcattagggtcaaaaatatataatttcatacagaacggatggcatatttgattgaataagacattataaaaattatctggctcatttaaagaaatctacatattcttctccatgtaatatgcttaaaagtggttgacacttaagaaggcaaagaaaggggctggtgatgcggcttgctatcacaggctctctctcaaaatgtaggtgctcactaccccagcttgaccctgttaccgcgcacacttggttgaggttaacaaagcgcacttggagagaactttaaaggcaacctttagaaaagcacaaatctccaataaattaatattctcccatcatgataaaaacacataaaatatgcaagatggattttaatattcatgactcacatctttcaaaagattggtgagatatcaaatgtgatacgataacaaaaaagcactttgtagaggtgctcaaagtactttcagcattaatgaattcttataatacccttgtaagaaagaatggaggcagagattattcaccataacttacagatgagatcgaggtggaaggatgctgtcagaagatcagctggtgtaggtttatggtgctccgagccttcctgggagctggcttccctacaatgtctgcagtaggtgcacacgaactgtaggacctatggtcacaggcccacccccaggtcaacctttggttgtagcttcaccactgcagagggggcataatgacagcttacatagttgatttcaggaacttttggtagttctaattgactgctgagaattgcaccaatttttagcttggcatgagcaaaaagcaaacagcttgcttgggttgctaaccctgactgtaaagcttcggcacagtggaaagtctcacactgacaggccttggtgagagaaccacatttgctccttatctagtaacatttaaggctacggtggagtgaaacgacgaggatgaacgtaaaaggcctagtacattaagggatgaggagcatagcaccaactcatcatttttagttcccagaacttaatcaaggattcaggctttcacacagaactcccattggtcatttctttttaatcactaattataagagagatcacagattaaatttccaaagaggaaaaatccctgatgacttcctgtagtcaaggtattcacttcaacgcaatttattacggaaattgaactcttctgatgatgatgggtaaaaataaccttcaatttcccttttaggtgtgtagacatacaagcaatccccacttttctcagctttgaattttgttgctctcagggtttagctgtttaataaagacctggatgtcaacagttcgtaccagtgttcaaacagataaagacaatacattcagaataaggatatgtagaataaaacacagggatttccccaaatggtgatttgggtggtctggggaaattgttcttttcctgtaagtaaggaccatctcattattttgtgctaagcataatgtcaggcccactgtgcctgggaatatttacacattggggggaattattgttgctagtggagagtcttgcctgcaagttgtccaggttcttggtattttgaacaaagaattagacaaatgcacagcaaagcaaggaacaaatgaagcaaagaaagcagagatttattgaaagcaaaagtacactccacagtgtgggagtgggtgaagcagcagctcaagggccccagataacagaatctttttgggtccaaatacccccagaggtttcccattggccacttggtggacatctcatgtaaatacagtgttggcccgcaatcagcatccaggtcagcttggctgcagaaagcaaccaatcaggctgaagtgaagttacaaaggtcatactcctaaacaaacatctgatgggcggcgaaaagcaaccaatcagaggctaaagttacaaagttgcacttctatgcaaatgaagacttggcctgtaatcagtctgactggttgcagacagcaccaatcagaggctgaagtgaagatacaaagtgacactactatgcaaacgtactttcaatttcccatctgccacacagaaaaggttggggtttgcaaagggagtagcctatggtccttttgttactcaggtgtggaatgttggggtttttgtttcaatttagttctaggaagtcagtgtgaaacggccttaggatccctgcctccagaccctattctcccaactgattatctctttttctatatagcacccacgtagccatccagcaaacatatgctaaagatagtagactagagatggacagtctggcccatgacgatgtcattgaacaatttagttatccaactccaaagcctctctacctctgaactcagtttataatcttttgcatttttgggggtaatatccaggtttgttcaagtgtgctgtaaattttatgttaacaaaacctaccttccctttggaaatcatgtaagaaaactaaaaataaatgtttagtaaatatatatatatatcgatagatagatagatatactaaacatatatatatacgtatgtatatatacacattatatatatataaattttttttttctgagaccgtcttgctcagtcacgcaagcaggaatgcagttgcaccatctcagctcactgcaagttccacctcccaggttcaagtgattctcccatctcagcctcccaagtagctgggactacaggcatgcaccatcatgcctggctaatttttgtgtttttagtagatacgaggtttcaccatgttggccaggttggtctcgaactcctgacctcaggtgatccgcccaccttggcctcccaaagtgctggggttacaggtgtgccaccacacctggcctacattctttttattcctcctgggctcaagtgattctcttgactcagcctcccgagtagctgagattacaggcatgggccaccacttctggctaatttctgtatttttagtagagacagggtttcacagtattggtcaggctggtttcaaactcctgacctcaggtgatccaccggcctcggcctcccaaagtgctgggattacaggcctgagctaccgtgcccggcctttttttattttgtctaaaaagatgcagggctgggtccggtagctcaggcctgtaatcccagcactttgggaggctgaggtgggaggatcacttgaggccaggagttcaagacaaggctggccaatatggtgaaacctcatctctactaaaaacacaaaaattacccactggcgtggtggcatatgcctgtagtcccaactactagggaggctaaggtgggagaatcatttgaacctgggaggtggaggctgcagtgagccaagattgtgccactgtattcaaccctgggtgacagaggaagactctgtctcagaaaaaaaaaaaaaaaaaaaaaaaagatacaggatcataccacgtctatgttggctacttccaatctctttctttagttgattttgtattgatgttgcaacctcaagggaacaaacacaggacattctcatgacatctgacacaggaaagggattagcaatgaatgtgacaatgtgaatatcatcttaaagcagatccagcctagtgagttcttctcagcattctggacaccctactaaatatgatttcatgataccttacagatttatattttttctttataaaatagaaagtaaactttttaagactgaatggacttttcattttaaggtgcagttagtatataaaggtaagggaagggtacttccaaacacaattttaaagtcatactcttaaaaacgatattagcaataaccaaagagatcatttgtgaacatctcgtatacagctatgataaattgacactcacagaggcattacagggttataattttaaccacaaaacattcaatcaaggtaattatattctacttgtccacagaaataacttatcaataaagaagtaatgtagacagtcatgaacagcataaaagagaattccaaggagacaaaaattacgcaatatttctatgcgaaaaaattacccagagatgtcctcagccccaagtcgacaaccagcatggaggaccctataatgacctgtctcagtcagctacatcagggcaccatagttctggtaacatcactgcttaacataatccagttgactagccttgtagattctgtgcctataaaacaaccattggataacaattgagctatccaaaaaaatttatctataagtagagaatgtgctgatgagtaaacattagtatcttctccctttgttagttttggttcttattctactttaaccaaccagtattccaccttttaaacagagttatctgatgagtttgaccctcgtgattcagctctgcaaaggctgatgacttctgaattcaccagcgtttgggtttccacgcctaagagcttgaaaaaaaaagactttagaacatggggaccattctgtcaccagtgagaaaactaaactatcaagattaagtcatggagattttgaggtccctgtcacagcagcataacttgtagcctaattcacatatactacctcattcaatccttaaaaggtcctatgcaggtagcacaaaaacaaaaaaatagtaaagtccaaggtgatataagccagattgaaacaaacaaacaaacaaacaaacagtgaccacatatttaaaatgtggaaaaaagcctaaaataaaggaataacatctaagcaaaggcctgaaagaaaaccataatatgaaatatatttttagtcttccctgcaaagagccaaagagctttgggcagtagaattctgagatgggccagcagtcaggaaattaggaagttctcagatacaagacaaaaagttcaaggatgggtagaaattgaaagggaaagaaaagttataataaagcctccttttatactttctgacaagacaaaaattgacattcttttttagacaattgcaggttcaagtgtgtttacaagtatggttgctcatatgtgtggccagggtgggggtacttacgggacaaacagattcttctcattcattcatacttaagatatggatttcttggcacaaatagggtagtgagaagtgaaatattactacaaccctgtgtctgcgtctgaccatttctgcggctgtcaccatctcccagtaggacaattcattgttactttgcaccttcaaggtcgtattagagaagaggcaatagccaggaaggctagctaggccttaaaatattgatttattttatttataaaataaaatataagactttactttcttttttcttcataatttttttaagacagggtctcactctgtcacccaggctggagtgcagtggcacaatctctgctcattgcaatctctgcctccctggttcaagtgattctcatgcctcgccctccctagtagctgggactacaggtgtgcactaccacacccagttaagttttgcatttttagtagagacagattgcactgtgttcgccaggctggtctcaaattcctgacctcaaatgatccgcctcttccagcctcccaaagtgcagggattataggcacgaaccaccatgcccagccaagactgtacatttttcaaagtaaaatcaagtcaagatggaaaccaggaaggttgccatcctgtactgttaagagcaaaatgaaggtcttgaggccaaaaagtgagtgcagacactctaagactccaaagtctccagggtctggtagtttcactatcaggggccagaaatgcagaaataacccgatccttgggctaggaatgcgcaactgtctagtgccatggtgagggactgcagccgtcagtgtcactaacgtggaagggcgaaggcagtcaagagacggaaagagggtcttcaggaaatgatactgatgaagcaagaacagggggccaggattctagaggtgcagcaggatccaagtttcctgataaataaacccccatgaatgaatgttttgtcttggaaagcactgtatggtataaagactctacattcctgcattttgtcacaggcctctaaatccccaacctagagcacctggacagatctcacttcttcacatgcagattcctgaattcagtaaaaaagccaataggaatttaatgacctcatttcgtagtaatattcccaataccaaacacatccactaccatcgccgtgtctttttaagaaaataaatatgtgagtaaatacagaaacagatggatattttaaaaatacctgacggacaacaacagtgaaaaggatcggtcacagcaataacttaagtgtgggctaatctgtaatggacatatgtatcctaagaagacagtggcaaaatgtttctgatgtgaatttaaagtgtctgagtttgggggccttctctgtttctgctcctgatttatatgctgtctccagagcatgagggtacaaatgatttcttgagggcagaatcttcctctgctcccgcacacaaggctttgttaccgcagggctgctctagagcacagagcccctggcaggattcgtctcaggtgaaaagaacatcaaagctgttactttgaaaaagacgcactccagaaaacgcagcacagtatggattttgcaacagatctcacaccggggaaaaataaatccagctcaattatatttgggtcctgcctttacaaaggctcattaacctctaaatcattcaaaagatgtaaaggaagagcaaaacgaactacagctttccctgccagcttttttcaaggtgaaatattcttggtgtttgggtacctggaaaggaagaaatgtttaaggaactctggttctctgatattgacacagacaggaaattggatgtatttatctattttaaggaaactgtccagtgttatttattctcccccaccaccccacatcctatgaggtgagtcaagcaattattgaacctcaattcatggtcgttgaatactatgaaaaaatgctcaaatgtcacctgagactgtgggctatataatacaattgagtttctaataaaagtaaaagagaaattggcaaagcataggaaagccactagtgaagatctatatgaggcaataaagacagcagggacgatcctaaattaagaagagaaaaaagggaagaaaatcagaggccgtccacaatactgaagaatgtaagaactgaagatgattcagcagatgacctgaaatttcctctgtcttgaattttcaagaaacagaatgtgctctccacactcgtaagtgggtcagagggtgttcccactgcatggatgggcaagctggctggccgagagtttgtctcaaggtttggctccatcagacaaacaggtgcaccagcatttccctccaccattcccaagggcaccttcttagaaaatgaaatttcatgctcagtcaaactttagaaacatatgatttaaacatatgccagtctctttctacatatttgcagcttcgcaattcttcacctcccagtccctttcttaaaatagcttgtggttgaagctaaaatgtttagttgaatagtcatcttttcctcttcttatctagcctatagaaatctctcatgaggaaactgagcagccacaagaaaactgagttagtgacgatttataatgtgatattttgatgcctgagactattttcagaattacaagaaaattttccttttccaaacacacagtcttccagaaaaaaatctaccatggaccataaccaatgaacactggctgattcacgtcttgccagtcccactttaagaaaaagaaagagagacagggtatgtgaaaaagttataaagataaaaatatcttcggaggacataaggtaataatcaatttttttattcacatagggtaagaaatcttttctataaggtgaaaagtgtaagagacataaactgcccagagttacaggataattaatttacactgattattttactaaaacacaaacatagaaagtgcttgtgaaaaacattatttagcaaaaaaaatcaaataattataatgctttatgtacccttaaattagcagcaatccattacaaacaacagattttatattaagggtcccacatgagcttctaataacaaaggtcactttttactaagacataacttgtggctgctcaacagtagaattggaaagaaaggctcttctctgattttaccttcccaaactgatgcatgccaatgaaataaaacgttatcctgccaaatgcaagcaaccctgggggagcttttcattgattaagtaaggtcttattgtgattggctcacatcgtttcctagtatttcacaatgtgtgtctcccaaattttccaaatccttcctaattttcatccaaagtcacctcaagcttctagaaccagtggaactactgttctccatgacacccttcctgaatagcctacctcaagctcaccaggcccactcagccacatcataacttccatctaactggcccgctatcatttctctataggtaagccctatctcctcaatcaaggtcattgaaattaagtgaaaatgattgaaatgaccaaggcatcaggaacagtagtttacagttcttccacatgcatactgcaggaacacaatataaatttcatgataacaagtgatcctcttgggaggaaggaagacttggtatctgccaggaatatgagtggtatcagccccagaagaataacaaggtgacggtgaggacacacaagaccaatttcccaatattgtcaaggagagtgtggtctacaaatgaatagaaagcagcattttaaaaatgatatagactcaactaggaaatatcagattgtatctcatagaaagagtaaattgtttgctgaaatctttgtttcagctacatatatgtgtgtgctggatcatgatgtgaaatctatttcttactctgggacaaggtcagagaggtttaaaatgcactgctttaatttgtctcaaaatgtgttccacaaaaaagcagttccaccaatgtgacctgcagaaaagggctccaaagtcgatgatgttcaaaaatagtagattaaaccaaattaaacagatattttaaatgcctgaattaccagggcttttaaaacgttaatatgatcacaagtgttcaaggctagaaaatagtattgatgcaggatattttcttgaccccttcacaggacctgtgacagagctgtcccgtttactcagcccaccatgctaaacccctcacaggagggagcgtgcaagtgagtgcaggaacaagcctgctccttcggcaccagcaggaacaaactccaattactcacttgggcctgctgtggcgcaccccttgcgggaaggaacgtgtagggaagtgagtgcaagaaatggtcagctgctttagccccagcaggagcaaatcatgtgtaggccctgtggcagcatccaggtggggctgactgtgacccaaaggcctcagagggcatgttacaatgctctcttaggtctgctgtcagcagacaacagtgtgttatcagttcagcgggccctttgcctcatggagtgcagtggcttccctctgccagtgagggcaaaggggcattataacagccttttggggtacccgcacttgttgggtcctgaattcttgtctggtacactggaagaataaggttacctagacaaatggaaggatgattaatgcggacaattttattgagtgatgaaagaggccctcagcagagggggagctggaaaggggatgggaggggaaggtcactgtcccccgaagtcaggttgtctctcttcctttctcctccgaggccaggttgcctctctatgacattcagcagtggctcagaagccaattcacctctccccaatgtccagccatttcccctctctaccagctgagcctggggtctttataggcacaggatgggggtgaggcgagccataagtagtttggaaagggcagcattcaattggtaaaaagacattattcagaaagaagtactcgggagagagcgggtaagcaggggtagaagctctcactttgggccatgggttcaggctttttggcttaaaggtggggctttgccagggacctgccttgtctgccaagagtttctctgcctcctgtctccatcagcataaagctcattctaactatatggccatgaaacctagggcaggtcgaggaactagcctctctcccaccacactctgaaaaacagtggtcaaagccagtgctgctgaagacacccgcatcgcctctgcatttcctgtctgatttcccctctgacatatgaccgccctgcacagcaaagcccattctagattacaggggagtgctcagtaagcaagaaaaacactgagaacatctgggagaaaaaaataataagaaaatgcctgaaaatttggtttcatgttataaggaatggaaaattcatttcaattcagtccccaaatctaatataggtttctcaggggaccatttgtgaagtagatgtgttacaataaaaaatgttagtagatcaagaaaatactgaatggcctacactctagtgacactagtacaaaaggagaaaaaaaaaaaaaaggaaaagaaatgagatgaagtgtgtttaaatggcacttgcccaggtctggttattatcctcagcatctgttagttctgctgaactgcatttgccttggtactagtcactaccattaaatttagacagtctaaaataattgttatatgaaatacaaggtagataatttgttatttaagcatcagaaagtaaaagagcatcaggtagtaaaaataatcaaaacaattcataatattttctttatgaactcatgtactctttcttaataggaagccatgatttttattttttatatgaatgaaaacttgatacacatatattttctttctttgatagatattctctctcaccagtataaaaggaaatagcttaattgaaaaatcaggttaccaaaatgaaggacattaattcaactctggatttcaggtgatgcaaaaaaaaaaacaaaaaaattcaaaaaaagcacaaaaaggactctgaagataatttatgtacttttcagcaaaacacccacaacatgacttctagactctatggtaaatcaaagatggaaaaaaaataaaacctaaaaaaaaaaacaacaaaatgacttactcagctgtttccattgaaaaattacttcccattaggagatgaacaaaatgcagcatttggttaatccctggcagtggcttaccattctcttaatactttcttctgcatctacacagttcttagtcagcacatatctgatattttgccatattgctattttaattacaaaaagctaatcaagtgaaaactaatttaaataatcaagtaagtcaagggcaaattaatcctgattcgtctaatacaagtttattacatcaaaatccctatctactctcatcagagaatttgggattgtagttgaattttctttttaagcagcactatgagactaccaggaatacagacagaactactactgaatttcaacatcagagacagcaagcagaatatcatagatacagacagaactaacactgaatttcagcgtcagagacagcaagcataatatcatagttttataaaagtgatctcagaacattcatagtaaagtccatcaagcggaaaagaacagaacagaatggtctcaaagaattaaaatgttgactattaatctcaatgcccagaaaaacttgccttcatccaattctaaggagccacttttgaagtccatcataaaagccacattctgtaaatcttgacactggctcagtgctcagaaactttcagttaagaaaaaaaaaaaaaagagtcaagggaaacacaaatttggctaaagaaggaactaaaaccaaaacgtgataagtgattataaaaccattttcaataagatgcatagaataaggtacaatgtctaaagaatgcaaaaggatggaggagcccagggcaacttgcttctttaaaaccatttgatttcttccaaacagacaaaattcagggaaggaatagtggaaatgaggaaaatgagtcataaatatatgccttcacccacatctcatgtttccttggttagactaaaatattttaatatttacatccctatgtactgtatatatatttttgctatgccatcataatcaaaacaactaacacagcaatattggataccaatgacagtcaaaggccactgaataggccactgaataatggaattgtatccaatcgtccaaaagtaacattacttgatgtgttagtcagggttccctgaagggacagaactaataggattgatgtatatatgaaggggagcttatcaggagaactgactcacacgatcacaaggtgaaatcccacaataggccatctgcaagctgaggagcaaggaagtcagtctgactcctaaaacctcaaaagtagggaagctgacagtgcagccttcagtctgtagctgaaggcccaagagcccctggcaaatcacagatgtaagagtccaaaagttgaagaacttggagtctgatgttcaagggcaggaagcatccagcacgggagaaagatggaggccggaagactcagccagcctgctctttcattttctgctgctgctttattatggccacattggcagctgattagattgtgcccacccagattgagggtgagtctacctctcctagtccactgacttaaaagttaatctcttttggcaaccccctcacagacacacccaggaacaatactttgcatccttcaatccagttaagtcgacactcaatattaaccatcacccttgattagcagacaatgttctccccctttgcacacaggtggaacagagatggacatcacccatttggggtttgtaaagactccagaccatgtggccctatctgggagcctgatttgtctaagcatccccttgacgttaggcactcaggtcatctcaagcatttccccattgcaaatcacattttatgaatacctgtatacatcaatctttccatttctagttatttcttcatggaagaagtggaataaagaactgagttaacaggaatatttttaatcctcttgatacattttaatctggttaattaaaaaaaaactactggcaagccacattttgccagtattttgtttttcctaatctcggattaccttcctactctttttagtctattctcttctcctctgcctcttccccaccacacccctgtaccctgtgctccagctccaagaacccttcctgcacagaaaagacaggatggcactttgcccttccatgctagctcctggctttgtttcattttcacatgtagtgccttcatgcccttctcctcttgctctctaactctcctgattacccccaccgagaatggctcacttcctcatcaaggttactaagtgttctgttcatgcctcatttgtagcaagcacaatttacattttctagaaatataaatttgccaaaaagctgctccagctgaaagatggtctctaaaagtactgacaaaaatgcaactggtactgcaagaccagagcttagaaaatgcttctgcacataaaaggcactctaaaggaaatgcaattaatacaggggaaattcaaaagacatcttaaatggcctcaattatactctttcaggataatttataatctgctaatgataaaatgcagatggcggactatattaatttcaaaatgctctaccgcagttttactagatatttctgggactataatgcaaaaccaacccaagacacattcagaaagacttctcattccctccaactacagccaagttgaattccttactcttgttaggcatgcatactgtggatctcaggttttaatgttctctgtattttatcaacagcttgtcttccataataataatactttcagtcctctggtctcaacattttgttgcaactttgttgaaacttcttaatttaatatctgaattcatattaaagccttctatgtttctttgagattatttttttgctgggagtctgctgttttcagccacctatcagaaggtaactcatgaaatagagtataattgtcagggtgcgataagtttttggcatattttctatgtaactgataggaaatataatacaaggctgttaaataatgaaaattttaaaaaggaataccattaggaaggttttctgtttgggtgatggatgtgatctatcatatagttctaaataataaattcagttttctgtctcaacggttgttctcttctttctcctcaggaaatgttacacgctgagcctctgtctcccagaacagtgctcctgaatattgaaaacatgctgcccagatctttctttcttctttgacaaaggctacttatcttgtagagtgtaaaagaccaaagctttttgtttgtttgtttgcgtttttttttttttttttcttttggtttgtttttgagatggaatcccactctgtcgcccaggctggagagcagcggcacaaacttggctcactgcaatctccgcctcccgggtttaagcaattctcctgcctcatcctccagagtagctgggactacacttgtgcaccagcacgcctggctaattttttatttttagtagagacggggtttcaccatgttggccagtctggtcttgaactcctggcctgaaatgatccgcccgccttggccttccaaagggctgggattacaggtgtaagccaccgcgtccagctgcttgttcctcttctgccttcttcctattcctttctttcctcctcccgccttcatccaacacggtttgtggtccatgttacttgggactattataggcttcaaacgagtctcgtatgagcagtctctagtccatattccacccctgtagctagtgcgcccatgttaaagctctatagtgttcacattactcccctgttcatgaatgctcattagccttccactaactaccatattaaatcccatctccaccttggcattcagggccatccacataacgctaaccctaagcctagtcagagcccatttacttgtgtttgtacctcctattgtcctcccacactcacccttagagcccctctggaccaggctctgtgtcaaaaacaccaggtgatttgcttacctttaggcctttgccttgcctatctctatctattaaattctgccgatcttcttatcgtaaatactgttttctattgactaattatctatgagaatcacacagatactcatacgtgagcattgcttttctaggatgcaacagaacttaatgtttcttatagacctggccatatttttcttttttagtaagcttttctatatattagcaacacacacttggcaatttaattttaaaaataacatttgcaatacaatcaaaatctgatctacttagggacaagacctatagactgaaaactagaaagcactgctgagagaaattttcagaaagtcctaaataaaatggtaagcatgtcttttacaagtatctgaaaattcaatattgttcagatctccccaaacagatctatagttttaatgtaatttaaatgaacatctcaaaaggcagatttctttgtagaaattgacaagaaagttctaaatttcataagggaataaaaaggacctaaactagccaatataactttgaaaaagaaaacaaagttggagaacttctgctacttttctttgagttttattataagttacagtcatcaagaaagtgtggtattagcatcaggacagaggaagagatcaatggaacaggacaaacagtgcagaaacagacaaatactaatctgctaatttttggcaaaatgtaagtgtaattcagtggagaatggacaatattttcaacaagtggctctggatcaattaaattgatctgatctatggcttgtaccttgtaacatttttcatagtcctaaatatgaaggtctagaaggaaaccaagaagatttttgtgaccttgaactaggcaaatatttcttgaatgtaacaccaaaagaatgatccacaaaagaaacattgtataaattggactttatcaaaatttaaaacttctgctctttgaaagacatgtttagggaatgcaaagacaagcatgcacagactaagagaacatatttgaaaattataaatctgatgaagaacttgcatctagactctataaatacttttcaaaactcaataataagaaattaagctacccaataaaaaacaggcaaaagattcaagcagactaaattttaacaaataaaatatatggatggcaaataacaacaatcactgatggtcaatagtattagtcattcagaaaatgcttattaaaattctagcaaagcaaattatagtgacataaaaccaagctgtgtttgcctacaaatgatgggactagaggagtgaaaggaagggatggctgaatggcagtcggagactttcctggttctggacatgttcattatgatagcagtgatagtttcacaggtatttacagatatcaaaatatataaaagcatatacacttatagcactgtgtcaaactatacctcagtaaagctataaaaataatcatgctagcaatgatctccatttttcaagttagtaaaataattttcagaaaaggaaacgtctgcatgtgtgagagagaaaaaaagaccacattagcctaaaaacaaacaaacaaacaaaaaccctgcctaaatcagatggctgtcctgggactcaaggaactgtgctttaagaggggactttctcctgtagtcccagctactcgggaggctgaggcaggagaatggcgtgaacccgggaggtggagcttgcagtgagcctagatcgcgccactgtactccagcctgggcaacacagagagactccgtctcaaaaaaaaaaaaaaaaaaaaaaaaaaagaaaaagaggggactttctatcaggcagagataataaaaagcactagtcaaaggaagaggcaccttatgcagaaatcactgtcataatccttcctgtctataggcaaggatggctctggaccaccaccaccccctgcattctaatttgagagtagatacactactccaacccttagggtctttcttgggttctaagaacactggatgagaaaatctagctaggatcaggcacatctatagcaaagctcacaggtttatccacaaaggccagccatgggctgaccacgtgagcattctagggatgcgatccccagaaatctaggtcacagacaatcctctggaaggtacaaagaggacactggagcaggagatgtggtgtccagcccagtaccccctaggaaggccatgtatgtcactaaaggatgctcacttaatacaggcagaatctcatcttctcagaggtatagcagccctcccttatctgcggttttactttccacagtttcagttacctgcagtaaattgcggactgaaaatataaaatgaaaaatttacagaaataagcaatacataagtttggaagtgtgcagcactctgagtagcatgatgaaatctcacgccaccttgctctgtcctgcctatgatgggaatcatctttgtccggcgtatccaccctgtttctgcagcctgccattgttcattgacattgtctgctcctgacattgaaacttgaacatgctcacggctggatgatccagaatcacctgacgcagataatcctccttctgacctaacactacgtcacaatgcctgggccgttcaccttgctcaatccaatcaggtaggcattttatcaacgcaacataacaagaagtgcaggtatggtaaaataagatactttgctagagagaccacattaacataacttttattatccaacatattgttataattattctattttatgattattgttgttaatctcttaccgtgcctaattcataaattaagctttgtcataggtatgcatgtataggaaaaaacagtacagtttgtgctctgtatccacagattcaaccaaaagaaacaaaatgataaaaaagtaataaaacaattgaaaactacaagttgaagaaccaacacagtataaaaactatttgcattttatttatttattcattttgagacagagtctcactctgtcgcccaagctggagtgcagtggtgcaatgttagctcacagcaacctccacctcccaggttcaagcaattctccctgcctcagcctcctgactagctgggattacaggcacatgccaccatacctggctaatttcaccgcacctgaccttacatagcatttaaattgtattaggtaatccagagatgatgtaaaatatacggaaggatatgcgtaggttatgtaaaaatactgtaccaatttacatcaggaacttgagcatcagcagattttggtatcggtgaggagtcctggaaccagccacccgacagacactgaggcacgactgtttgtattgggtttggtactgcccaaagtttcaggcatccactggggatcttggaacctatctcccattgacaagagggaactactgtaaccaagaaactttgattaacaagagaaaactgtatggaaaaattcactaattaaatgataaacataatttacaatataataccttcataagacttttctaactcatatgcaaatagtaaaaatacacaaaacaagcaagaatgcaaaaaattttccctaaatcttaccaatttgcattaaagaaaaatttctggccgggtgcggtggctcatgcctgtaatcccagcactttgggaggccgaggcaggcggatcacaaggtaaggagttcgagaccagcctggccaatatggtgaaaccccatctctactaaaaatacaaaaatcagtggggcgtgatggtgggcacctgtagtcccagctactcgggaggctgaggcagaagaatcacttgaacccgggaggcagaggttgcagtgagccgagatcgtgccactgtactccagcctgggcgacagagcgagattctgtctcaaaaaaataaataaataaaaagaaaaatttctcataggactacagttcccctgggatattactattcatttataatctatcattttgcaagctgaataccttcttaacaatttcttaaagtgctatgaatgcctagacttctaagacagtgatgccagtgtctctaacttcctgtatatgccacgctagtttctgtatagaataggttatcaattttacgtctgtgttaaggacaggaatcacaggacatctcacttattaaacggcatctatggaattatgccaaacacatttatctataaagaatgctggtcctcactatttttcattaatcaaatgcaatgtgtaaccagttacaaagcctgtagtattaatagaagcttctaatctgtatagcatgctgctttcttttagctgaaataacatttaaaattcataaatattggaggtaaaaagaagaaaaaagattataatgtgtgctctggcttgtagcccgaggagaacagaaacaggggaaaaacaggtaatgctttccagcgatgagtgatgaaaaagaagcacaacaattccagtgactgtatgagaacagccagaaatcattcttctaaaaaatagttttaagcagaacaatgatctagaaaaggatcacaacacattgcaccgccctgagcagtcccataaagcagtgtgatgcctctataaagcaaagttccgtccaacagggctgtcagaggggaacatgagtgaaagggagggagcgccttgcacatttatatccatgctgcaatgatccccacatctctcatggtgcccagcgcacgtctcctcctgcacccacaaccaggaattaggctccacgttcacctgctctgcagctacaggccttatcctctaattaaaccaaccccactgctctagaagaatagccctgctcggtgactcactaacatttaagaatacacacatgtgaaactaagatgaaaatgagggcggagatgatttatgtgaaaggacatttaaagatgaataggttttgtgaggttgaggaagcctgcccctctagagacagaggaggcatttgctcaagtgtggaataccagctgttgaaatgttaagtcaaatgaagtagaaatgtaatgttatttaacaatggccgaaaaggaactcgctaattagtatttagcaaaaaaaggttttgagtggtcaacctgtgtatttgtttatttgtttgcttttgtttggagacggtcttgctctgtcctctggagggcagtggcactatctcggctctgcaacccccatctccatctcctgcctcagcctcctgagtagctgggactacaggtctgcgctaccatgcccggctaatttttttgtattttagtagtgacggtgtgtttcaccatgttgcccaggttggtctcgaactgccgacctcaggcaaacctcccaccttggcctcccaaagtgctaagattacaggtgtgagccaccatgcctggcctaatctgtggactttttgtgtgtagagtgtgactgttacaaatgggaatgccctaatctatatgttactgtggaattttcctatataacaaaagaaacttctaagaactgctaccatttggaatccagtaattgtatttatattgaaatatttattataatgaagtatagcagaaaggctagtgagttacagaacaatatcagaagcctatgtgccatctaaaattttcttttattttttaaattaaaatgatctcaccaagcttaatcatctctaaatctaaaattttctaccaagtttactaggacactagaggcctatttctccagaaaaaatggtaatactaatttttacatatattagaaactaaacattttccaggaatgtacaattactctggaaattccaaatctttatgtcaaaaaacctagaaaatctgccaaatgtaccatgtctaaacctaagtgggtattgctactaatggtatctttactctgtctttatatagaaacaggcttatttggaatttagggctcagaaatagacctacacatacatgacatggtcatttgattttcaacaaatgtatcatagtcatccaaataaaaaagtaacaactgcatatccatatagatatccatacctcacactatcataaaatttacatatgttggatcctaaacctaaatgtgaatgccaaaactatggagcttctggaaaaaaaaataggagaatatttcatgagttgggattaggcaaaggtttctttgacaggttagagaccacaatatcattaaaaagtaataaacttagaaattaaaacatctgttcataaaaaatatgaagaaaatgaattaccaaactccagactataagaaaatagttccaaaacatacacctgataaagtactgatatgtaataaatagatcaaagcttccagaacaatatatacatttcctaatgaacctaatttgaaagtgaacaaaatacaagaagagacatcacgaaaagaaaaatatgaatcactaaccagcacgtaagaaagcacataacattgtcagtgagtctgaatggaatgccagtgcacaggcaccagaatgaaagcctgacagcatccgaggcggcggagccaccgtaatgctcatgaagagtcagaggtttgaccttttgctatcaatgttgttataaatgttaatgcacaactatctgtcagcccagcaattccactgcaggacatttactcaagagaagtgaggccgagtgtggtggctcatgcctgtaatctcagcactttgggaggccgaggcaggcggatccccttaggtcaggggttcaagaccagcctggccaacatggtgaaaccccttctctactaaaatacaaaaattagccgggtgtggtggtgggcacctgtagtctcagctactcaggaggctgaaacaggagaactgcttgaacccaggtggcaagggttgcagtgagccagggtcatgccactgcactccagcctgggcaacagagcgagactctatctcaaaaaaaaaaaaaaaaaaaaaaaagagaaataaaagcatctgtttaaaagtggtttacacaacaaatgtttaccttgttgtataaatgctctattcaagagagtcaaaacctggagacggcccaggtgtccctctacagtagacaaaaatacttctcagccataaaaggcatgaacggttgctccacacaacagcatggaaaaatcgccaacatattttgctgaatggaagaagccttacaccagagtagagaccacatgactctttatatgaccctttagaaggcagaaattgtggtggaaaaaaaatcagaagtgtttctgcccctgctgggtggagggcttggaactgaccaggaaggagcatgacatcattctctggggggtgataatgctctgcagcctgacaggggctgaggctgtaccactatatctttgccacaactcataacattccaccggatataaaatctatctgaaaaactgaactatgaacatgtattgaacttgtttgtcatggtgttcatgttgaagtatttcgaggtgaagtatactcatgtctccaactcactttaaaactcattttaaaattcttcaaaaatgagacgaattggtaagtggatggagaaggatagatagatatttagccaacaaaggaaatagagtaaaaagttaattgcagagctctatcaaaaagcaatccttacccaacagcatgaagagattagtagacagatgctctagcttcccattctctggaagcacaattctatgagacattctccatagctcctcagatgcccaatgagactgtgccctaattgtcccctgcactataaactcaactacccactctttgtcagctttgctttattttccatctgactttcccaactcctcaatgtacttcccaagattactcccaaatgaaccacctgcacctaaaacagagtctttggttctgcttttacaggaacccaacaaagatgataatatagggaatagcatgcatatgtccaactgtgtcagaaatgaggagccaagctgatgagtggatctacagtgatgttctaggaaatttaaaatgtagaattccattttcgcattgtcaaatgcaaggtgtacaattttgagaattttaaataattgaatatataaaatgaaggctctgaaatatctgttgcgatagaggtaagagatctgacagcttgtatgttggcatcacaaaactattgtcagttgttacataaatggatggtaaagctggaatgcctggattggagtctcggccctgacgtgtgcttgttaatccctcctgcctgggtttccttgatctcttaagcaaaatgttgaaagagcagctggatcatggtaaatgctattgaagtgtgctattgtttttattattgcctggcaaacactaaggaagtctatccaaggaattgtaacagaaggaaaatgagggatctgactattatagagaaaagtaattaatttccacgaaacagtcagtaacttggctaaagcgagctttggattatttgtcaattctgaaataacagggatttttttttttttttcaaaacaagtaaatttaggacaaataagatgacgtacttcacaaagtaatgaaaaatgtatgggagccattgttcctcagggatgggaaaaatttgaccagtgtttgtgcaaatttggggaaaaaaagtcatggactagcactaaaggaatgagatctacctagactttgaggtttgtaaagggtcttaatgaggcaaacaccaactgtgttctttcttgattctgttcattacctcatttaattttcaatggtcttgccgtgaatatttgcatgagatatagaatatttttaaagcaagaatattaataacagtttttcattttaggctcattaaataaaaacgtcattttttcactaattcacatgacatttattgagatgtattaaaaaataaaagaaagactttgaagacaaaattgctcaaaggttaggggcaatctgctcttcttggagtaaaattcaagggccattataagaagtataagtcaaattatagtaccaatcaaagaataaaatatttttgatggaactgatataaaaaagttgcgtatccttgtaagacgaatttctttctctccctatctctgagtagctgcataaaccactaagtttttctagaagcaagtgataatgctttatcataggtacaggcttaaagaatgattaggtacacttaaagttgggtactcctatcaaaatccaagacagtgcattgcttctttcctttccaaattttttttttcagtcttgtggcccctaactagtaattaagagaactaaattaaagttcatactggctacttgaaatcttacttttaatattctttgcattatgcatggaacttgtctatggttttaaaatccaaggggaattatgacatttgtaaggcaaacccaggctttcatccatcattctaatctgttttacaaaaaaaaaaaaaaaaaaaaaaaaaatcaaagcagcatttgggggacaaaatgagtgacagaaaaatggcaaaaatgtgtcaacaatagtgagatttcagagatccaggagactagctactaacctcagcatctcccgagatactccattatcgctatttatgttattacagatgatataaatcttacgtacaatcattgtacactgaaaagtagcagaaggaacagaggtttgtgaccagaatctatgacgcagggaaaattaaaaatgcatgaaccattccatataggagggaattgaaaattatatgcaaaagagtatatgtacacccacagacatgctatataaaaatgaacaaaatttaaaagcttattgttacccattgttctgatacgtatttctgttttcttggaaggttctttgctggccggccagattcctaaattttatatcctgctgcactagtgagatatgtaagaggattccaaacactcaagtgtccaaactgagctgtgctgaagacttcaggctctccttcccgtaagatgagaggtcatcaggaagatgatgctctgtgataacaggattgaggcagaaaagctatttgtcacattcccttgtttggattttggttttggactagaaagaacactggcttcaaagtcagaaatcaagaaccaaagcccagttctaacgtgttttattagctgagggacttcaggtaaatcatttagcatttctttccttcagtttcttcagatatttaatgaaagaattagaccaattgatttcaaggttctcattttgtttcaagattctacagttataaatcataaataaatcaccagtaagtttgcgtttgtcaaacaattcaagttactaccactttacaagggcacatattaattttcttaaaaatttatcacatgttatgtaaaaaaataagacttctgaaatacttagacaaaccataaatgtgcaaatattctatttcactacctcatagacaagttttagctgattagcatgccctgatgaaaatacacacgatatgcaggtgtaggagttggatgaatatttttaattgtgtatctcctctgtaggccaaaactgttcatctactaatacattagccttaaggcatgtgccacttttagtgactcagttgttaaaactgcgttacagctgcatttgctcccaaaaaatattaaagtcctgtaagatttctattaatgaatccttttgatcttctattttacatcaggtaaaaggtttcaggagcttctccattgttacaacatctccttgtatctaggaggatatgggggaaaatagcaataaaataggtggggatgacattctgatactagagagcagttaaacgtgatgggggaagaaagcgacgatccaacagaatatcctcgagtaggaaaatgattttatcgcatgactgcctacctcattacaaagtgaaattcaccactatacattttcgtgtgagctttcatctgctgtacaggagagtggctccctgggtttcctataacagctgttcccatgaatctaccagatattttgtttccacttttacctttcttactctctgtctccatacccttctgagggatgagggtctgttgcctaactctttcattagttatttatttatatctgctctgggaaagaagattgtggaaaatgtgagagcaattcacacatcaacgttttaagatcccgtgtacaaatgggattgctccggaaaagcttcttcccacaggcactaattaaaaagcaggaagttcacttgagcagcatttttcttccgtttattttcctttgtaatagacatgctactttttactttaatttgaacattatccctctctgtccaaaaaaatacaaaaacaaaaaccaaacaaaatacagtaaaggaaggcagagtataacattaacaatttagaaaagatattattttcccctaataaattctactgcattcttggaaagcattaaaagtataacaggtcacacatccttgaaatattagatgaaggaatttgtgaagacagactattggaacctctgagaaattagctgggcctctacttccgtggtcattctgaagcatttttagatgctggtcacgattaatgctggaaacaacgttagtgacagttcttctgtgcttatcacatgcctttagttcaggaccgaaagaaggaaggaaggaccacaaatggtacacgaatgggctgcacagggtggtttaaaaggtaagaaaccaaagtgattgcttgtgtctcatttaagttaaatttaccacaaagttcatattcaataaatttaataagaaaggtaaataaaaacaatcacagtaagaattacatatgaaaataactatccattcattctattaacaaactaataaattattgaacatacactatgagtgattctgtcctagatactggagattttcatgatatactaagtatgtttcctgcaagagttgaggatgtcagaaccactgggatactgcggttgaatagacaccattgcctcttggtggtctgaggctggtaaatacacaggcaggaactacgcattgcaacagaaatacctccaaaggtccttatgaggatggtgcacacagaaaaaaacgtagggtcatggagaaactggaaggaggaggatagaagaaataggtgaaacaggctaagatttatccaccccaagttgggagatggtattccagtgggaaaaatttcactgctaaaactaaactagactagcaattctgtaagatgtaagagtgtgagtgatgagctgagggacagcctgagtggttgaaacgctgcttttctgatgatttggctgatggagtggccctaagcaagtttcttcaccgctccgtttcagattcctcctctgtcaaaccgggaaaatactcgtatctacagtaagagttgaaggattcaatgaaggatttaatatatgcaatgctgagaaaggtctgtggtgttcagtaaaaaatcagggtcttttagtttctttcgtagggctgcacacgcctgacacaggggatgtgaaacacagacctctcatcctacaagtcccagctgcacctgaccccagcagcctaactgcccctggcccatgactctaccccagcccattatcttcttcataatcacaatttataacttggctattgctacattacatggtgcatttgcctatgtgtatacttgcttattttgcatttattttcctcatatatgagccctaggaggatacggacttgcctgtatttggggactggaacatataaggtgttcaatgagttttgttaaatcattactgatgatgctgatgatagcctgccactacatagctcttcctttgtgctactcttctaagcattttaaatacactaatattcttaattctcacagcaactccaagaggcctgcctcattaagtgggtcctgttactgttttatagctgaggatattgaagtgcacaggataaaaaagaaaaccacctaaggacacagagtaagtgatagaactgagtgctgagctagcagtaggctctcaaaacatattcttagccattaagctgcctggttctaagtaactaaatgacagatcggagcggggtgctgcctggggccctggctagccagtaggcagaaatggaccccaagctacccagggatgggagatggggcagatattaagagaaatgaggcacatcctgtactagacaattttcctagaagcccagtggctgagctgtttcatctgcagccaagagtgatgttccattgtttcgcatgcactctgtgagccgcctgctgcctgttgcctgagccttactccttcatccagcagagccaggccggcccacaccccacactcttaccacagatggactgggtttgaatcatggctgttaaatgcccttcaacactagtcaagtgattactttctttatttcttcacctgcaaaatggggattataaggtacctacctcataggtttgtggtgagaactaaatgagttaatacagagaccaatgcctgggacaaatgtagctcctctaattaacaatttgaattccctggtcccttggtttagtccctgtttgtcatgtactttacaaaagtgacaggttcctattcttggaaatgaatctgtctatactcagaatcagaaaaaccaaaggaacaaaataaaaatggaggcataccagccaatgggtgcctcggtggtatctccatgaaatctaacccatcagaggcagataagcacagagtccaaggccttcctctccagaagaaagaggaagaaggggggcgtgtgggagtgtagagtgcaaccccctgaggggctgaacccacagaaacagcctaggggtgagataaggggtcctggcccctgaagacaccctggggaattgaatggcttggggatggggaaggagaaactggggggcagaggtgaatacctccccatttctcaatgcctggcacctgccattctgctgttcctttctttccaagatcaaaacaggacattggccatcctcctgggttgtgcttccaaggctctctttgatcactctcagccctccagcttccagctgaaactgacctctagtggcctgtacactggtcttactacagtcattgcccccagattcagaactcccgtctcatgtcctgattgctgtgcagtcagcatctccacggaccagcactctagattatagcaccgagtacaagatggaaaaccaaggaatttcaccaccagttagtgttagacaattcattgttctttagtggcttgagatttaaagtggcaactccataaaaactgacgaagccttccttggtgttgacctttgacacttgtgagcagccacatgtggagtgcgtcctggacattttcaggtatctattttgatgcagcttttttttttttttttaaattaaacagactttctcactaaattgctttgtcatggcctcagggagaatctggcctacaacactgtttactatttcaagtcatgtgtgaatttgatgccctcatttcctcttcttcatgcttgtcttacaccaatcaataaaggaaggaactgggtcatagtctcctggggatgactcccagagttcaaattctggctctgcctagctgtgtctttggaccagttagtttcttcatctctataatggaattgcaatattactttatagggttattgtgaggaataaataagataatgggtataaagtgcttggctggagcaaatgttcattgggtgtcagctattctcatcgtcacgatcagtctatgagatggagtccactgtacttggtacttggaaataagacgtgtttatagatctgtgctgacatgtcagttttcaagagccaccatatatcctgctctatgcgtaatctttgtaatttagagtaaatgttaaggaagagagggcaggaaggaataaaatgtaatgagcaatcattggacaaataaattgcatccactttttaagtgcattttgtatacagtttaaaggtagaattcctgaagttatacgattttaaaatacacttgagaaaggtgatgggctgtccaaagcaatgattttcttctaagaaatacttacacatatagaaaatttgtatctttatatttgctgatgtgaggctgctctacactttgttcccttccatcagcacgcaggaaataaataaaatttgcccacacgctaaataaaagtcagctgaatcccaagtccttgccgtcccctcaaccacacaaactcatgcacccataaatatcttctttttggttctgagtgcacacagaaccaaaggaatttgtattgaaacgtttgatttcacttaacctgcatatttctatttctatatatcttaactctgaagttaaaatacaattcttccaatgatatgaaacacagtattttaaaggtatcacacatcttgggttgttagcaagaatttatataatcatttatccaaatcactatctattttggcttcacaccagacttctaatcaattctatatccttgttcaaggcatgtttcttatttttcaccactagtcaggtattcattcccttgtgctttgttcttgttcatttaacacacaactagtcccattcataggaaacacatcctaatccaattggtgttttacaaattgaatcttcccaacagaaagtcattgtgtccctcctagttcagaaatactaactgcatgcacttgaagttaaatcaaaggataattactggtctaatattttggatcatcttaaatatagaaccatattgtgctacagctggagaaattctgagagtttttagataacttggaaattacacagcctaccgaggtgtctttccccaccctgtgaggctctactaaagagacaagggggacttcacagaaagtttaattcaaacttaattacacttgagcctgaaagttgattaatcggttacatttgcaagcagcagaaaccaactctggctgtcttatacatcttgtacaccttgttgtcttatacaccttggtaggatgttagcctccaagtctccctccaggcaagctgtcccagaggtcatagagcaggaagacttggaccaaattaaaatgcttgaatcacgtaactttttaaaacatagtttgagaaacaaaagggaacagaaaagaaaagtgagccaggggagaaggtgatttttgtttattgccttttatatctattatattcccagcaccacctacaacactggtccggtacatagcaggtactttatgaagatgtcctgaatagctataggatataagtatgcaacccttttgtaattattataagacaatgtcttggaaatcatagctaaaaacaaatcaaacgaaagaaacttagtctcatattctattgtcaaaaattcttccatgatggtatatgcaatagaagctgtactggtggatttctcccatgtacaggttagcacacaggtaacatatgacctacagagctgcagaggatctgtctgcttagtgctgaaggccaccacttgatatagaaagtagaagtggggtgtcagggtggtagggccactggtccacgggacatactgctggaatagcaagacttggacccctgcttctgtttatcctaaggaagtgactggtgctcctctgatgatgcaatgcaaatgtcctgcagtctaagggctgttgtctgacatccagtctcagtaaatatctgtgctgccccatctccatgaattctccatataaaggctatttgagaagccaggctgtgagtgctctccaccatgtagccttcactgacagaaaatctgctcaatgttttaattttaaaggtagattatggattcttttataattagttgtagaaaagatcctctggcaatatggtagttagaacacatctttgccacccttcgctctcaattaaatattcaactcttacctgctaagcagggggagcttggggcacatgactaagccttaaagtcctataaaagtatcagcagaggggcctattaagatttggagaggggtggaattagatgaataatctaataaagaataaacatccctgaagagccaagaaaattatgtagaatttaagttggttgaggctaggctagtgttttaagttggttgaggctaatttaatttaagttggttgaggctaggctagtgaaagaactgtgcagtcactagactcaaataagtataaagagccacaccgtctcgtggataataccaaataatagaggacccataagtaaatctaggactatatggtacttcattttggccaggtgatatattgatatgttgggagaaaggattatttaataaatggtaatgtcacagaaggccatctattcaaagaaatgaatttgggccccttcatcacaccacatatgaaaggaaatttcaggccaattaaaagttttaaatgtagtaaactaaaaaaatagcagatacatctgacatctagaggctcggagaccttgataatcgacaggtgactacatgaaaatatttgtatatgatgataccataaataaaaaacagcagacagtggaaactgatagactagaacaatatacatgcgactcccacagtagagaaaaggttactatctgccataaatacggcttacactgtgatttgaaaaccctacctaatgtatgggagcagagagaaatgctcaataaacagatgaaacaaaatttaagttacaagaatattttgttttggctaatcagactctgaacacaatgaaattccttttttttttttttgggaaaaggagtcctttcataaaatgaaagcaaaagtgtgaattattacagcctgaaattaaggaaataagtataaggacatatattttactcacacacaaaaaaataaataaatgcatataaatatgtatacccctattcactggattgctgtatatagtcacacacacacatgcacaggcactcacaccaaaatctagaaatatcagtaacaaatcaataggcaaatgtttaaatcaaagccattgcagcagagcatagaatattatgcagtcataaaaaatttttaaaaatagaactataaaaattacctttgagagaatggctataaatgattaagagaaacaaattcagaagaaaaaagaaaaaacttatttctatgtgtgagtgtgaatgcatgccagagatatcagaaaggattttcactaaaatggttagcaatgcttgtatcagcggtttctacctcaccttttttatattggttaagtgttatataatgagagtgcattgcattatttgtcacataaaatttaatttgaaagctatttcattgctaaaaggcactggtataactataacttatttttctcatttaaaaatattctatcaaaataacatagtgcttccaccaggtgtgtgtcaaaaaaagaaaaacaacaattactaatgcctatcatttaaaaggactttgatataattaagcgaaaaaaaaaataaaagcaaagcacgttctctttgtgccttccaactacaccaagaatacaacaaagacggcagaagtttgtctgtacatttaataaagaaaacaaattaaagagagtgctttgcactgggacatttgaatccagtggcagctgccagattaaaaaaataaataaagagccatagatcaagctgcagctgcgtgcctccaactcactccgcagcacaggcccaaagccattgtcagtgcccccggatgtgtgggtgtccttcatttctctttgaatgtggccaggcctcttgaaggagaacactaggtggcatgcctaccaagctctgaaacaccattaaccaccaggaaaaaatgcgattaggattctatttggagatcatattttcccctgtaggctaaggaggcattctctaacactgacaggctctgagtctctttagccagaaaatcaaaaagtttctgtgaagccactaggtaggacttttagaaatagagtcgctacatcctctaggctcctgggaaagaacctgtagctgaattatttttgtgggtcatccgtaaaatgttaattgtggattgtcaaacccttactgcagagaggactttcacagaaacagttctatttctgataaatcaattttagcagaagagtctcttttgacatgcttaattcaatgagcaaattgtaatgggcctatcccttaagacactggtgtttgtgtgtttgggagtgttcgctcagcaatcttggccctgatgctgggggaatttgaacctgacaggcccagaggatggggccagcccctttccctggcctatggctccggtgctccagacacacacacctgagctacctcccttaaaggttggaggtcaattaaatccctcaagtacctactaccaagctatttgtttaaagactattttggccatttttttgatcagtaggatattgtcacgtgctgccaaagtgctgcaggtggacatgtttgtgtgttctgaaggacttacatcatcctgcaatggtcagctttatgacacaaagaatgagtgataactcagtcttctcagttttgtgtcgtttgtggttttgtttgtgtttatttctttccctatctggggtaaaagcctcagtccctgattcagcagctttctatctaggtgtctgatttactgaattgcatcatctcttcctcatcagtgttttcgcttgtttgcttgtttgttttgagtcaagggctctccgtctgtcactgaggctgagtgcaagtggtgcgatcacagctcgcagcagcctcaaactcctggcctcgagcgatcctcccacctttgcctcttgggtagcagggactacaggtgtgtgccaccacacctgatgcctggctaatttttaaaatttttttcgtagagacggagtctcactatttcccaggctggtctcaaacttctggcttcaagcaacgctcctgcctcggcctctcgaagtgctgggattacaggtatcagccactgtgcctggcctcccttcagtcgtaattgcattttgaaaactgggcctgcagctctgtggataccacacatgttctatttgagcctatatttctctgctggccgaatttcttaggaacctgtgccaattgtttttcatctttgatcatcagcccgaaccatgctgtgtccacctgaggggacggtccagcatctctgtgccatggcagatggactgccggggctccacctggttttggaacctgcagtttgcaccatggctctcctgactgcagagccaccggcagctgctgtgtttcctcatttcctctaaccccagtctgtggggccttccccttcagcctgctgcagaacccatccctctggtcagttgaaaaatgtgggtaactgagttggaggtggcatgaggggactttctggaaaaggtctaaaagtctgtctagaggagcgtatacatgtgtgtaggtaagaatggcatcaagttgcacactgaaggtttatgccccttactatatgtcaacaacaaccaagaaaagaatcacctgccaaagtcagtcaccacctacttagttccctagagttgccactggctcaattcatgagcttatgtatgtgccaaggggaaaggcttcctcctccactcaggttttgaacattgtaaacactaccaagcagcaaacagatagagcctgaacgtgtgaaacttaaatatctatttagtgtttgcctcctcttcccatttttttttcctttgacagaaaaattgtagtaaggggacagtgctttttgttatcttattactgtgtgtgtgtgtgtgtgtgtgtgtgtgtgtgtgtgtgtatgtgtgtagcaaagtctacatcctagaaatgtatgctgcatgccacagctgggggcctttgtgatacatgtgataggtgaaattcattgtaaaggcatatttgaggtgatttttccttattgtaattctctgtgaattgggagctgcactgaggaagtgacaaggatgaaatgatggttactatgatcagcctgttttccccaactaaacattttcacttggttgaaagctaccagagactacagtcaataataacttaatcgtacatttaaacttaaagagcgtaattgcattgtgtgtaactcaaagaaaaaatgcttgaggggatggatacctcattctgcatcctgtgcttatttcacattgcatgcctgaatcaaaacacatcatgtaccacagaaatatgaacacctcctatgtacccacaaaaattacaaatgaaaaaagaaagtcatcaggtctcgaatatactataaacatatgtgtttacagtctcttcaaacatataccaagaaccttatttaaatctcaccaaaaagaattgtcggctcacaggacaagcttaagagctgtccactgtgataatgtgacaatcccaaacgaatcttttctcctcctttttcatatttctcccttccccacattgactgaatgatatgttgtcggttccttttgttccaatcaggtagttttcaaaatttcatggcaggggaactgagttaaccaatatatacatagcctaattagctttcaagttggctttatggggcaaacaagcaagtgcgttatacaacagggaacagtgggctcccctccctcctgtatctcaatgactgggcacacaaatgcatccccatatattaactggacaacacaacagccccagctagaccagagatggtagacaccaaagaggacatcagggaacaggcaaaatccaaataacatgattctagtttaaactggattggcctcattctcaggtgaaaatgggtttacacaatgcatccctgcaacatttgtaagcttatttgttcctttacaccacgtttcattcagaaagaacgtgaaacagcccataacaatacaagcaagtgaagatatctgtggaggggagtgggctgaccgaggaacagaagggtaggaaatgttgacccagtcgggggtgacgttccagtcccaggtcagttcccgaagtttcatgtgcttgctagaggcaggacacctatttgtttctaagctttccagcaagcataggaaagggaagtgggattaattacataaatcacacaaaccatttgcatatttctttgctatttctggtactgaaaccaaagaatacaagtggatgcttggtgttaccaacatctgcacatgagctgaataaggatgatggtcatattggctctggaaccacttacagcttctacttcagatcatggatttccacacatagtaggtattaaatgctttttgaatttaacgggacaagggaaggtaatcagaaaatgaagaaagaaaaagagaaataaatgcataaagagggtcaggcttggacaaatattgatacagtgttgtacaagaaccatagaatccaacatggtacacctgagatacaaaataacaacagcaaccacaaagagaaacatggggagaatcagggaaagaaactaagaatcataagtaggaatcactaagtgggaatcaggtcctaagcaaattgctttatgtgcatttgattatttattccatcattgcttgtcagcttccaactatccctgcccaagagaaaagtgcacagacacactcagatttaggggtaggaaagaagttgagaataagaaaagaggttctgaaaggttaaggatcttgccaaaggtcacacatctaggaagaggaacttggttaccttatcaaaaacaggaaatccattctcagtttgataatgagtcagatattgtactgactcattatcccagaatacgtacaaacattctcagtgatctgagttcctggcgtattttcttttgtattgcaatctcacaaataatgtgtagagaaagaaaggaactgcatgcaaagtgtgttctttttacacacttactttgcatccaccagtttctaccctggacaaagacaggggttggagctgttatttgctgtattactgctgtactagtcccttcttgatggttccaaatacactacactctagtcattaaacacagatgttgcctggagatcaaacgctacacttaaaatcatgattcaatctgcgtttacatttagaatgggtgtaaacttgaggagaaatgctgtattcagagatattgaagacagacttataaaatataatagaattttatattacacgtagaagcgtctcagcctgaggacaagtggcactagctgtagttgccgtcaggctgaagcctgtctatggaactgggcggggtggatctaccgggagtctactgacatgggacagtgaagaaccacctgggaaaacatcactgtgtgtcaggagggtgtgcaggcacccaagcatcatgcaaatctaacacttcagtctgaaacatgggatggcaagttactaccactcagccagctcccatgggctcatcccaggatcctcgcaggagtacacgggaatttttctcttattaaaacatgtgtgggcatacctcattttattgcacttttactttattgtaatttgcagatattgccctttttacaaattgatgttctgtggcaagcctgcttagagcaagtctattggcaccatttttccaacagcatatgctcattttgtatctctttgtcacactgtcttaaatttaaccttcaactaaataactattgtattatttgaaacgttcaagtaaactaaagttttgtgaaaactgcttttcacctacttctaaaatgcattattattgggtcatttctgacacctttttttcttttttttggtgcttttctgccgatttgaagaaataatgataaaaaagaatttctataaatgtaaggatacttggttaatgtatatttgcatttcattgacaaaataacattttccataaccatgtggtctcaagcagataaattcctgtccagaagcacggtgctaccttcagcatttaaatgtcgggaggcccaatgtgttctcacattgagaaccacatgcattggaaggtggctgctattcagatagggaagatgtaagaggatggagaacaaatgaggtcctaaggagacatgtaaggcattgggagttcttctgctgcagaacccaggctgcagcccaaagggatctgagagacagctgctactgacagggaactcacacaggccacatggagctgtttccctgccatcatcatcttctggtgggtctccttgctgacccactctgaggataagaaggtgaaggagatgtccttgacagatggcagcctatgaagtaggtttctctgtgtaagaaagtcacctcccctcctgtcttggtatggggagggaaagactgtaagcctctctgtcttataaaaatcaaagatttgtggttccaaaattatatgccaaagtatacatcttggaaggaattcaatatggtgataaaactataagttgggaaactaacaaccttggtcctagtcccagatctgatctgtcactgctgactgcatgaccaaggcaaggcctgtctgatttctaagctttgggctcaatagccataaaactttactaacacttgaattgccgcagtatgccgcccctcgatccctaccatacaccccatttatgcaatagccaagtaacttttttccagctctttcttcctagttttagaaaaatacacttactagttctaaaaatccaaacaggtgcacctgactgccccagggagaatcccctgaactagtgctatctaagagaattttctgttgacaggaatgctctaaactacaatgaatgcagcagcctctagttgcaactgcccagtgagtccttgaaatgtggccactgtggctgataatctgactatttaattttctttaattttaattcatgaaaatttaaaaagtcatatgtgcctagtggctgacatattggacagtacagctctgtatcaacttttgctaattaatgtacatatccaggatcttgtactttatttgtccttttaatcaatcaaatccaatattcaataagcaaaaattactgattgcataataggaggcttcacaaaagggcagagtctagtgaagtaaaaaacatccactgtcctctctttctcttgattacttccaacatttacaaatttgggcttgccccgctgatatggtttggctgtgtccccacccaattattagttcccataatccccatgtttcacaggagggacctggtgggaggtaactgaatcatgtgggcgatttcacccatgctagtctcatgatagggattaagttctcatgagatctgatggttttataaggggcttctcccttcgtgcggttctcatttcttctctctcttgctgccctgtgtagaaggacatgttgcttccccttccaccatgatcgtaagtttcctgagacctccctagccatgcggaactgtgagtcagtcaaacctgttttctttattatgacccggtctccggtatttcttcatagcagcgtgagaacggactaatacatccagcctcctttgacttcccttttgctgatccccactgaagttaaagatgcacatttcacacgtgctttaaagattctgaaatctgcatgtttggagtaggccaggcaatattgagaagttttggtatataaacctttgagaaacttaaagtaaaccaattttctccactttttaacaatacgagtttctgtctcctaaatgaagcatttatttcaaaactcttatacacaaaactgtaatcttaaaataagggtgggggggtgctcctgactgccttggtcttctgttctgactaatcttaacaaagaaagcctcatctaataaagacaaaagtggcatcgttatgaaacttgtattgggctctgcttctgaacatatatactggcattttcctagatttgtgatattatttagtacatatttcacctaaactatgtattccacagcacattttccaatgttatggatattttttctaaactcatcttaattttccaagttcaatacaatgcatagccatttgaaaataaatgcccactaaatttcaagctgtacaaggtaaacttactttttccccccactaaatgataaacttgagtaatatatagaacctaacatttgtgccaattcactctcctgccaccccttcttcaaaatcataggtttccaaataaaggaaacaaaaacttacggctgaataccctgctccaaattaaacataaagtaatcaaagtcattattaaatgtttttcatgttgtcgaaggaaacaaaacaacaggaaggacaagagtttaggtcaagaggttccggtgttatctgcgtccttcattataagtgatttcaaaatctttttccctccaggaaaaactagtgagtaacagcttagtctaaatgacagcagctctgtggtacgaagggtccacatttcagctaattttcagctcttcttatcctgataccatgagatggaatttaatagatggctggaacatctataacatgacatttaccaaaggatgtgtcagcggcatccatggcctcaacaaagatggagccttcaaaacataaatcaaagaaaaatataagaacatcttagaagaaaaggatgacagtgatcctgcacatttaaaatattttaaatgccttagggactctacggagcaagtagtgttaaaaataatgatgtaccaactaaagatatttagctccctgttaagagaagaggctatgtagcagaaggagaaaatctttagattttttttttcaaaacatgtggtttgagagcccacctcacactgttcctttggtaattctcttattctctgtgaaccttgtatagttttcttgggtgtaaaatagtcacaggattcccaaccttacccaattcacatggttattaaatcaataaagacaatgtgtgtgaaaatactttttgagctgtaaaaggctctacatgaaaagcttatgtaatagaatattaaattggaggtttcaattaaagccagatacaagagatactataaaccaaaagaggtgctgattgcctatgtgaatttacaaatctaaacatcactgacataatttttttaacagactttttttttttttagcagttttaggctcaaagccaaatcaagcagaaagtacatccttttcttccaaacatgggctattttgaaacatctcatgaacatcatatttatagattggtttgttggagtgagtggagataatgtttgaaggtgagataatgtttgaaggtgatttctttgtggaagaaaagggcttctatggaaagactccactcagagagcttgatatggctcttctagagttaaggagaaacagtgatatgatttggatctgtgtccccacccaaatctcatgttcaattgtaatctccagtgttggaggtggggcatggtgggaggtggttggatcctgggagcagtttctcatgagtggcttagcgccatccctctggtgctgttcttgggatggtgagtgagctttcacaagatccgtttgtttaaaagtgcgtagcacctcctcctcactctggacaggtaaaacatctcacatctcctttgccttctgcggtgactggaagcttcctgaggtctctgtagaagcataagccactatgcttcctgtacaggctggagaaccatcagccaattaaactccttttctttgaaaattacccagtgtcaggtacttctttacagtaaggcaagaaaggactaatacagagagtgagttcaggtctgacccgagtcccacttgataatgttaaaggctagctactttgttggtatagttatattgggtttagtctgtgatcccagagtttgttaaaacaaaatatgtatgagaatgcccaatggaaaatgaaaaagagctgcactgaaaccactttagtttctacccaagatgtcctggaagaccaaggagactccaacagagaaaatcggggtggataacagtgaaaaaccagcagctgagaaagaagtgatcaccggaggaggaacatcagtatatgcttggaggtgaagcagacatttcctctggtgacctctaaacaacttgtacaggagccaatgagataaagtttgcttttcacacttcctacacttgacagcttaaacatatcccatgacagtgtcagctgagtgagaactttcctgtgccctcttgctaagctcctaaattgtgcttcaacactgaggtatcagaaacagaagagagcaaaatggcagtgcaggggagcaagttcaaggtggggaaggacggaggatgccccccaccccaatatacaccacccctccagcaagtgcccagcctaatgcaggcccagcaggagtacatggcaagctttttatttgtttagttggttgttttcaagagactggacactactatgtactgaaataaagctgtaattgaaacttaaagttatccatttggccctgggagaaaatctattaatataacatgacatttaccaaagaatgtgtcagcagcatccatggcctcaacaaaaatgctatctgccaggaggacatggaaactcctttagaggagacaaaagaatcctcagtaaaaggaaccaccaccagatacagcgtgatgggttgtgcagttgaagctacaaaaggtttgtcttggacattaatatggtttggctgtgtccccacccaaatctcatcttaaattgtaactcccacaattcccacgtcataagaggaacccagtgagaggtgcttgaactatgggggtgggtttttcctgcactgttctcatgatagtgaatgagtctcatgagatctgatcattttaaaaagaggagttccctgcaaactctctttttgcctgccaccatccatgtaagacatgacttgctccttcgtgcctctcaccttccaccagaagtgtgaggcctccccagccgtgtggaactgtaaatccaataaacctctttcttttgtaaattgctcagtctcgggtatgtctttatcagcagacatacagatataccgggagctgctttacaaaaatcaccagtaggcatgaaatttccagtggctcaacacgtcccactatgaccaaccctggtgataagctcagtgtctgacacagtggctgccacacctgctcgctctgaattgtcatttccaaccctgcctcttcattctccaacctgaacaccaacatcattccacaaagaaggccctgtgtacactctgccttttccttctctacagtcagtactggatcaatgtccacataggccctatccacaacccaacagcaatctcctggtcctacttaagagcacattcaccttctaatttcaggatcttctttcatagtcttgccatacctttcgtggctccaacgctgttctttgaaaagaaaacttctttgaggcaggagaatactctgtccctttttaatgcttgaatcgtaagtttaatacagaaggaaagccctaggaagtaaatcattgtagctgctttaaacatttgaagagcctacaggtggaacattccttagatttcgtttttttttttttttttaaataacaaaactagaagaatgggtggaaacatttaggtcagataactttctctcaagctctttaacaatgaaaacagttttgtgaaaagcaatgattattcctttactcaaagtgctctagcaaagtcagatgactacaaagcaagcatgtaagagtaattatcttctataggagggaattgagattagacgactgcaaagttgattcctattctaattatcttctataggagggaattgagattagacgactgcagagttgattcctactctaattaccttctataggagggaattgagattagacgactgcaaagttgattcctattctaattatcttctataggagggaattgagattagatgactgcaaagttgattcctattctaattatattctataggagggaattgagattagacaactgcaaagttgattcctattctaattatcttctataggagggaattgagattagacaactgcaaagttgattcctattctaagtatcttatatcggagggaattgagactagacaactgcaaagttgattcctattctaattatcttctataggagggaattgagattagatgactgcaaagttgattcctattctaagattatggataggccaaggtatacaatgactattatatcattcattatcatagtcattgtataccttggcctaccattaatttacttcatgaaacatcttaaacatcaaataataataatagtaataagaataaaaatatctactatgtggcaggcactatgctaagcaccaaagtatggtccctgccccaaggaaatgaatctaataagggagcccagaacagggggacccaaataatcaagacttaattttttggtcatactccatttatttcatgaactctgtttatgcaaagtttatatttttatgataacattgaacaatagacatattatgtcatattggtttatactgacctttacctaaagtactttaaataaaaatatcctattcagagacaaagacaaagagcatggttctcatttgtttgtagcacattatgggaggagtagagttcatttctccatgagatactactgctagctttaaattatggccatctctgagtgtacgcttattagcatggcattctaaattaatatgaaattctgtatgcacaactgaagattcataacacattaaaaaaaatagggtcattctgacactagacagaaatataattctttgaaactagccgtgggagaacccgtagttcaatcataccaacaaatgactgaagggttttaatcatactcagagattcaagtggaccatgcccagtgcatgccatagactctggcatcagtgagtatcgtgccctacaacaaacccacttggctaactagtcactttacaaatcatattctatgagcatttcccttttaattttcataatttcctttttcccagtacgcaatactcttccattttcttttcagcaagggaaaactccatgtttcacttctaatccagttctagaatcttaatccccactttagaaaacagagtccagtgaattttactcttttcagggaaagcctgcagagtaagtgtcaactctccctcaaccttataagaaaactaatgtgactcaatgtgagtgctttcagcaagaatctgagctcaagttccccagattaaactctcagtttggtttctttctcgccgggtgacccaagtaaagtcaattaacctctccgtttcccacccggctttactgatgcatttacgcaggtagctggatattcccagatggaagagcatgcacgcatacattcataatgcaaactcatatcacagtactggtctgtactggcttgcctcattctgaagcagtattttcagggagactcccctgccccgcacattttatcactgtaagataagatatttgtttcttataaagcatcaacaaaggatctactatgtaggaagaaaaggctactaaattctatttatgtttccccagtgagatttttgagccattcgcttcttaagcacataaattaacccactgccctacagatgtagtttttacttccacaagtcttgataaagctcctcagtgctcaaacggataatatgtcagtttcactctgcagagactcaggaaggtacatctatgtgtagaaacaggcactggagaaaagtagcatttcacacacaaaaacagtttcaaggctagccaagtctagtacaggcaaagtgatacaaatagggcatagaacagcagggtttccacgcaggaaagaaactgatgagttcaggaaagtgggctaaaacggtgatgcatttacaaatgtgatagtcgctgatcattgccaacccaacgtgcttctcaccctctgtccttgctcataggaatccgattttttttggagatggaatgggcccagactaggggataaaataggactggtctaagccaatcatggcaattctgtttccatgtggcaaacacttgcttttcaacatgcttcgttactatcactggccatatggcccagttataaatgatgagctgtaaggagaggcctattaggaggcttctaagaattatctttttccattttgtttatttttatgtatttatttatttttgagacggagcctcactctgtcacccaagctggagtgcaatagtgccatcttggctcactgaaacctctgcctcctgggttcaagtgattctcctgcctcagcctcctgagtagctgggattataggcacatgccaccacagccagctaatttttgtatttttagtagagacaggttttcaccatgttggtgaggctcgtctcgaactcctgacttcaagtgatccaccgacctcggcctcccaaagtgctgggattacaggtgtgagccaccgtgcccggccagaattatctgttttatatagaagagacaggcactgctgtgtccgttgttatcctgccttgcacacagaattgatgccttgatgctctgttctatgccatgaaggacagtggctagtaaagctagaaacagccccgtcagtgtgtgagtcaacaagaatgtcctgatgggtttatctgctgtgtgagtgcctgatccctgccaggagacagcatcacgaaccaataaacaaaccaaccaagtttttaaacatgatacatacatgtaactacaacgtaaaatgaaacaataagacatatgaaaaacgttctttagagaaccttattttttcttttatgctttgtaggtactttaggttgagttttctcaaacccttctatgtagtatcaagaaatatttctcttataaatattttaaaaatgtatcatcctgcacaatgaataagattgtagatcacttaaccaatttccaattatctaaattaatgactgcatgtcactactaactgacagactttgtaaaacttttaatatcttttacataaaaagtaagtaatactggcttggtgtacctcattgccataatgatatgcatatgtgaaattagaaaaagcactatacaaatatcataacaattaaatatttaggtaaagtctgagcttagctcatgatttatggtaagcattcaataaattatagggatttttttttttttttttttttttttttttagataaggtctcgctctgtcactcaggctggaatgtggtggcatgatcatggctcactgcacccttgactttccaggctcaatggatccacctgcctcggtctcccaagttgttgggcctacaggcacatgctaccacgcccagctaatttttttttttctattttttgtagaagcaggttctcactataatagtagtcactccttatagtatacatacaacaaaaccatgtactttggaagtaatgcaataagtaacatgttttaaaatatatacacatactttttcagagtaatatgcttttaacttcctgcccacaattttgagaatttcaaactagcagcatgggtcaagcgcatggctgggtatcaaaacaaaaacactgagacactctacacaacaaaatgcaaagcgacatctggtatgttcccatctctccagggtcctcatgatgctgagcttttgagcattctaaaggtacacttggggaacttgcgtctgcaagaccgacttctttttctgtctccctttttcttaaagagtagtgagtaaaatcattaccaaacaaacaaaaaacagttatcattacagagggatctctattaaagaagcaatgaaaggctagcactactgtgggctggatgaaaataaatagctggattgaaaagtcaatgaattaccaacattgacccacatttctctagactttaattaactgacatcatcccaatgaataacatatgataaataaaatcttaattctaaaatactaggcaaaggacaaaggctctcaacgtacgcatttctgtgatacagaagagtaacaacgaattggctaaaattgccggcagctcagctagataccattttacttatttcagatcaatgctgggtttctccctcttcgccaaagctgaatgtgcatcactctggcttttgcccaggtccccacatagactttgataaaatacttactcagtccaccttcggctatcactcctccctgaactcgtctatcccctccatcctcttcttctcttaactatgcctctgctccatgagaccctcagctaaacattggaggagtctttgagagccattcaaatgatctgatgttttcctaaaaattagtgtctttgaacaaatgaagcttttgtgacctatacatgtgtgtcctatggccatttgtaggagttggttctaggaaggctgctgaaaatccattcaccaaaggctgattcactggctggccaacttacctaatcgtttactcaaaagttctaaaatttgattatttatgaactgcacagtgtggtctttggtgtcctgagctcttcaggtcccctcctggcccctcagtgtacaactgcctggagctgttgcagaagggagcaggggcataaacaatgaacatccctaaaatgctcctaggaagagaagaggtgttcacctataacctgaaaagtcctggaaattcaatataaaatacagaagatcctaaaagctgattaaaagaaacatatttttggtaaaccaacaaacaaagaaaatgatttggaaaatgttttttaaatctggagtaacagaaaaacaactaaaatagagattagaaagaaatcggtataagccaagagttcccatatggaattttgaagtttaggttatatttataacaatagacgtacaagtatattaaagaagaaaacgttcttaagaagatgaattcacctgtatttcataactttcaacaaattgatcattcattaaaatctgctaagaaattattgaccattttgagaataatcaaatacagaatacaataaaaatacttgaataaattccaaaagaatgtttcaaaacaatattattccttatattagtaaatgtggtaaaaatcagcaaaatagtaagtgagaaaattcaatggtatccatatgaggtgtgtgttggtggaaaagaacatttacgggtttgaaacccaggcatgaattatcaaaatgagtctcaagaaaatggcagtagcagcatttacttacaattttaaattccttctactggctgatactgatgccctgaaatggtttcgatcaaccgtctttaaggagacccctttacatatatattgtatacagtatgcaaattctaaatgtaaactatcaagaataatacatgtataaaaaataaatcatcaaaattttaagttctttatggtaatccttttttatatgtttatttttatatgtttactatgttttttatatgtttatttttaccttaacctggctcttttggaagtattagctttggtaaaagggaaaaagaggaaaatattttaacctttctcacttctctatcgactggctctttgcgaggtgagtgtgcatcatttgtgtgtggatgagagcccgtgataaggaccaaggagaacacaagcaaagagagtgggcgtgaaaaggagatgaagtaagaagcgtccacaaggccaagagaaatctcgtggcagaacagatggtggcgtgaagggcgacagtgaacacgggggccaccctggctttggtagatgccagacatgcattgtgttctgcacactttccaccctggagcttatgaatccacacagaaaccagcttcgctgtagatttaacactgtaacgcgatgcaaaacagaatgcatggtggccggttccactctcactgtcgggacatccaaaacatgccctacaaatactgtcaataacataaaataatgcgtaatgcctcctccactgtgctttcaaagcactgaaacgcctgataaccaaatctacaataagcaaagaggggatatcacacacttaggcaaaaacaccccatgtgaaaactagaaagtaagcttaggtctattctaagacttgaatttcttacataaatgtgagagtaattttgataacaagagaggtaagaagactcctggccaacaattaatctgtaacaaatattaagcttaggaatgattttacatttagactgtatttcttaataaatttcctcacataaattgtgcctaatctataaactaattttaaacaaaatccatcatgccaggcactttacatcttactctatttattgcaccatttctcatcagaaaccttttagctttaatgctattccatggcagagtatctcattagagtggcaaagataaagttctttttgagataaagtaattacggtgattgtagcggggagggggtcacccaaagttcttggctacagtaatctcctggcttctgattcattttaagaccaataaactgagtacaaacaaaaagatgttaatggtggataactctggttacctagagtttgtcctggagggattagcaattcataaccttaatcagaactagagtcctggagaattttgctcccaggaaaatatttcaagaccagatgctgtatgtgctctcagctcacttctatgtcaattctatcttctaattattattaaagtcaatcaagtatttcactctataaaaagccttactatattttaagccaattttctgttccaaagactagtcagttacttcctatcccaggggctttgctttcttgaggaggcacaagtcagttgaaatatgggctatggccaagacaatgatagtagcaagggacaggactcctcagccatgatcagaaagagtactgttaggatttagtgagaagccttcaggggaaggaggaggcttggttttcaaatcatgccaagggacagacttaccattgccatggagtcaaattaaccttaccagcccagtcaaaataattaaaaattaatacagtctctgataaagtttgttgatataaattggtgctagggaaatatttcaaggaaacaatgacatgagttattttaaattattaatttcattggtcaggaacccaatcagaattaaatatgcacatataaaacaacctcccttgtgtgttcaactctgtctcatttctgcatggacctcagtggatgacttttgaagaagcagatgaaaagtgaatgcttgccaattagctattgttcaccgttttccagtaagcattcatatttctaaaggattatagtctagtccaaactctgatcaaggtcaccatgcaagaaagaggatattctgatatggagatgaagaaaatttgagtccgggttggttctcaacttacctatgaggtcaggtgaaaacttcagacatcagttccccatgcctaacatcaggacaaaattaactatccatttcctttacaatttgttagagtatcatattaaatgtgaaacatgattaaactggagcatcacatttgaaaagcaactcattattattacatgtaaattttaaatagcattcaggaaatgttagaattaagaacaaatcaccaataaaaactttagaagattaccatttagactcatgatatgagtggatctcgttgcaaactgatttttccaaatgagaaaaaatacaattatactttcaaaaataacccaggtggctaaccaggttccagttttcctccttaggtataaaaatcttgctgaagttcacataaaccacatgctgctcacctataactagtcagccacacaagatcctatattgtatttttgttcttgatcagagacaattatgtaagttatcgatccttataaagttctagaaaatgaaacctcagaattgcctattattcacacagcaatctttacacttggcaaagtttagcacctactccattattgcaaagcctaaatttgctggtgaatcagtagtgtgactggtcggctgatccacagaaatattatttgtaggtgttactgaatgtgtatttttgttattgaaaaattgaaacatctgatcttctcctatggactagctacactagatctagttactgtactaaaatatggattatataagttatctttgatttaattgtccctaaatccataagcatatttttttcaagagtatgtttcagttatattttaagtacaagggaagtagttagaaaatagaacactgattactagatttgtatagtgaggactatatcctagtaaaggccagggctatggaaaaatacaaagcagatttttcactcctggcttcgatatttatgaactgtgtaactttgggctcattacttaacctcatggagtctctttgtaaaaacactggatgagaattggagaaaaatagaaatacaagaatataaggataaggaaggaaatcagtacactgtagtgaagccatcataattgctatgcttcatttcattatatgatgccagacagaatttctaaagggtatgaattcatggagtcaacatagaaaatttcgaatacaaatgctatttattcagcattacttgattcgtgtctttctatggacaaggcactttgtgaggtgttaaacataaactagagacccaagctgaaagttatctgatcttataacaaggcttacaggctcttcgaacatagacaagtaaggacactttggtagaatgaagggcaggaagtgaatgatacctgcaatactggagttgacattttggcccctcaggtaggaaatgaagagaggagaggccaacagctctagaaaaacttcagagaagggtcaatgatatgcagagcagaaaacagtgcttggggaagaaacagcatgaatttaaatatcaaaggtggagcatctctgggaactgagaaaaatcccaggtggtcacatgactgggctttggagatagaggtggagccgagactacaaaacacagggattgaacatccctcccaggatgctgggcctggggagcagggtggcatgacatcatcacagagcctcagcctgagatggaaatgctcacagcctcttgatgcagagcagtagaggtaggggtggttttacttctctgaaatcagttagccaaagcctagattgatttcatacatgagtatatataaatatatatacatacatacataaaatagtaatattaatagaataacaataaagaattttacatttctaaatatttatgttctggctactgttctaagtactcttcgtaaatgagctaatctgcacaaaaggaaatagatactattgtaccattgaatagatattaccaagttggcataggtaagagcaaaggaagtcaggattctaatggggcagactggctctggctaactgatttcagagaagtaaaaccacccctacctctactgctctgcatcaagaggctgtgagcatttcttaggctcacaggtcatcacctctcagccaagccttactgttcctgaggattacgacatgtcaggctctggtaagtacctactattaatgtaccatttagtccccacaacactctattttggcttgttatgtttaggccaatgctacaggttggttttctttctgtttttctatttttttcccacacaaagcatattattaaatgagaaatcccatgtaaaattccagattgatgatttcttttgattaaaaagaaaacaatacagccatactgagtttccctctcacctcttgccagcaactggcagaagcgacttttcaacatgaattccacctcacccttccactactgtcctcaccgccccctactgcccacatctaacctaacttctcatcacctgagtgatcactgtggacatatgagtatgtgacatctatcgtaattatatctgtgtgttaaaaaaaaaaaaagctgaaaagctaaaggagttaaatgtttagattagacagtccaggttcaacctccaagtccacactcataagttcctcttttcttgggcaaatgccttaatctctttaagccttattatcctcacatctaaaatagggttactaataatgcttaactgagagtgttcttatgaaataattaaaccagataatgcctgaaaagaatttagcttggaattcaatattcatttttattgccatttttaccaagaataccaggaagttggtataaataggtcatatatgccacctaaagcaatcaggacttaggcacagattggggtagatgaggttgtgtcttgtgttgagaaagccagaggagaggagcaagtggaagcaacccctcttggggacattgggcctgcagcatgctgcccggcaggagagctgcccaagaactgtcccagaaagagccccgtgggcatcattcttgtgtggctttgactctataaatgaatttctctagacagctgaaatgttcatcaaagtgaaacactgaatcacagctttctgtaattccaccattttctcaggcctgagaagatggatccatgatttctcctttattaggtggatcttttgagttctttcacaggccccgtaacacccattctacagggctgccaccttgaccctggcccacagctcctcatctgcgaaccagatgaaatgcgccttaattagcctcttgtctttcacctgtccccatcttcaagtctaatggcaaactgtcctcagcatgaactgtcctcaatagcgtttgacacatcaccctggtttatacaattttgctgtggtttccgtcagcttgcagaatagaatctgaacatgccagtcatcactggggttcctggctggtgcctggggtatttacccacacttgcacacctgactgcccccagcactgtgtccttgacacccccgtgtctgtgttctctccaccgcggggactggacacgctcggcctgcatgccctctattgcaaccacatcacatccagccaaatcccttggagccaccgagccggaacctgacactttctatcggggtcagcaaacctgttctctaaagaaccagtgagtatgtattgcaggctttgtaggccacccagtctgtttcccagctactccactctgcacttaaagcaggaaaggagctgtaggcaacatgtacagaaatgggtggggctggctctccattaaactttatttatggacatgagaatgtaaatttcatgggtcacataatgttattcatcttttgatttttcccaaccatttaaagccataaaaaccaactttgcgtcaggggctgcacagaaacaagcagtggccacagcagacttcagttgactgacccttgctttatatgcatactgtttgctgatccatactctttttttactttttaaaattaaggtataacgtacatttggtgcaccaatcttaacgcaacagcccagtgaatgttgacttttgtatataaccatgctaccatcacacagatcaagatacaaaacatttttagcagcctaaggttcctaaatggtcccttctaatcacaccgtaacagaagcccaacctctttttgctgccaaagcactctccatacttcctttcataggcctggataaagtaatggggaaacaaccctgtgtaatctaaactttcacagagcagaaagaaatccagaagacaaaggcgcataaacgaaacttcggctatcattaactatcacaaccacagaagagaatgtcttttcttttcaaagacgggtgatacatcattagaaaaactgaaaggcaatgtgttagtacacattcattttcctggcagtctcatgctgacactgcatttccttacctgggtcaaggtgagcgttgcctgcctgcaggtgctgcactgtaccctgagttttcccggctgcactctttgacaggggcctttgcaatacacataaaagctgttgtagattgatctacctgctggagaagaaaaagcagaagaagtggctaataatgctgcatctaaattgagacaagaaactctttaaaagcttgttagaggcaaattttaaaactcagtcttcaggaacattttgaaacattactggaataaatattccaatgggaatacaacaatttaatttagaaaatctaactttatgctccaagagtgaaatcttttctctctcttgccaacagccctgtgacttactcagcaaagtaagcagcctactgccaagagaatcgggcaagtgtatctgcaacacagtaaaatcagaggcactctttgccgaggaagtttgaaaagatgacaggaattctttcaggatgctcctgaattctatctcgtgcttccagacacagttttgaagactgcagatttttcctcataatatctacagagaaaaaccagcccatttatcgtgatataaatgatatgatcacagtttgctgggcttctagggttgactttctaactcacagtcacacataaaataagaaaagaggccaacgctgaggaactttcagagaccaagcagctatgtgcagaaatggatggtttgcatttcatttatgatctctctacctaggcaaacaccattcaaataatacattttcaagagtaaaaggtgaacaaacaactaattcaatagttcaatctcagatcatttctctcaactgtcaccatatagggacactctgtaaactagggaaatttaatcaatttatacttccatatctgttaagaattaactttattcagaagcacttaccagaaatacaaccttcttcctgaatttctaaattttgaaaattactaaatagttttttcttttaatccttacctgggtggataatataacagatcatgacataaaagtttctttgaaattttactatgatcatcagaggcacctagagataatatatttttttttaacatttggaatgaaaatcttcagcctcacaaatgcatatgatctattaaaaacaactagaacaaaaataatgaaaaaaatgagattctaaagtcctttgcagcttcatttcccgaatttacaaaaagagcttttgcagacatattggattatcatttgtttagctatctttcctaatactgtaggtgacaatactttgcaaaatctgaagcacaacaaagatgtaaagtttcatggttttatcatttgtttgcaatatattttataattattactctataaagattaatatttagtttccagtgggaaatggaagataaaatgtaaatacatgtttatattgatgtgaaagtactattttctgacacttctgtgtaactttaatgccctaatgtacaacatattcaagtacataaatatgacattgctgttagcaaacataataatgacataaaatgtttcacatgtaatatacatgcagcatagaaccatgtattaatgttatagaaatatttgtaacaactgactgaaatatctgtaatatgtaagtaaatgttaatggaaatatttgtaacataaatatttgcaacatgcagagtatcaaaagatcacaagaactgtgacaattctgacgtgcactaagaagtgcatagaagaagaagtgcttagaagaagaacctttactgttaaaacctttatcagcaacaggaacaaatccaatttcacaatttttataaccttttgtaaaggtcaaacaataaaaagaaaaaaggaggaagaaaaggaacaggaaaagcaaaagctttgaaaggggagtcagggctgcaaatacgctagcattgttgaaagagcatattagcaagagttttacaatattaaaagaagcatctcagaaattgcaggaaactaagtgactcttctctctcccttaaggcaatagtgatgtttgcaatattgtttcagctaatgatatatcaacgcagaatctgaaagctaaggaacttttccacctccgaatgctactaccttcgctgaagtccttcagaagttattcagaaaatactgtatgccaatgtctgtgccctagaagcatacaagatgacatgcaatctattacacacactgctttccagacccagccacaagttggggattaacagccagtctaaggaagatcaaggtcaggccagtcgtggctgcagcgcttttcaagctgttggctccacttggtcaagcagctggggcatcaggtaaatcttgagagcccctccagaacggcttccctatttatttagctacataacacaattaaaagttggcaaggttttctgtgtcatgctgtgacctggacaggcatgaaaacaaataacaccccgacaatcttctgggcaaggttcccatcggcctggctgaagggcctaaagtagaaactcttgaatatggagtcataactcttagaggaatggcaaggcaattccaaaaatgacctgagaaacctttcttgtggtatgtagctgtctctagtcaatagcatgaatctcaccctttcacttgttcttggaccttaaaatcctttctctctcctaatcaactcttctgtatggcagcttcttgattatcccaataactaaagtagcttatgtttgtgttcataagagtttcctctttttgtatagtaagttttgaaacatagagagatatttcaaaaattgtacaaatcacatccttcattgtaattcatcacttgcagatatttcgccacgtttgggttccctgtgcgcgtgtgtgtgcatatagctgtgtacacatatactacatgtataaactatttggttgaaggatctgtaacacagtttctgacatcatgctacttcacctctaaattcttcaacatcctaaaactagggatgtttttcatataaaaccatttagctttttaagtgatttggttattttgtagttctattcatagactaatcaggtatattttaagtaggcattacagaaaatgacagtggtttgcaagctaataaaagatgacaataaaaaatattggggattctctcgtcaaaccaatttaggtggtgctaagtgaagccacattaaacaagtcccctgaccataccccttctcagagctgagtgactctgtaaaaatgaaaggatgaagcacaggacatctcaaacttctcctgaccatagatgccttcctggaatgctgcatcgtgtgacactgtacttctcagaaaaaaacaatttagaaaaaaatatcagatgaaggattcaatccacttgtagggcttgatttatagaaagtgaaactgctcatgtttataaacccagatttaccaaattctcctggatatctgcctacggccaagttctttcctccaacccaaaacatcaacgaactcatataattactttgtcatgtgccaggaggttaagtctacttatgtaatgattttgcaaataaagtatgttaattttattcagaagttttgttttttttttttcctgcagagaagttaaaaagaaaagtgtactgagttcagggcccttttaaagcgtgagtcaccgtggccattcagaggtccactggctttctaccattccttagcctaagaagtccatcttcttcttcttttttttttttcttttttcttttttgagatggagtctcgctgtgttgcccagactggagtggaatggtacaatctcggctcactgcaacttcctcctcttgggttcaagtgattctcctgcctcaacctcctgagtagctggaactacaggcgtgcaccaccacacccagctaattttggtatttttagtagagacagggtttcaccatgttggcctggatggtcttgatctcttgacctcatgatctgcccacctcagcctctcaaagtgctgggattacatgcatgagccaccacgcccggccaagtccatcttcttctttagttttctctcacgctttgcctaacagaaccctcagtcaaatcttctcttttcctttcttttcttggtcaaaaaagttgctgaaataacaatgtttacaacatattgaatagagccaatatttgaaaatagtatattttatttgcttgggattttttagaaaccagtataatctttacagttatcatttttcttttatgtattttagataataggcttaagggttgaagacaggatacttaggaagagtcgttctgattctaatggaaacttttcattaacctgagaagtttccatcactagttgtcactgagaatttaattgctgggataatttgttttctaggtggggagagagtaagatttaacatatttcttaccttggtaaaatactgttcagtatcaacatattgtaacagagcaaaacagcaggaacaggacggattttaagtgatatttatcacatgagctattaaaatattaagtagaacaatgtcacccaagagaactctctgcaatgatgaaaatgttctccatttgcactatctcatattaatatatacacacacagacacacacacacacgtacatagcatatgtagccattagctacaactacctatggagaacttgaaacttagtgaggaattactctctgagttttattaatttaaagtagtttcaatttaaatagctgtctgtgggtagcagctaccaaactagaaagcacagaagaagagaataaaaaccactggtgtggctggtcccctcttcaactgacaacgcggagactcactgggcagtgaaacagcttgttttaatctgtgctcatataaaaataatgttggcccgagagaaggagaaggaagaaggttttactcgtggcactggggtaggacagaaacaggggggacttccgtagtgctagaagcagagaaaaggttctcgccatcatgtgcccttatttcctacaccaaggggatctgttcttgagacgcacctggacagcaatggctccatctccatttccatcaccacctttgaaatctgacccatatgctcaaggtacagttagactggcacttcttgtatgatttctgcccttgatttccattatcatatgatatttccctaaaaatgacatctaagagaaggaaagtagccagtgcagtctcatcctcttcgaacagctggcttgcaccaacaccacagaaccagctactgataaggagctgctggcatgaggcgtcccccaagcctttgtccaaagccccccacattgccaagcctggctattggtggtttcagctccttccctctttcctccttctgactacagagttgtccttgtttcttacacatcaagaatgctgctgctggtgtcattagctctcatttttcagttacacctgccatattccctcagttcagccctgcgcctagtcatgcagggagtcacctcagttctggtggagccctggattctcctgtggaatagatgcatggccagagtttctggacccgggacagggatctggtcagaagtaacagcaggggcacagaaccttcttcctcatcatccatcaggattattgctactgtatttctgggtgctggccttcagcagggcttgaccacatttgctggaatacacgtctccacaaggacacaaccagtatgtaccaaatgaacagaatcagcaccacctctgatgtccagcaagcgcttctttacacattatggagagagaacccacttttcttcatgttgagtgaaggtattcattagttctagtttaaccaatatgtacagaaatagtccaaagtggttccacatgaaattcatttggactggacttcctgaatcacctcttctaaggacaccttgctttggagccttaaaaagatggggatcggcctgccgcagtgactcaagcctgtaatcccagcactttgggaggccgaggcaggcggatcacaaggtcaggagatccagaccatcctggctaacacgatgaaaccccttctctattaaaaatacaaaaaattagccggcttggtggccggacccctgtagtcccagctgctcgggaggctgaggcaggagaatcgcttgaacccaggagacggacgctgaagtgagctgagatcccatcactgcactccagcctgggtgacagagcgagactctgtccccccaaccaaaaaagaaaaagatggggataacgaccatttcaccattatgcaggttactgggggaaaagttgctaaactgggcaggtcaaacacggaggcttcattatctcactagaaatctccctctagggagccacagtcagcactctctggaaaggtcatgcagccaaccgattcacttgaccgtcctaacatcccactcagcgcatggccccgtgtctgcccatctttccgtctcactatgtgagtggaccactctcttcagttgaacgcttccttccctctccttctgaaggctcatgggacctcatgtgcacaccactggccctcaatgcgctcaccttgacctttctgtacctgtccaaacttttctatggatacaacctctctgtgtgtaacacttcactctatttcatatgctccaaatggctagtgaagttccctgaactcaataaacactcaataggtatttgctaggtcaataaattctcccatatttttaatggggtgaaaactgaagtgagcatggtggtgtcagggcaacaaatataaaatagaatgcagccatgatcattcaatatctagaacatctttcctaccaaccagacaccctttaaattgttgggatatcatatttgaaatcagtaaaattaaacattagaaaaattacttacataagaactaaaataaaaaaatgtttatataggacttggtgtaactgaatgttaaggagaaaaagtgaaattctaagtttaccaacaagtagaactattctaaaggaagacagttattacatgaacactcttcactccaaaccttgtccaataggttattacacccaactgaatcaaactgcctgttccatgcttttaacgagccataaacttaactcctgtggagtaaccaaggttatgctatattgtaaacagcttccaattacataaccatccatccagtgaatgtacttctaaaaaatacttctaaaacatgcttagcaatctctaaggagactctacacttaaaagttataacttaattctcaaatttttgctggggttttaaattaacgtatctgcacaataatttgacctactgaggcaaaaactgctgattaaatctaatacctttttctgattttttggttgttgttgccaatttattttttcatttttcattttgaaaataataatgaaatttcccataccaagacaaaactgtagagtgaagcaaaatttaagaattaggtttaaataaataacaaagtacaaagccaaaaagagtaaatgtagttgctttttctttcagaaatggatacgggccaggaaatgggcacagttaaggtggtgccaggaaagtcacagctttccaaaagttgaataaactccataatataaatgtagatggaagaaaccatcaatgctgcagataatgtgtccagtttcctcacaatgacatctctatagcctggggtatgtccatcttggcttaaagaggcagcacctatgggaaaactggctagccatatgtagaaagctgaaactggatcccttccttacaccttatacaaaaattaaatcaagatggattaaagactaaaatgtcagacctaaaaccataaaaaccctagaagaaaacctaggcaatgccattcaggacacaggcatgggcaaggacttcatgactgaaacaccaaaagcaatggcaacaaaagccaaaattgacaaatgggatctcattatactaaagagcttctgcacagcagaaactatcatcagagtgaacagacaacctacagaatgggagaaaatttttgcaatctacctatctgacagaaggctaatattcagaatctacaaagaactcaaacaaatttacatgaaaaaaacaagcaaccccatcaaaaagtgggcaaaggatatgaacagacacttctatgcatccatagaacagacagctatgcagccaacagacacatgaaaaaatgctcatcgtcactggtcatcagagaaatgtaaatcaaaaccacaatgagataccatctcatgccagatagaatggcaatcactaaaaagtcagaaaacaacagatgctggagacgatgtggagaaacaggaacgcttttacattgctggtgggagtgtaaattagttcaaccattgtggaagacagtgcagcgattcctcaaggatctagaactagaaataccatttgacccagccatgccattactgggtatatacacccaaaggattataaatcatgctgctaataaagacacacgcacatgtttgcttattgcagtactattcacactagcaaagacttggaaccaacccaaatatccatcaatgatagactggattaagaaaatgtggcacatatacaccgtggaatactatgcagccataaaaaagaatgagttcatgtcctttgtggggatgtggatgaagctggaaaccatcattctcagcaaactatcacaaggacagaaaaccaaacactgcatgttctcactcataggtgggaattgaacaatgagaacacttggatgcagggcggggaacatcacacactggggcctgttgtgggatggggagaggggggagggatagcattaggagaaatacctaatgtaaatgatgagttgatgggtgcagcaaaccaacatggcatatgtatatgtatcaaactggtatgttgtgcacatgcaccctataacttaaagtataataataaaaaataaaataaaataaaataaaataaagaggcagcacctctctggagccatgacctctttgtcaaaccctggcctggccttgtcacctttgggaaatcagctggccctcaatgcctgttctctcatctgcaattatatgtctactattattgtctcagtagacaataatagtatctaactcagtagactgtggtaaggattttaaaaataataatggaggtgaggcacttagaacaatgtctgctatacatggaatgttcagcacatgttgtttatttgtatttgctgccaaaaaaattctgaactcaagctcctcccacggattcttcaagctgtaggcatttacccctcctacttcctcaggtggctactttcctgtttaataaatgttgattcttagacagtatttccatcttaaatccactgcatttttgtaaatagaggaaatataaatcttaaataattctttttaaaattacttcattcccaaccaaatcctttacaattaaatatttaataatattatggaacacaaaccctgatggaaagtcccaaaattgattgaaatttttctagaatcatatttgtttctgtgaatcacttttttattatgaggtaagagatacaggggtggactgcagaaaagttaggaaggaaaataataaacaattacatgatctagtccagttgataaaattttcaagttggctaatatgctttaaaaaaaagtatttccaaaataaaagctttttttattgtatggttgtggaatggtactaaaggggattcaatatgtatttcaaaatttaatatgaatggcagacttgttaaatttgcatccactcttctttgaaaggtaggtacgattgtcagcatttcataacaaagaaaacacaagctaatgggttgaatggtgtccccaagacagcactcggggtcatcagagatttacaggtaagccttcctcattagaaagcacaagctttccttttaaccacatgataataaccttgagtcagacggtggactttacaaaatactgtaggggactgattccatggctcttgcaaagtggcacttacacacagatcggcaattatggacccaggccagcagtcacaaacaccactgcaggtgctggctcactacccccacatccctcatgcaatcagtgctaacagtttcatggaaattcccattaatgttttaaagcactggcattcagtaagaatgtgcaggtacagcaattaccaatgaggaaaattaagtctcattttcaaagattagcacatgttctacaaattgaatgttatcccaagaaatggaatccatggaatgacctgagaatcaatacaatttcttttttatttttacagaagtagtacttttcttgctatttaaaaaataatttaaaattttttaaaaaaacattctaagtgttagaaaaacctgttacgtaaatgaaccctcagaggaatggcattaattaagagagtagagcaacacggtgtgagcctccaaactcccacattctttgttcatcttcaatagccaatataattagttttgtataaatattttatttacatataatatttcctatcttcactgctaacataaaataaacctcttacaaatttcgatgctttaagcatcttatttcacctgtaacaaataagacaaaacattcaatgttaaaaaatttggatcatttctagtattgatttccaaaagcttttggtggtgattgagattcataaaatctctactacctcttaaaagaggagaagacatatttttctctagtaacatactgataagttagaaacacatggtgatgtcatcatgctggggggaaaacatagattatttttttcctttaatcaagactgataagactatgaattacatattgttctaaaagtctgcactggaataactccagctgaaacactcttcactggtactgtgggaccatgaaagtctttctatatcatgagtatctcagtcaaaaggtttccaggaatccatctaagacctcactcaggggccgcctctctcctaccctaaacactccttgctgtaagttcccttcaagttgaatgtctgtagcaggctgagctatcccatcttctgcagtgacttcacctgtttaagtcagcaatcccccgagatttgaagcttctcaagggcaagtttcatgtcagtggtctcacttctattccccacccccaccttcaaccaaaaagaatgttgtcccaggaagacattaaaccctgtgaatgatcaagtaattaagaaattggtgagattaagaaagctcgcttaaactcaacattttaaaaacacaggaaagttgctcggcctgtgctacagattacagtaatgtttctgtttacttttgatattgtctctgcctaaagaagaaaaacatcgggctttgagaatgctgcagagtcacaggccggcatgtattcttcattgcctctataaaaggtaaacttagagaaatctaaacatgcttatatacagtcaggcattgtttaacaacagggatatattctgagaaatgtgtccttagacgattgtggaattgtgcaaacatcagagtgtacttacacacacctagatggcatcacctagtacacagctgggccctatggtacagcctattgctcctaggctatgaacctgtagagcatgttactgtactgaatactgcaggcagtaactgtaacagtaactgtaacacaatggtaagtatttgtatacctaaacatatctaaacatagaaaaggtaatgtgacattatgagggctatgatatgactgggtgatagaaactttttagctcaattaaaatcttatggggccattgttatatatgtggtccatccttgactgtatgtctttatgtggtgcatgactatattagcagtcaataggaaaaaaaatgaagatataaattgataatttatcagtcagtatctagctttctaaatgtactttaatcttgtctgcaaaaaggattgggttgtttgggaaaagggagaatgatggttagaaagtggggtggtggtcctaaagaaacagaagaatattaaaaacctatcaagatgccatctatcaataatgttaacaataaatattgggggaaatctcatggactcaacactagtagtttgtgagaaaataatgaaacaatcaagacaagcctccctttaacagttttcaaatcctagaataacactgagatgtattccgaaacaccgtgaagggtatttcacaatgcatacacaactgggaaggagcctagcatgctcacaatagtaaaacgatgctgggcacagtggctcatgcctgtcatcccagcagtttgggaggctgagacaagttgagcttgagctcaggagttcgagatcagcctgggcagcacagtgagacttcatctctacaaaaaataaacaaaaaaatagctgaatatggtggcacatgcctgtacctccagctaggaatagctaggaggctgaggtgggagaattgcttgagcctgggaggtcaaggctgcagtgagctaacatggtgtcactgcacttcagcctgggctacagaatgacaccctgccttaaaaaaataaaaaaaatgtatattttgtagaattattactatagtaaaaatatttccaaaaaaaaaccatacacacacacacacacacacacacacacacacacacacacacacacacacacacatatgaatagtaagaagtaatagagtcttatattgaaagttctttgatgtcctattctggaattattctagcttcactttcccatgatcctgtgttctatccagatgcatccactcatacccttaggaggccagaaggcagccatgcaccctagatcaaaaggtgttggctcaatgctgttagggagtgaccccagacacatcccctatctctctggagcttggttcaggtctcagacgtacagcatacacacacgaacaccaaggtgccaggagacactgcaggaagaccttcaaaggggaacagatcaaacaaataggcacctgaaggaagggaagggaagtttagaggtggggccaattcaacacccagagttctatgacttccaattgcacgcactttgtttcagctgtaccatcttttctatctccagtatcctaggttttgagcagcagaatcgtggtttccctagagagtcaagacagaaaccacagcacagactgcctcctctcctttcttcagggttggatggttctctctgtgtagttggggatggcagccactggttacctgtggctctgagcacatgaaaggtggttcctgaaactaaggaattcatttttaaatcttatttacatttgtttaatttaaatttaaacagccagttctgtccagtggttatccaaatttgggcaacacaggtctaagggaatgaattccttcttaacacagattgaaggttccagggaagttacctgtatatttgcagacttttatccagtacatatgcaaataatttctgtccagtgaaacagataacacccaaaatgtgtggcctggcggaaatttcttagttgataaatagatagatagaaagatagatccctaatttctcaaggctctctgaattggtcatggtatcttatgatgtccctcattcattaaaagattaaataaaaatttttacatgtgttcactttatatttgctttataattttaccttttgtaaattatactttaggatcttatttttgaggagagagaagattgttaaggctccagcttggagttgtctctcaataagtaagcaataaatattcacctttcttcctcatcctttatccctgctaacagcatctaggaatccttatttcatcctacttccccatctgcaaccttattgggcccagaaataccacttcctctaggaagtcttacttaattcctccatttaatgtaaatcccctccccctaaatgcccactacatttgagttgcatcattcttaggggtcgtaagctacattctatctcacaatatcccatagataattttatctctcctaccaggctttagattcttttgaaggtgaaggctacattttattgcattctccctggtgttgatgaataaaaacggtaaatattatgtggaggaaccaaataactagacttgaaactaatggtgtggtataaaaaagtctttcagcttgcaaaagataaaatcacaatcaactggccttaaaataacttaatctctgtgacaatataatgaggaatgttcttccaggcccattaaaatgacatgcaatttgataattatttttacagtgtcaggattctaaactaaatgtttctcagcttctgttatctggtgatactaaatgaatgttgtcaaaagattaaatgtaaattggttataaatcttcatttaaccacatcatgcagggaaggttacattacagccaccatgttcgtgtcatcattaagaaatggagtcttattttaatagtattaagactattgaaattattgtttattctatctaattggctttggagttgaggatgaagcttttgatgggcatcactgaatacaggagcaaaactgaaataaaaatgaggggcaggccgggcggtggctcacacctgtgataccagcactttgggagggcaaggtgggtggatcatgaggtcaggagttcaagactagcttggccaacatggtgaaaccccatctctactaaaaatacaaaaattagctggcatggtggtgcatgcctgtaatcccagctacttgggagactgaggcaggagaattgcttgaaccgggacccgggaggcagaggtagcagtgagcaagatcgcaccactgcactccagcctgcgctacacagtgagactctgtcacaagaaaactgaagggcaatgaacttaaacccttctggaccccaaatggacaaatggacaggatggggaatagctgcagccactatctgcaggaaacactatcattgtctgaaaggccatcttcactttctaactagattttccaaactaattaaacaatctaatttcagtgaaaagtccttcttttaaaaacccagtttgcggccgggcgcggtggctcacgcctgtaatcccagcactttgggaggccgaggcgggtggatcatgaggtcaggagatcgagatcatcctggctaacaaggtgaaaccccgtctctactaaaaatacaaaaaattagccgggcgcggtggcgggcgcctgtagtcccagctactccggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacccagtttgcctggctttttcaggaaatgacctatggtttgatcacctgtccaaaccatctggcggcaggaatgtgatctagttagactctcacagacggtgtctgggaagctccatcattgggctttaatgttaaagccacacggccacacagccaggacactttgatgaacagccactcacggacacagtgagcccatcatgagatgatgagaccaagttgcattacaatgattttgacagccagcaaaattatatttaaaaatgaaatctttcttttggttctgtatttgaagtaaggaaaatcactttgggggtaaaatcagggttttggaagaaactgatacttcttattaggtttaatttaactggcagtaataattaggacatgataattataccaggtgaagcctgcaatagacttagttctactttaatacttaattgatattgcaaacaccaagattttcggtgtacagacaaatatagtatccttgtataaatgtatatgctcaactaatgcagctattctacaatcgaagaatctctccttaatcaaggaaaatgattcatatcagaaaaactgtaaaaagcacctcttgacacattctccatgtgctacatgaaccaaggcccaatcatttgttcccctcagtctctctcctgatatgcatggtttccacatccctttctacagcctctgtgtgggggtaggaagaaggaagcagaaaaacaaacacacacatccacatgttccttctccttactgctctggcttctcagacttggtcccactacttacatttttttgtttgtttatttgtctgtttgtttgagacacagtctccctctgttgcccagcctggagtgcaatggtgctacctcagctcactgcaacccccacctcccggattcaagctattctcctgactctgcctccctcccaagtagctgggattacaggcgtgtgccaccacacccagctaattttttgtgtgtgtatttttagtagagatggggtttcaccatgttggtcaggctggtttcgaactcctgacctcaagtgatctgcccacctcgccctcccaaagttctaggattacaggcatgagccaccatgcccagttttaaatttttaaaagagtattaataaatacatcaatcagaggaatatgtaagattctactgagaagcacaattcctattagcgcaagggagacaaaaacactatcatggtattgttaaggctccagcttggggttgtctctcaataagtaagcaatattcacctttcttccctatcctttatccctgctaacagcatctaggaatccttaatctatccgacttctaagtaggaggtgagcaggggtgtgggaaaacattctggcaggatctctatgcaaaagaaacaggtggtttagggtgcgattgagaggtagacatgtcccacacagctccagcacagaactgcacgccggggtgacaggtctgcctttcagaggactaagctgctgtggcaacagccagccacagccctccagaggaaggaccacagttcataaactttagagtctctgggagcacttgctggggagcagcgtgatggaggtgctttccagaaggcggtgctgaccaggccgctccctgcggaagcccctctggggaaggacactgggcagcaggaatgatggtggtggctcagcaggggtggagaactcctgtgtgcagcctgtgttcctgctgagagaggccccaagccctggagtcatgacatcaggaggctgtcgtgactcgttcactaggtgtgggaagcccagcactgtgtagtacatgctgcagagggcagaaccctgaggtgtgtggcagcctagagtcctgctgagcatggcagccggggctggaaacagtgaggcctgttctggagtgcctctgtgcaaatccacctatctggggttggggattggacatgagttatttattcgtttattagttattaatttttaagtttaccagggaaattgcatgcatagcaaaatatggaaaccattcattaaaagattcatgagactaaggtatcagttcagtggacacaaaataagcattccaggagtagaaagcaccctactttgtggggtgacattgagacagtgctgggaacctaacagtgaagctccctatgtgaggacctggtgccacaaatggggtggtagataatgcacatgggcctccactcatgttcctccgtggcagcgaattaaagaacatccatcttcttacttcttttctgtttctcagttgccaaccatatgcctgtttagttacacacctcggcatggtggctcacacctgtgatcccagcactttgagaggccaagaaaggtggatcacttgagcccaggagtttgagaccagcccgggcaacatggagaaaccctgtctctacctacataaaaaataaaaattaataaataaattagctggtcatggtggcatgcacctgtactcccagctacttggcaggctgaggtgggagaaatcacttgaacccagtaggtcaaggctacggtgagccatgatcctgccactgtactccagcctgggtaacagagagagttcttgcccaaataaataactaaataaataaaataagaaatcagccaaagacttcacttgctctgacagaaactttcacaaaatctactagaacgcagtggattcagagatctgtcaaacacttctttatctaatactgcataggtgactccctgtctagaaaaattaataaaaactgacaagccacctgcactgtagctcttccgcttcctctactgttcattattggctttatttcatttctatattaaactgcatattacaaactcaggccagctggatctttgcatagatactatatcttgtttctgccagagatgatttttattcagaatgaacagtaaaaggcaacactacgtagaaaatgcacttgagttttaaaataaagatgaaaaaacttgtgcatcatccaatggtcctccgcagcatggaggaaaaaaaaaaaaacatacttcagggagataatatctttccttctccatttcacaaatgggtatcttcaattaaaacacttgtttagattcattagtgtttccttgatttgattcttcggtccatgagtaaatacattttagagattaaatgattagtttctttacatatgaaatagggctaatagtatttgcctttaatgatgttggagaatagtaaataaaataaaatacccttgccaggcatgtacagttgctcccttgtatacataaaggattggctccaagacctcctatggacagcaaaatccaacagtgctcaacacctttatataacatggtgtggtatttgcctataatctgtgtatatcctctcatatattaaaattgtttcatcagcaatggggaaaagactccctattcaataaatggtgctgggataacaggctatagatatacagaagaatgaaattcaagatggattaaagacaatccatcttggagttcatttttctgtatggtgattcctatacagaaaaatacctatcaccatacagaaaaatcaactcaagatggattaaagacttaatgtaagacttcaaactataaaaatcctagaagaaaacctagaaaatatccttcccattctaggccttggtaaagaatgtatgcttaagtcttcaaaaggaattgcaacaaaagcaaaaattgacaagagggacctaattaaacctgcataattaaagagcttcggcatagcaaaagaaacaaacaagggagtaaacaggcaactacagtctggaatcttcaggaatgagcccagcaaggccagagttcatgggggaaaaattttcaacataaacgtaaaagagtgactaaatcaatcaagggtaagaagtgaagattcaagtacaaagcagagggcagcaaaccaggtacaaaggaatctgtcacctatgcagtgagcataacccaacaggtagtttctcaaatcagagacccaaccagtaaccaaggtaaaagagggactaaatcaatcaacgaaaaaaaagtcaagatgcaagttcaaggcagaggtcaggaaacggaactccacatggacacagaatggtctactcatggcgcagccaaggggaggggcaggcagccgtcagggaaaagtactcaaaaaggcaacacttaccgaatgactgaaatttggagtcatggatttcagcagggatttgcagtgaaagaaacaggcatatagagactaagttcccaataaacgttacaattcatcctttcactctcctcttgaaatgggatgtattgtgaatgtattgagctaaattatcctgcatggctttggccagctatcccattctctggtgagtgtttattttcaaagagttagatgagtgaagagcggagaatggtaatgtaaccaatctgatgccttgttagaaaatcttccctcatgataccagaatgctttggtgtgaaagactggttcctgctggaatagtttcttttttaagactaatgcacaaaaatgcatattctgcctatgtttcttcccatgatgtgtattcatttagtgcgtaaggaattatttcttttcttccttgttcgcctcagtcctagtgcccagctcagtatcttgcatttgctgctagttgatgacactgaatttgcagcaaaatgaaatagaccttcttcaattggtctggtctgtttgtcactgagtatatgtgtcattgctgtgacagtaacctggctgatgaatgaaatttactggactatgaacagtaataagatattcctgaagccctggtttctcactttgctatcttaaaccaaagctattaaactcttcaaataagcatgctttattcagtaattcatagacttcaattaaatttggagcagcagagaactctgaacattcccattgatgccacagtggtatggccagagctaggctcaactgctccaaaatcgtcagccaaatacctcagtctcccaagccaaaatttgacatagactatgcttctccggccttatttcattactcaaaataagatgattgaaaaatgtatgaagcttacagtagaatactagtgggcacaagagaggagatgtaaatattcaggtaaaactcaataagttcagaaaaagattttcagcagatgcaaattaattggaaaaaatgtcagatgataaatctttgctttaccactttgcagtctgggtttgacaaggacataatctctaaaaaggaaggattttcaaaagaatcaacagaacattaaaggtatagagaattcagacactaattcaatcatacataatcttatctaacagttaatacactttctaagatgacgtaccagttggaggataagatgcaaaggatgaaaaagataaaagtagatttaatgcaatgttttacaggtaaaacattggttttggtttgaataacgaccttttactcttaccactttggacaacataggaggcagaattctatgataatccccaaaattccagccccctaatatacatgtcctatgtaagtaaccctctcgccttgagtgcaggtggcacctgtaaaaatgatcagatatcctcctattaggaggttatattaaataccaaagataaaggatttttgtagatgtgcaaaaggtcagaaatcggttgattttgaattaatccaaaaggagataccctgggtcggcctgacccaatcagagaagctcccatagaaaaacagtccagatcttgtggaaacgaagatacggagatagagcttccgaccgctttgaagatgtgaactatcatgctgagagtcccacgtgtcagggcattgcaggagcctcaaggagctgaaagcaaccatggctgacagccagcaagaaagctaggacttcagtcctacaacttcagggaatgaattctgccaacaatcatgtcagtgtgaaaaatgaatcccaaactgcagaaaggaacatggcccaattaatgcgttgatccatccttgtgagaccctgagtggaggatgcagttaagcactgctcacaatgtctgcgggtcagacctgaggaaatgcgggacctgactcacagaaattgtgagatcataaatgggtgtcgtttaaagccactgcactagtagtaatttattacacagcaaaaaatgactaatacgtgtggctggtttacttcacctcactgttagttttcttttttttaattttattttattattattatactttaagttttagggtacatgtgcacaatgtgcaggttagttacatatgtcatatgtatacatgtgccatgctggtgtgctgcacccattaactcatcatttagcattaggtatttctcctaatgctatccctcccccctccccccaccgcacaatagtccccagagtgtgatgttccccttcctgcgtccatgtgatctcattgttcaattcccacctatgagtgagaacatgcggtgtttggttttttgtccttgcgatagtttactgagaatgatgatttccaatttcatacatgtccctacaaaggacatgaactcatcattttttatggctgcacagtattccatggtgtatatgtgccacattttcttaatccagtctatcattgttggacatttgggttggttccaagtctttgatattgtgaatagaagaccataataggagggcactttaagaatttcatgtgattgacactcttggcatgtagctagcatgtaataaaagctcagtagaggcagttaatcataataatagtgctgctaatagcactattagtagcagcagtataaactgcagtaattgtgacaggctggaactcctagatatgcttgtaaacaaaattaaattgggatgaagaattctacaggctggtatttgactaaattaaatcaatgcttgattaaatctattgacatctatacgtatgtgtatattggcttattccaaatagacacgtgacacacacacacacacacacacacacacacacacacacacacacacacaaacataatgctccagaaacagcacagtatacctttctacaaatacactacacattttcctacctttgtatctctttcttatgtcctggtttttccccctgaaatgtcattcccacagctctacctgtaaaatttgttgacttttcattgcctacctaggatattgtgtattaacaatgttccaagagctgttgttgtcgttttgtaatatgagataggaatcatatgagataaatattactattattccaatgtatccctttttaaaggacagggaatgaaggactacaaagactgatttggctgtgttcgtggtgtggtgtcagcatctgaaattagtcactcaagctcctggttgtgccttccaccaccacaataagctttgagtcgatggcccctcatagatactcctccataccccaaaaagatttttttttccttttcttatctcttaacgatattttatttgacttagtagggtttaagctaagaccaagctgagctatatttggcatatagatacactgagtttacagaactgcctaacaatgttctggtcaacaatggactgcatatacagtggtagttttataacattacaatacggtatttttactgtactttttctatgtttagatacacaaaaacttgccaatgtcttataatttcctgtagtattcagtccattcacgtgctgtacaggtttgcagcctaagagcaacagctgtaccatgtagcctaggtgtgtgcgaggctataccatgcaggtctgtgtaagtccactccatgatgttcacacaatgccaagatcacctaacggtggactactcagaatgcatccccctcaaaaagtgacccaagactgaatttacatccactaatgtgcatgtggggaaggacaagttggagaaaaagcttgatgcgtgccgtcatttatactttcccagttggaggagagaagccaatcaaagggaattaacagagaggctgcaggccttctggaaggaatctatcttgagggaagtaggcctggggaattggatgctgctgcatcctctttctgggcacggacccaccctgacccagccactctagtattatacgccctagggagaaaatcatggcaaaaaattaaggttgttgctgcaatccccagggcccaagccatcttgctctgagctgctataagagttttacacagtgcaaagccattttctgatcaaattttataaaaaaccatactcatctgagatgccctgggttagtggtacccgaaactcctggtgttcttgggagagacaggcctgttgtcttggttcattttctgtggttataacagtatacctgagactgggtaatttatcaagaaaacatttatgtagctcacagttcttgaggctgggaagtccaagattgggcagccctgtctgggctgcatcataacatggtagacagcaacacgtggtgagagcacatctatgagtgagcaggtgcaaaagacaaaacacaaagagtgaccgaactttataacaacctgctctcatagtaactaatacagtccctcaaaagtaagaacccactcttgtcagatggcattaatccatccatgactgtaaataccttatgacccaagcacctcccgaagttcccaccacctttaaaccaacacacctacattggtgaccaagactcaacaggagcttctgtgagaagaaaccatattcaaaccatagcacctgttgaacttgagaaattcaggcttacatgttattgtggtctatttttaaagctgagagatcgggataccttctttcatctctttggtatcttcagaagtttgaaaagtatttctaagttaatctaaccttctttttcatactaacctgacactgatgtggccaaagagacctggagaacctgagatctctgctgtgcacatctccccaacactatgcaccttggagctcctcatctctgcaccctccatggagccaactccaatgctgtacacacagcagaggcttaataaatgtgctttgaccaaagattttgttgtatcaacccacagtaacaaaattgacagtagatgtagctgatgtgtttaacttcagaaaacatatatggggaaatctcatataaaaggacaatgtggatttacctgggaaatagttattaactaatgtaaactgctggctacagaaaatgactgctgttaatgtagggctgtatatatatatatatatatacttttgttatatatttatacttctattattttattattttatttcctaaacatatatgtttaggaaaccatatgtatatacaaatggaaagagttggaagcaatgatcccccaggggaatctattgcatacaggtagggagaaggcatcaataagtttaataataataataataataataataataataataaaattagatcaaactgggcaggttagaaagaacttaaggagaaagagtcagtgcttaccctaagaaagaaaagactcataaaaaaagagagactgagaaaagcagaaaaataagaatcagggctatgcgctttgagacagacaggcagacaagacagaggcagagacagatacagagagagagagagagacacgcaggcaccagaaaggagagagtgctcccctccaaggctgcgctgcaccccttcctgggtgctgtggataggggccctagggctcctccttccacaatggcactgtaatgggaaaggcccacaacaagcatgaaaccagtcctcacgagcagagccatgtgggtcaaattactgcaatttgggagaaattctgcaaagacatttgggagggatttgtgcaggaggaacaccaagaattttgtttgtttgtttgtttgtttgtagagagagccttgctctgttgccaggctggagtgcagtgctgcaatcttggcttactgcaatctccgcctcctgggttcaagcgattctcctgtcccagcctcccgagtagctgggactacaggcgcctgctaccacgcccagctattttttgtatttttagtagagacggggtttcaccgtgttggtcaggctgatctcaatcttttgaagtcgtgaactgcccgaagactccatgagtataacaagattaacttgagcctaagaattcctaggcatgggcagctcgctgcttcagccactggctcaggccaaatcagttcttcaaaatcagtcatggctccagtcccctccttggtatatgctgctacttatgaggaaatcctaatcctgagcacagaagttcattctcttgctgcgctaatgatccggccagaaagtgctgacagccggctggctgcctggctggctctcctgcaaatgcacagtcttcttgtcatacagcaggaggagcacaatggataaccagtgtatatatctacatttaactttacgtaactatcctagtatacgtatgggacttgcatacagtcttccgcatatgtacatctttacgtagttggtatgatttctctgtaataaagtccaaattttagtgtgtgtgttaattctcttaacatccacaccctttactcattgactattgcattcatttttagctatgcaacactttgaaaataagggtttttttcccccaccttaatgtaataaaccaaaccactgcaaattttatcttgcttttcattatctggaataatttagctactttttttttctctctctaccctttatatctatatccattagaacacagttcctgaaaatcatggtttttgaaaacccaaaacatatccaattatagtttaaatgtaagagactctctcaatgatcaataaatctgacacccacaaacacttgttttactttagaaatggcgcaaatatgtgagtcccaaattatgaaattatggtgttgattttcactttgtgcttgacctctacctgaaggtacaaagctgaggtctaatttgacattaattaatcttactctcttcccctcactcttaaacttgaaaaacatagtagggaaaaatgcactagccttctaccattcttatgccctatgtgacataaaaacaaaagtgaagttagctacttagtcaaagctggcaaatgcattctcaccatccctagtgtccatacagaaaacgtgcatgccttctggacagaaaacactaaggttgtgttcctctattgaaatttgggggaagtccaaaaagatggacaaaggatgttgtattttaaaaaccagtagttccattaaaaaaaaaaaaaaaacttaactacttagtgacctgagtgacatcaatgtgttcttgtgagggctattttctcatgtttggtggtgaatgtgcagacacaatgtttatcgtagagagaattctccaaatagaaggtgtagaaacctcactacgctgagctcattcaaggacctgggcataaagcaaattacaagagggattgaaccacgtaataagagagaagcctttagtctttatttctactgaagcaggtatgctttagagagacgtgtttcaactgaaatgcacaaaccacaaaatcactaaattcaaaattcaaaagagaaattcatcataagggctgtggaattgacttcttagagtatattttgtggaaaatagaaatctggagcactacattttagatgcaaagcataagtgggtccccgatgttacagttggtcaaccacacgtacagacagggactagagactcttctctccaccttcaaaaatgacaaatattggtaatgagagtcccagaactaatcctttcctgtataaatgtgaatgctcatttaaaatttgaaaaataaagttatgattcattaaaatgaaaaacaagaaatttaggggaaaaagttcttagtccattgatcactcatctcactttgctgaaagatcgttaaatggtttgaaattaatgtctgataaatatgtgagctgattgaagttataaatatcttcaaacagctattcaaagcttattaaaaatcttcactttaatgaggcgaaaacatgaaaattgactctacctaatgcctagcagagtccaatattgcactttacatattggtttacaaacattatttccaggtgtctttaaatagagctccaatcttgcactgttctgatttttcaaaatccttccagatatttggactcaagtaccatcactaagaatagaacccacagtaacatcagcctagccacaagcttccacatgcaccaccagtagctgctgctttgcggtgttgtatgctggatcttttgtacacctctaaatgatggaaggtaccacagcgcaatctatgggaccacttctgttttctatccaaactcgctgctcaagtgatcttctcagtcctatggcttacgtatctaccctttgctttttgctaaatttatgtttccagctttgagctgcagatttgtacagcaaattgtctccctgactcatctgccttgccatctctaaattactatgcccaaattagaatccctgattgttcttcaacaaaacctgcttctgcctagtctcccccatcccaacaaaaacacccccagtcacccaggtgttcaagtaactgtgattcatccttaatttctctatttccatcatattcagcttctaatccatcaacagatactgtaggttttatcatcaagatcactccagaatgagaccacctctcaccaccttcagaatgacacaagcgtcacccacgcaagcacctgctcttacctggaatccattacctgcatccatttcagcctgcctgagccatttctccaacagaggctgggcttttcttttagaaacatgaattagagcccattattcctttgctcagcacctgctgatggctacctatgcatattctttacacacatctgcccctgcccctctcccagatcaccagttcattcccagatccagccactctacatctacatacaccaaactcaatatctgccctcggccttggcacttgccattccctcttcctttccactgttcctctcaacattgcacagctagttccctcaatctatccagcactcgacttagagaagcctttcagaaatagtctgtttttgtacaaacgaccaatacctgtatcctttcgatctgtttgacatttctgtatggactcataactagctcaaattatatagcaaattaatttaattacttgcttactggccatctttcccactataaggtcagctccatgaggctaggaatcctgcctgttgttttcaccattacatctgagtacttagaaccactccgccacagagcctgcactccgtaaactttcctttattgaaggaaacataattgaatgtgcatcccttttcacagcctgggtaccagacaattcttatattctattattgtaaaggtaaactgaagtgcaaataaacataactttgaatagcaaggttgtaggttgaaatcaagtagtcattacatatgtatatatgcatgagcatatcttactgaagcaatttttatattattggcctatatggagccagtgaatactcaaattaactgtaagtgtgtctatctgttggcatgagccaagaagtatgacaacagtgacggttcacagagcaggatgtagctggctgcatttgctgtataccaagccagctccttggctagaagcaagtgggaagaagcacaccctctttgaaataatcctgcaagaggcaagctgggcttgaagtctgggaggatccaggggaagagtgaagaggaaggcactcagctgataaccaacttcctcacttgctccacttatatttagtgattgctctgatcacaatttgaataatgctcaccagagactgttagtcagaacaatgtgtcccctaggactgatctactgacttcaatttcatgttctaatacagaacagcatacataacttgaagataggaatctacacaactgtgaacaatagaggagggtcacagaaatctaataacagcctggagagaatcccattcttgctttgctgtcatgccaatgaattgcattctacaagaaactctgttaattgactgctcctatcttgcaccaggcaaaccaagtcacagtgaagagaaggtatccatggctctttaaagcagtactttataaaaattctatgcatgcccatctgaaaataacttaaaatctctgttgtagctttctgatcttctttctatctcataaaaaatatttcaaagtaacatcgtgggttcagacacctgtctccccaatgtgatgtaaattcattggactgatggttcctgtacgacaaatgctggaggtgctgaaggcattccatagatagcttatcagctttctcagaaattaagaggaaattcgctcctcactggaaacctcagataaatatgcctccctctctctctccttttcctttctccctctccttctctctctcctctaaactcagttagtttccaaagaaaatatttcagagagctgagagatcctccctaatacagaagccaaccctcctgatcaccctccatgtaaactgaaatactaacatttctcaatgtttataaagaaaatttactttctgaaagggaaaaccaaatttattgtcccagtgttataaatagtgtttgtaattacaaattgatttcagagaatgtgaagttcagttatgcctaaatagataagcatactttttaaatgggtaagaagtcattgggaaaaaatttaacagtggtgttccctaactccccaaaatctcttcagatgaggaactgcattttatttatactgagaactgcaacaaagtgataaggtgtgagagggaatcctggaaagacagagcagacagtatcagctgcctgctggatctgtatctaggacagtgaaatatcacaatttgatcatttgggaaaataacagccatacacatagcacggtcctaggaaaatcatacttgtgtggtaatcccattcaataggttaataccgaatatgctgaggttttggtattgtgaaattagagagttacctattcattcccaaatcaggaagcctaatttaaccacctgatccgctgtcccaaatgattaactacatcccagagagagaaaaatatatatgaattaaacaaggcaatctctcccagagaagacagaaggaaaactaaggaaatgcagtgctctgtaatttctctggccccacctcactaataagggcctggctgggttaaggctgctgtgtccacagtatcatagtgtcatcacctgtcacctagagatgggggtctgtcactgtgaccacttccataccccttaacctctcagggaggttaatttcacagcccttggaaagccaatttctaacatagtgtcagaataaggtatcactttcccagaacagggagagaggctttatctcaagattatgcgaaacgaggggtatgtagggtatgagcagccacatagggatttggctagcctgacaatttctgcatctcctgactcctattttctgagcctagctcacggcactgttgctgacctgcagtgcctgttgaaggctatgtgctcagggcctttgcagctcccctcccatgcctggctactgtccccttcttctgcaggggctgccttcctttcctttgcaggggtaaaaggatgatgaccaggagaaaggcgacctttcctcctcactccccaactcctgggggttcatccccatcttcctcactaaatatagctcagtttatcaaatggccagttgaatgtcagggaaaatggacccttttcctcagaagtggtggattaattgcttttcctttcacttttctgaggataggcatataatggagcagccgcttggtatgaaatcattgatttgcctcaaggttgagattaagccagtcacttcaaacattttaatattagcaaaaggctttgtgtgattttttcttctctctgctgtgactttattcaaggtctttagatcacaggggctttgacaagtttgtcagtgatcaggggctgccttaatcaagtaagaaaaaaaatcccgccaagacctcctatgcatttatatgttacaggactgtttaatgccagtatctgcacaaagcgtggtgtgtaaactacaggctttagaggatattaattaatacagattggagaatttctgatgcagctcattaacagagatcaatatttaaaacttatgtttgggtaaaaaaaaaagtcatggtaaataattgagtaaaagaggaaatacacaccagcataaaagtgtgtttatttattttgcacaaatatcaccatgagcactaatgaacaactatatttccttacagtaaaataataccacatggagacttctaaaagaaacccattgatagagtcctatagtcacccttgtgtacaaaaagtcatgtgaatactgcaaaaagaggcacatcttgtcatttcaatattaactctccaagaggtttttaaaacatctccaatatctatatgtaaaggttattcattaatattggctattatttggatgtgaatcctagaaaaaatatagacatttttaaagcaaagcatatgcaagtatttctatatgatacattaaggaatgtattgactgaaaatacaccaagataatgcatatctcgtaattcagattgaaggaacttattctaaggaaatgctatacaaatatgcacatacaagatgttcactgatgcagtgtcacaaatgcaaaaacctggattaaaaactaatagcctcagttatgttaatggaaagtgaaatactgtgaagccattaaaatgactctaatatctgaggagaaaaaacctcctcctcattttatagacaaagatggtcaattaaaaaataattaacgaaaaaattttccacttttggggaagccattttattgaatacactcacttatttaaacattcaagaaatactggacgtgtccgccagatttcatgtggttagaaacttcatccccaagctcatatattaattttaagtggggcatttgggaggtaactaggattagatgaggtcatcgcagaggggacaccctgataggactggtggtttcataggaagagaaggagatacgaatggacatgcatgctcttgtcctctaaccatgtgaggcagcaagaaggccctcaccagatgccggtggcatgctcttggactttccagcttctagaagcatgagcccaataaacttattttattaacagattatccagactgtggtattctattatagcaacagaaaatggactaagacatatactgaagagttgatgacaaaaataaatatgtgattttgacacattctatgaggaaaagaaaaagatgcagctcagaatcatagtattgaacctaacataggatgggggaaaaaagcagagaatgtgttgttaggatactatgggaaagtgagaacaggtacacgacaatttgcaactaagaatgttttggactcagagggagaatgcccctggcatcatgtcaaggctgggccacactgagttggggcagaggtggggagacagaactgaggaaaagtggagccaggccccagtgagctggctttaggattctgaattttgatttatttcagttcagtttatatactaaaaggtttgattcagttggttcattgaaaagatttaccagggaagaaatgacacaagtcatatgttttaatttagttatataacataatatagagttgtccctgaggatctgaggagggttggttccaggatgcccatggatacgacggtctgcagacactcaagtccttgatataaaatgacagagtatttgcatatagcctacacacatcctactgtatactttaaatcatctctagatgacttgtaatacctatgacaaggtaagagctgtgctaatacttttcatatttattttaaaatttgcattatgttttatatttattgttattttttactgcttttccaccaagtattttttatggattggttgaatctgcagatgcagaaccaagaatagagggcagactgtggtgacagacaccgtctgtgttatcacttgaagagctgtcctgtgggagaaatgacagcatgacaaacaggctatgtggacttcagcacatcggcacaatgtgcctccagttttttcatctggaaaaacaactggcagtgggtggtaagtgatattaatgtcccttccagttccaagtgcagtttagtgctttgggaatagtattcagagattctcttatggcagtgacatttttaccagtgttaggtgaataaaatataactttatgaaaaaaatggtataaaaggattagtatgttatttttcttatacaaaggaaactagctgaatgagaggcttaagggatatttgtcttttattatgtgaggtttttttgaaatttaaaatatgaagaaccaaaacttaccactaaatcctactgtccagattgcttttaaaagttctactgtgagaggtaaactgggaatctgagtgtgtttccagttgtgtaataattacattgccttattgttttttagccaggtaatattcttatctggaggcgatgtttaatattgtttgaatatctatgtgacttgcagcactatcataaatgagtcttacgacatgcctccgtcattctgatattgtggacaaatgatgttatagctatctacgaacattacatataaagaatgcatattgtcaagattgaattttacctgaggtctgagcccctggaaaacaatgaaaattaaagaaatactcctcatggccgggcgcagtggctgaagcctctaatcccagcactttgggaggccaaggcaggtggatcatgaggtcaggagttcgagactagcctggccaacatggcgaaaccctgtctctactaaaaaaatacaaaaactagcgcggtggctggtgcctgtaatcccagctactcggaaggctgaggcaggagaactgcttgaagccgggaggtggaggttgcagggagccgagattgcaccattgcactctagcctgggtgacagagcaagactctgtctcaaagaaagaaagaaagaaagagagagagagggagggaggaaaggagggaggaaagaaagaaaaagacggaaagaaagagagagaaagaaagaaagaaggaaaggaaggaaggaaggaaggaaggaaggaaggaaggaaggaaggaaggaagaaaggaagaaagaaagaaagaaagaaagaaagaaagaaagaaagaaagaaagaaagaaagaaagaaagaaactcctcacccttcagtgtgatcaaaaacagcttactgccaggtccccctttccccatatgaattagatgtgtcacctaacactggtaaaaatgtaactgctataagtgaatctctgaataatattctcaaagcactaaactgcacttggaactggaagggacattaatatcacttgtacccgttgactacataggacaaggccagacttccaattcctatcctttgcctcaacaatgattagctggattgcttgtccctactgatgaatcagaaatgcttattggttaaatttggtgaaggttctctctatcctcagaaccctgacctcaaccccagccagcagagagcctctcctgagaagaagctggccctagggtaaaaccctctctcatttactatcccatatgtctttcttccaccccactcctccacaccagttcttactagcttgtttattcccctgtataaaagaaagcccaagcttggtgtggtggctcacgcctgtatcctagcactttgggaggccgagatgggccgatcactggaggtcaggagtttgaaaccagcctggccaacatggtgaaactccatctctactaaaaatacaaaaaaaaaaaaaattaactgggcatgatggcacatgactgtaatcccagctactcaggaggctaaggcaggagcatcgcttgaacctgggacgcagaggttgcagtgagccgagattgcaccattgcactccgcctgggtgacaagagagaaactccatttcgaaaaaagaaagaaagagagagagagggacagagagagagagaaagaaaggagaggaaggaaggaaagagagagaaagaatgggagagagagagagagaaggagggaaggaaggaaggaaggagagagaaagaagaaagaaaagaaaagaaaagaaaagccccttttgcctaacccttgagatgcctgcagatcttatggtcagagcattcttctattgcacccatcctcctcccactattcgaatagcccatccctaagcccctgcaataatcctttctaataacgtctactcttactaaattgagatttattttttatttgacagggtttttaatgagaaatgctttttacgaggttagaatagttctggtggttgttccttagtctctcatcacatctcctttatgacttggaaagataaatttagcatggaaaaaaatgtgattattagaaaacaaaaagaattttaaatcatgaaagaaatttatgcaaacaatagggcaagacctagtacataaaaagagtcagtgaagcgaataaaaacaacaacaaaacagcaccaccaccaccacttaaccacaaagtgaaacaatttacataatgatttcttgcttttcttcttcatattattgaaagtttctttgttcatgttatctccagtggtctgttaaatgtttgcaatgcctcagtgctcctctgaacaactttgttaggaatgagaagtgctctacctatcaacaacaaaggcagccgaatggctagaaataagtttgttgaaaatacttcttgggttctgccttacctgtcaatcacaaaaagaaggtggagaaaggaggcatgcttatggcatcccagttttaaggaagaacattttagcaataagcaagcagtcaccaaaaggattcaaaaaggcagtgggtttagggtgctttgtttcactgtgaacatgaactgtcataaatgcatatctgatattttaatatcagatatttggttaaaaaaaaaaaagtgaggtaggagggtgcatttcattatctctcccagatacgtactggccatctggtgggaaagaaaacaggcagtctcagtccagggaccagaggatctcctttgtccctgtacatacacgcaagaacgcacatattacattatccaggtagagagcacgtggtaggttacaaagaagccatgaggaagaaataggaaacctgaattgtagttgcactcctctcaatatcctcatcagcaaaatgaatgagttgttaataattacaattgtaccaactgtcatactttgccatatggcttgtatatgtgtttggtattttaaatctataacatacagtcatgtgccccatctgcatcaatcatggcatgtgtatatggtggtattttgtattttaccctactttttaatgtttagatacaaaaatactctccattgtgttacagttgcctgcagtattcagtacagaaacatgctgcatgggtttgttgtctaggggcaataggctacaccgtacagcccaggtgtgcagtaggctataccatctagatttgtgtaagtatactctatgttgtttgcacaacaagaagattgtctaaccatgtgtttttcagaagtatgttgtcattaagtgacacgtgactatacataaatatgttaatagcttgtaatgaagacataagctctaattctgatcaagcctagacaaagcaacttacatacataattcttaaaataaaaacccaaggaagacgttagtattccttgtttctggaaaaggagccaagaccctgggagttaagtggccttctatgaggccagatgactgggccaggacccactacctggctgaccccaaagttcacccttttattcattctgctgcattggttgtgacctagaatattctgttgtttttctggtttagagaaacagaaagaagactcagagtagactctgaaatgtccactccccacacattgcccagagccactggaggtacaatgtgccaggcacagctgtgtgggcagcaaggcacgtggagcaggaagcaaaggatgatgccgaggcacgggccacgtgtgcagtgcccgaagggggtctcctctggtcgtggctgtgcaccagtgacagaagggtttacttactatgatactggagaccaccatgatcactgacatttccttaatgatgcacaaaatgaagcgcacaagtatccaacaaatgaccagagaaaacgctagcatacttctctgaatgtacacttcagagaaggagggaaatgcttaaatgtaatattttagataaatcactgaatacaattagtatagtaagtacactatggatttgatggtatgtagtaatacgtctctatggcaagctcatctcctggaaaactggaactacatttgtccacaagcctttctcactgagcaggaacacagcttgcaggttggccgactcatctccccagattttattttctattttatctatatttttcctggctctaatttgtttctgttttgttacattttatagattcctacaaacctctttaactattttgtaatgcaagatatttgagcataaatccctaaaagacatattattttatgatgtaaaggtttcattttttccattttatagatgattaaatagaggcccggcatggttaagcggcaagcccagagtcagccatccaacgcagcgcagagctgtgatacaacccacttccactcccacggcatctcggcttcgtgggagttgaggagcgtctcaactgcatgtcaggagaacccatgaaaaggaaagaacccagaacaaatgggtgagaaagttcaagactatgttcagcgtaagagcaaaagcctcctgagaattctgcttgcagcccattcccaggcattacagtgcaaagctaattagggagaatggcatgagtagaagaccaccaagaccaccagctgaaacgggtgttctcatggcctccagtgggctcgactatttttatatttttaatattttggtccaatcactactctatacaacttagctgtcttaaaacaataaagccaaaacaaaaataaaacaataacccaggcctcccagatgttggcttcagtctgtgttcacaagttatcttcctaatataacagcatgagtactacttccccatactgttctcatgagatctatggccaggtccaaggtcacatcatagtaaatctttatgaaggttaagaaatttataacatttgcatttgttcacgaatgtcaataatcccaaccggcaggttttacgctcaggtttgaatgacactttgctaaccaagccattaaggtttgtttcaaggagtcgggggaagctccccagcagctctgagcaaatgaggagccagagaaaaacaattaaaaattttttaaaataagatctttgaaagtatattattaattctatcatccaataagtgttttcgaagactatgcaaatgacatcttgcggtataaaagctgttacagaacagaccttccaacatttctcagtctccttctttccttcccacgcatgccctatgtgtggactggcagcaatgtttttacttttaagaggaatttcatcatttgggaaaaatttagagatattaacgaaaaattgctatgtgtctcatggctacctactgattagaagcaattaacttatttctattttgaaaaattaggctagcaaatgaagcctgtgggagaagcatatttaataaatatagaaatattaattgtaggaagtaacaataacaccatgcaaagttgtcctgtacattgaaaaatcatactgattgtttacctccttattcacagcaagggaatcaagaccatagaagtcaacctgtagctgtataattgcgtccaaatcccagtgaagagtaaatgctaaagcattagggtgaacccattaaaactgagaaaagagagggaaataaatcaatacttaagagtagagttacctaccaaagtaccattcagttcaacacatttggaggcctctttttcatatatgatgagttttcactcatatacactgataaaaaggtgaagcataaaacatctagaatgatgttttgaagaaggtgaaagaatcactgtggtgaagactatagaactgccctgcctccatctctcctaggcactttagccattttactctaaagcagatttggagttgactttttaaatttcctttcaatgttagaaatttaaattagaaaatgtatgttaaagttgattaaaacttaacaagttattctgacccattttcctcttctactgcaattctgtctaatgtcttttatgatgcctttacaattactgttatcatcatcattattattttagtctatcatgtaggaaaatataactggattttgatttccttaagaggttttctacattatttagatttgtgaaagaatgttattgtaagtaaatagcaccaaatcttaaggatacaatatataactgctaacgcaaacagtatttgagaaatgcatctagatattcattactttattaaaaaagacatagaattggcataataaattgctagataaagcaattgagtaaagtgtaatgagttcaagtagagataagatcattttatggagataaatgaattagagaggttgtgattgagaagtgagaagtggttaaagtgttttaagacaaattataatatctaggtcttatccctacttatattgataggcatgatttggtgggaaaaaaagaaacattgtcactttaagtatttccctatcctaaatgaaagctactttattcaagagtataagctaccctaagtttctttattttaaactttgaatgcttcatcacacaaatgtttatattttaatagaaatgtattatgtctgatgatatccaacatatatatacaggctattgaattctatatgtagtaataatcatgaaactcagtgttttctcaattatatcagcaaattctctaacacagatatgccaggttttcttcaactttgatgaagtcactttagttctagtaaagtagaattccttctagaaggaatttaaaagaagctgaatttcctggcttccccccacccccaacaagcacctatataatttatcagtccatatttcaaactactttatttattcaattacaacacattccatggataattctaaaataaactcccacatttaaaattaaggagccacaaaagacacttttaaaataagaaattgcataaagagagaagaaaaaataaaatttttcacaacctacaaattaccaccaagttttacattgagtttgacattcctggtattcagagcaaaatatggacacaaagactcatgcacacactgggtgacctcatttcactgttgtatgtgtgattcctcattctaagtatagaatccaggaggtgcgggtccctttgtccccaccaggaaaatgcagttttccacagtgttaaggttggttacctttttccaatggcagaaaatgcaggccagaaactgagaaagttgctcagttcatacagaaagcagactgcctaacatgaacctcttagtagtcagagcgacatatgctattgaagtaatgtgttcctttattttctaaatggatccttcccaagtaaaatgtacctaagtacataaaccatttagtgggaatacatacacaaagagttgcctcctagatgtaaatgcctcttgaacaacaatcaactattaactcatgcaaaaatattttgataacattttcacaattatctgctaaattaaaggaaactactcacagcaacaaatgccatcaacatctggcagtgaaacaactttgaggtacatctggacaaaaatgactcatgtctaccctcacctgttgcaggctttacacctacagagaggcagctcctctttgccccaacatatttagtttctggactgcattttcgccttctgttgcaaaatggcaatcaaccttattaccgtagaaaactgcatcttcatggtaaggacaaaggggtctgtacattctggaattatattcaacacttacatttacatgaaagagccttgaaaacaatagaataattagacatgtttgtgagataattatgtcatgtaatgatgcctattacccaaagagctgttggttccttaaaaaaaaaaaaacatttatcagccaatcttgcagacttgtaggatctgaagaacagcactgttctcatcagagctaaaagcatatgctatgaatggggtcctccacatggcaatgaccgcaataaattaccagtgtgtgttctgttttcttgagatgggctcaatttatcattttattgaaaaggttccattatgctaatgtcttacaaaatcacattctgctgttgctggaaggtcatgaggggatataaatttttgcatttagaactaagaagttgtatagcagtcacagactccaagggttaataagaagccatcaaattacattcaaggacttatcaatgacagctcttcagcatgctctcctagttaacaaaagagaaaaaggggaatattgttccaagcttaacatcacacacacaaaaatgcttcaagtataaacgtattaaaacttggttttaacacaggttgatcatttgaaaaaaaagtcattgaaattttatctgtcagtgtgaagtatcagtataacaggtacatttaatacgagtttaatagaggtttctagtacatagtactcagtttgtttaaattagctactatcttcaaagactttcaaagataagtttgctgaagatctacaaagaatgcaaaaattaatatgcatattttagtgtaacctcattgtgtctataaggaggataatggagatttttgactagcatcaaatcccacatctcagtgagttcttagggaaaagaaagatgatgagctaattattcaatgcaaattagatattattccttagagaaatgttttgtttccatcttttcaagaattactgtttccttccaatcatgaaggactgtggatgtaattcacgaatatatggtgccatcaatctatcaataatttgcagttatgggcaacaactgtcaaacagctgagtaaaaacacataaaaccagatagctccctttggaccaattattgtaaaccatagaaacactgaggaaaaacagttgctctttagaaacacttggtatatacttggcatccaattttgtaatgcaacctaacaagcagaatgtaaacaacagtaactgcattgctagatttgtcattctgttttgtctggttcagcagctaagtggttacgaatattaacattctacaacatcagtgtaccttaaattcaagaggccattttgaatggatcactgattgcattttgatggaattcccagggaggtgatgagtaagaagccaggttgtggtctagggctgggcacattcaatcttattctgtattaaagtacagagatggagatacacaatatgctctttcctcacctggaactaatttgacagggaaaaaaaaagctttagaaatgggtctaagatagtttggaaacccaagttcacaaaattgtgtttaaaaatatataaaaggattatagaacttcttgacaaattcaaattattatataaagtttctcattgagtagctccaaacactgtcaaaattattttttctgtcagttatgtatgtcctgtcaacaggtatatgcattcacgccaaatgaacaggccatggaaagtagacatctctttatttgggaaaccattactcaaagattttaccaaaaaaataaaaaaagatttttggaagagcttggggtgaagtggttgtttttgcatcagggtatatggaattaatgttgattcttccaaatcatgatgactctaatgaatctaatcaagtacacataaacactttgatctaattcaaagaatatggaattttgaatcaaaagacagtggttccaatcttagcctcaatatcttttagctatgacagtttggccaacaatttcatctttactctcagttctccataaaagaaggaatgataattatggccctaagagataatgtaagtgtaaatgtttcacaaactgttagaagaaagggaaatacttattattctcttgagcgtaaaatattgtatctctctggtgatgtaatggttgcagggagcaaagtatatttaccaaaacattttacatattaaataggactattttagtttcattctcttaataatcaaaaaaaatttgaaacttagaattaaaccaaagagattactggtactctttcaatgcgatgtaggtttattatatgggctattttacaactcggtaggagcagtggttcacttttttccagtggaaatacaaagaatttctgtccagtggagcagacaacctcaaatattatggtttattgccctgtaaacacttgacaagatttgtatctagtctagcaatcttatgctaacatctctttattaaattgcatatttacctatctataatcaagacactaatttttccaaagccttttgaaccaatttatacagcttgctgcttctcacattaagtaataggttgaagaaaatttttgacacttgtacattttatatctaatataatatctaatataatataatataaaatagcaaaacagctattttaccttactggaaattataatttaatggttttagaggtcacgctcaaatggaccaaataaccttcatttccaggaagtttgcctcatggactaatatactaaggaatagttcctgaagtcagacagatcttgaaatctgcaaccggggttctccactttttcccctttttcttttctgaatttgtgtgtttggttttgcttggagcacagactcacaataatctatttccctttggtggtcacagtgattgggaattgccttgatagtctgactggcaatctctggacctggatgacacagctttattctttgttgaataagagacaacagagactatgtgtaagtcacttgtgtttacttatctcttggtgacctcagatcaattaaaaatcatatgcccactggggaggaaaacagctctttgaggtctggactaatacatttttgtgattctctatcttcttttgacgcatgactgaagttgtaggactgaagctataaattctctacatggctttgcgtctacatatctgtaattcacaaaagctgttgcctccgttgtgtgaaatgtttccctgcttgttgcaggctgaattacgtcaaaattcctatgttgaagctctaacccccagcacctcctaatccaactgtatttgattaattataatgaggtctttcgggtgagccctcatgcaatctgactactgtccttataggaagaggaaatttacacaccagacaagagggtatgtagaggaaaccccgtgagaggaaacggagaagacggccatctgtacaccaaagagacatgcctagaaagaaagcaaacctacaacaccttgatcttggacatttggcctccagaaccacaaaaaatagattttggttgttgaagaaaaataaataatgacatatacaaatggaataccggcaaaattcacagaaaataaagcaaactctgagtacttcaagtgttctagatttttagggaaaaatctcctcttatagaaactgcttgctcagaaatccaatcacatacatatggtgaatctttggacaatggaacagttttaataatttgggtttaagaaaggaaaaacttttctctcatttttcagtgttaaatatgtgataaggtttctattttacattttaacaggttggggtttggtttcccaggaaaagcgtacttaatccgaacttctcgtacttctcaaactatttttcaatcacaaaatcttgcattacagtgacataattttaaagttttttgaaaaatatacatttttagctgactaaatagaataataattctggcaagtttttctgtagtaggttcttatatctttatatataacttgcaaacatggattgatcttcagacagctaggtaatttgtattaaggctgaaaacaaaagcaatgataaacagacataatatttagtttacatatttttggccctttagttatacatactatagaatggctatatttttgagtcacattaattgttttagttttgctactttaggagcctgtagctctaaaaattgtactatatatatttatagctttgttagtctgctaaaatgtttgtgtttgacacacagctctcctattatgactttccagtttctttgtgaaatcaaagatcttattttgaatacaagttataatcggatttggtggctgagacttaaatagaagaaacagtaacagaaaaatacaacgatttatccaaagtaatgggatgagctttctttttcaagaatgaaaagaatagggtattttttccctaaagcaaagtgttgttttgtaccagtatatgaaatgacaccgtgaaagataaaacttgagagaacacagcaagttgtggaaaatttgagggaagtgaattttaactgcttttgtttataacacctatgtctgaaaagaagctataaaatatattaaaattcacctaattttgattggcttatttgtgagataaattaagggggaaaatgatctcataaaacctatatttccaatgcattaatgcaaaattaaaagtagtctttttcttagttgaattaataaattcatcttagaattcttaccaaggcatagtaaaaatactatttttcccttttgtgtgatatgaccagaaagcagagattttataacccaccagaataatctctgctttgtgttgattctagcatagtgttagaaaataaaaatctacaattatgaaaggcaaagtttcctcacttgtgaatgaaccaagattccctgcaatcatattacatttaccaacaattatttttgaacacttgttaatttgattaaatcgataattaaaggcacctaggattttattatagccaaacgaccaagtctactctgacaactactttaatttccccccagccccatgatcagatctaaaatttaaaaatatagaccataaaaattcaacaatatactttatacttaaaactggctttaaaatctcccacaggctccctggagagaggagctggaaagccttaggtttgtttcaagggttttgtatttcttaatcacctccccactacagaagagctatggaatgagctgtcaaatcagaaggacgctcagccttccctgggttcagtttgtgtacatgaaatgttatgcacagaaatctgttactaatcgaacattttatgggaagaccaaggagagtcatcagagcccatgctgtccattatatatatgttcttactctccggagaaacattgatcaaactcttataaaatagtcatacactgtgtcacaaagggttattttacactcgtcattctgatattgctggtcactgtagtaattaatccagccttttattagtatcaaactggtttctgtctccatctgatgcttgcctgagaactgtgctataaaccacaggcctggggttgtatcttcagcgtatactcctgtttccagacttctcagaaaggagtgtgccagatactctgaactactgatacttcaaagaatagactcttgggtactggcgttagagctgacatcagctcaacaactttcagactgtaccagggaatgaatcagaatttccaggacttattttagtctggaaatagatgttcttcatgaaactagcacctaacccaagatccaaaaaataacaattaattacacaagaacaaatgaactgatgagttaaattatggctacttattttgaatgtttttagtattgcatttaatgttaatttttatggatatatgaagttctctttcttcttcatcagtatcactttggatataatagactattgcttttgtatataattttttttttttttaagacagagtcttgctctgtcaccaggctggagtgcagtggcatgatctcggctcactgccacctccaccttccaggttcagtggattctcctgcctcagcctcccgagtacctgggactacaggtgcaccaccaccacacccagctaatttttgtatttttagtagagacgaggtttcaccatgttggccaggatggtctcgatctcttgacctcgtgatcagcccgccttggcctcccaaagggctgggattacaggcgtgagccaccagctgcttttgcatataaaatttaaaaaactgtaagtagtatctgatttttagcatccttcgaaaggcagaaagaaatacttttactgattctccttactttttcatgagaacatagttattaacataggttcaattaggatttgttctcatcttaccaggatacaattgaacaaattgattatgcaacaaaggatacacatggagaattatatatgagaataaatctcacttcatcaaacacagcggcacgctagtccggaaaactgacgagacacgtagctagtgcctacgaagcccagtggacaaatcaggtttactacctggctattagagtcctgttcctgagaacttcaagaagaaaggaattcatcccaatttatatatacagtgcaggcaaaatatggtggagagaatgtcttggaattgtttcccgagctttgagaaagaaaagcaaataataaaggcttttaaaagtcaaatctaagattccttaaaaaaaaatctcaggcagaattaattatctgggtcaaattatatggctatagatttgtaaagcaaactcaagcaggcctatctggttaattaacagtctcattggaactatgtaaaaaataaggccatgtttcatctggatgaaaatagcatttttctgtgattaaaacaaaacaaaacaaaacaaaacgaaacctttgtgggctaggtgcagtgtttaacgcctgtaatccagcactttgggaggccgaggcagagggatcaccttgaagtcaggagtttcagaccatcctggccaacaggtcgaaatcctgtctctactaaaaatacaaaagttagccgggcatggttgcaggcgcctgtactcccagctactccggaggctgaggcaggagaatcgcttgagcccaggacgcagaggttgcagtgagccgagatcacaccacaggactccagcctgggttacaacagagcaagactccgtctcaaaaacaaacaaatgaaaaccgttttgattatttataagggggggggcagggaatggagtgtaaaaaaatagccacaacttagaaatgggccaaatagacaactagatgtccttttggtgcagcgttgagcttgttttcctattggcagggagctgtaccactttgtagaggctgagataccttgtacatttttgtttggtaaagatttccatccagtgtaacagataaccccaaagtcaatggtttaatatcctcccatttatttatctctctcacacacacacacatgctagaaagaacttttcctttgatcctttgatgagtacacagaagtacagagagttgtataatgagtaaccatcccccagattcaattataaataatgtgtaactagctggttgtcccacttccactgatcctaagattgatcacatggcatcagccagattcccttcacttatatcaacccattcactttcatctaattgtttcatctatttatatctgttggcagaataaagtaggacttgcaaaatggtgaatatctaatttcgcaatgcatctccaattattgtctgaaacttctctgtaaagaaaaattttcctcaactactagggctatttggttaccttgaaatagaattcttacaggaaaagctagataaacccttattttatttttttaattatcaatttcctgagtttgattttagggctctagttatttccaggagtttctaatgtatttgggttttttagcaaaattatgacttgttaagtcttcaataacttttttgtcttagattacacttgttttcatcttggattatcccatcttgggacactgaatcttcattagcccctgtgtccttcaagtatgtcccttctgatttcataatctccactagctttcaaataagatagccacacaagatacacaaggttcatcttgcatatgatttgtcccaggcctaaaatcttctattcttcaatgattccttgtcttttttagttaaaaacagtattaagagaccacaatctgagtggccacaaacgtactcctagttaataggtttagatgaatgatccagacactctacctgaaaagaggggagagtgggaggatcaggagacaggaaaacactagtacatgaagtgttaaaactggctgctcatcagaatcacctgtgaaaccttcaacatagagattctcaggcctcaaccattatggaatatgatgatcaaaggggagcccaggttatgtaaaaggccctaaggaaatgaagtcactccggggcccactaggcgggagtgctgagttacagtctccaagcagccacatttccagaccttgggatccagtatattagatatgcttagcagttgaagaatttctttcttatcttaaatagtaatacatattcattctagaaagttcatataaaccaaatattcgaaataaaaataagtcacaatcccatcacaagaagaaactgctattaaatcttgcatctgcattttaatattcttctttatgtatgcacatgcataaacggggatatatatggttagttattttttatagagtaagatcacaaactactcagtaatttggaattgaattttgtcatgtggtgtctttccatgccattaaataatattctcaacatcatcttcaatggatccatagtgtttcattttatagaactgccaaacattcagaacctatggttgtacctcttgatagttttccattttttactaatataaacagtgttgaacatccttctagataatctactgtgtatatctgtaatataattttatcataaactctgagagtataaatgactaagtcaaaaggtcgaaattgcattttctcttgtgagaattctaaaataattccctatcagtttaaagtaagaaaagtctagggcacatgaaaagaactagaaatgaagaagcaagtgtgcataaagagggaaggaaacatgctgactcttatcttttagagctgtcacacattgaattttaatgtttggggaaataaccaatgtagctgttaggaagctgtgattcaaacatggtagcactaaacgatacatcactgtattgggggcaggtgcaacataaacctcccatggatatttgtcaggtgaagaattcaggaataaggtttgcctatctgtatatagaattttgaagtcagggtaccttctagtgttgactgcaatggttaagtcatctgtctgtctctgacaaaagagctagaccctgcttcaggaatgcaaacttctcccactgctatggtctgactgtttctgtccccaaataattcagatgttgaaacctaatcaccaatgtgatggcattcagacataagaaatttggaggtgattaggtcatgagtatggagccaccgtgaatgggatacgtgctcttacagaagatgccctggagagctgctgtgctccctccaccatgagagggcacggctggaaggcaccatctatgaaccagcaagcagccttcggctgacatcagctttaaaggtgccttgttctttcacttcccagcatctagaactggaagaaataaatatctgttgcttataagccactgactcattttgtattttgtcatagcagcccaaaggggctaagacacccacaattgggaatcttggatgagaatgaactatatttcccattttcaaaaagcttatcaatgagtgaataaacaaatgttgttttcattcatttaacacatattattaagttagtaagcatcaacaatgtgcccagcactgtgttaggtactgcaacagcccagagtgagaggaaatgcccctgcttcctggagcctgccttccagcgggcagcctaccacctgcgtgtgctattctggtggccaggacgctgttgtctacagtaacctggtaaattaactatgttaagagagtactttttctttcttcacagaaacaagaaaaattatttgccgtggagtccaagagaggagcatatctatcgaaatggtaattgaaagagaaactggaaacatcacctgtatgaaaaatagtggatggctctgttaacgaaacaggcatgctggtgacaacaggcaacaaatctaatctaatctaatctaatctaatctaatctaatctgtttctccataataagcagcaatcatacaacccactaaatgactgctgttgcttgtcactgaagatgtccatattttactgggacataacatttcttcttggcatgaagagaatggattaagcaaatgaataaaagctatggttctactttaccagcacaaatggacaaatccaaaataaataactgttacagcaactatgctaaccgtattaattaaaatatgcaaggtatactcattctcattttcataaaaggaaatcctaaacgctcaatttgaagtatgtttcctcactatttgtaggaacttctagtcctagaattcttggtccacctttccccaagattgtattcatttgttaaatatgagacaccaccaaaattgtaatgatgccacaatgggagagttaatgaagtaaaaaaatattaaatgagtcaactattattaaaaaagaggcaacttcatatccatcaattagaaatcaaagagtctggctggctatttatcatcaaaaatcttttattggtataaaaaagtccacacaataagcagctttttaaaataaccactcaggccagagtatcactcaccaagctgtgactttatgttctttgtaacaataaagaaattacatggcaaacaacaatctgtgaaaactttcaaatcatactttcctaagctatcgctctagattaaaatgtttgccttagttttcagggggttagagaagagtgtcttatctccaaacagaacaacttcatgaagatgcatacacactttcttcttgcagctaaggaaggaccgtctttgactaggtaaagatccatgtatttgaatcatgaaaatatccaaaaagacgggctgggcatggcggctcacatctgtaatcccaaatactgggaggctgaggtgggcagatcatgaggtcaggagtttgccaccagtctggctaacatggtaaaaccctgtctctattaaaaatacaaaaattagctgggcatggtggtgggtgcctgtaatcccagcttctctggaggctgagggaggagaattgctttaatctgagaagtgggggttgcattgagctgagatggcacctttgactccagcctgggtgatagggtgggactccatctcaaaaaaaaaaaaaaaggaaatatccaaaaagacacattagcaggactcagttcccagtgtgttgtttgaggcactgaccctgatctgaaaacagtgctcagttgattcaatctgaatctgtgtccaccgtcttcctgctcacttagaataagagctgtgtttgcattgcacaatgaacacccacttgctgaaagctaacttgttcctaactgcccccatccttcatccactgccagagccagctttgttaagccccctgtgacctatatctgtgacctatccctagctaatcttctctttcaaaatatgaagtggggtacacactcatcgccaaagggtcctttgagcaagtcccagtagaaaatttatccactttttggatgaagtactcaaaaaagagtactacatttcccaacataaaatggaaaacaaatacatatgccatacatcattcagggctggaaaacaacgaaaatgtaacactccagaaaaacagccatgggaagtattattcctcatgccatccatcattatcatagagcacccactattctaatttagctccaaatgtgtggtggaggtgatcaaactttaaaattaagtaaacaaagagattcatacaaaaataaaataaaataaaataaaataaaataaaataaaataaaataaaataaaaaccctgaccccaaaactagagtaacctgacgtctcccaagtatgggttggggacctagcacctgttctgggggcaattcaggcaggtagccctggatctgtaaacctaggtagtattttagagcctgagcacaatattgggcctttgtacatgtgaactagaaagcaaagggataactgaaatggataacagatagtcagcacttggtatattccaggcctttctctaggcccttgtcacgaagtatctgacatcaacttcatgagttaggtactttttccttatctctgtatgagaaatggggaaactgtggcctggtatgtttaaaaacaaaacaaaacagtgcactattcacttgaggatcttattaaaatgaaggttactgattcagtaggtctgatagggggccaatgattctgcatttctgataaactcccaattgctgctgctggcccacagatcacactttggactgcaagaaagtaaattctccgagtcctagaggtagcaagaagtagagccaagacgggctaagttgcttggctccggggcccacacttactgccagtcggcttagcatttgcatggcagacacatcacagcccaggtaccatgaatgcgctcaaggattcaaaatcaatgtctgtcaccctttttgactgcattttctagcaacaaaaattctgtattcagtgcgtagtatataccaggaactgtggtaaacactggttcaaacgattttcatttaatccactgaagtaaattatcggccatttgattcccttcttacaggaagcaaatcacaaccccactgatgcactgggactctagtgagtttaattatcatgcacagaaaagattgagcattaatttgcaaagaattagaatctaataacacacctctaacaccaaaggtagtcaacctttggggattgaggaagaattgtaagatcttacagagcatcagaggtatcatttggaaaattaattatagtcaaatagatgaagaaggtgtaggagtttgggcctgattctgtgaaattatcaaaaagtactctaaaaaagaatgtagtgatattttccttgtcataagggtttcattttctattatataatagatattttattaattctgtttttcttacataagtagaccataaattcttgatttatgtatgaaatgtttggaagctacaggtcatacaaaataacaccttctataaaatttcacaaaatttccattagtccttatttactcagaacaaatttagaaagattgaaaagagtgtattacagacagttaaattctaccacttaatttgaaattttttctttatcttccctttaagaaagtggaatccagcagcctgcctgcatttttggcagactctgcaataattacgatgctcagatgattcccaagatggacctccccagctgtaaataccctgcctccacgctcattcctgtcaagtgcagatctccccatcttggcatatgggcagtgtcctctgaaacacttcagggtttgaagagtaaaagatgtaaatgatttgcttcactggccatgtaggcctccaggagagggacacccagacactaccatttgtagaggcctgtcgttagaagagcacactgtccagccaggcctcatggagtcttgaatgcaatgtctcccttccccttgaaatcacaatatgaccttgcagaggtgacttcagaaaaatcaaaacattttgaggctccctacaagtactttacttaacttcaacaaccaatgctgtcatttctcacctactctcccccacagttactttttatttctttatgtttcaaaacagataaccaaccacaaaaagcaaaacaattcccacagaggcatgaacccaaacaggcacgaacaaaagcacaaggtagacggggccagcctcagcctgtgctgccccggcatggtattcctctccgcagctttttgtcaattgcatgctgacactccttcccgctctatttcatgacatgtctcctctccttttggaagcatataagcaaaaacatggggctgggtgtggtggctcacacctgtaatcccagcacttcaagaggccggggtcagtggattacctgaggtcagtagttccagaccagactggccagcgtggccacagtttttcttttttttttctcaaaagcaaaaaattctgaaaaagtagtataccttgtgatatagttttaaaatctgactacttggctgaaatcaattaacatgactcttcaaaaaggtccattttaagactatatctactttctaaccaaaacatctagaggaaatgcaaaatttcctttcacctgatagctatattcaggaaaacacaggctactggatattttacataagctctgaagtgagacggtccctgggtacggcttgaattgtctgggtcggttcctcaagtggtctctgcagtttcctcatctataaagaggatatgaacatggtctaccttacaaggctgcaaggaattaaaagaggtatttcagggaaacagggtttctatagtgccaggtttgcggcaagcactcaccgacaccgcctgcaggtatggcccgttcgcgatgttctgggcagtgcagcagttctaggatttgaaaaccttccgggttgtgttgcctccaccctttcctcctgcagttccttcacaagcagccagcatgaggcttcctgaagtcagatcatgtcactccattgttcaaaagtcaaattttctcaacagggtcaaatcctgggcccagcagaccctacctgacctctccaccctgccctttttctgacatcctcttctccgagctccacctgctccaagctccaccccatactggctgctgcgttttctgggcgggggcctgcctggggctcacgagttgctgtcgcctctgccatttggcacacaaatggatgctccctgagggtgccctcctcacagtttagctcatcacacaggcctcgcggctgctgtatattacggaactccccaccaatactctttgtccccttgactctgctgtttctcgatagaacacacacttactagctgctccaaatagaatagctccgttgaggtaggcatcttgtctgtttctattttctgctacatcccagtacctggcactgtgcttggcacagagtaaggactcaatcgttatttgtttatgtagttcgttaactgtatgacggatattggaggagcctcctatttttttgctaggtccaatagcttcatctcatctgtcaggagatgatgaatggcgcctcatttaggaaacaccaataacacatgaaggtaatttacacacaggcaccctggagcccaggtgcagctcaacgttcttattgaaaatgtagtaaaaatagattttattcactgaccatattttaaggaatactattttttactatttcgggcagtactactcaaagcacagcccctgggcccgcggtgttagcatcacctgggagcttgctggaaacgcaacttctcagcttccatccaaggccaactggtctgggcccagtcatctgtgcttttataggtcctcaggtgattctgatgagcactaaagcttgagtggcactgctgtaaaaactacttcaatgactcgttccagttctttgacgtcctcttacaagtctttagtgtgacatgcttgcgttcttagtaccaacagtgtaactggttcttcatgtacatcatgttatcacctctcatgttgaccacttatcttttgccaactaaaaatacttgaaaggcaccttctcgggtttcagaagtttccatttgtttcgacaacatatgaggctacagcccagctattcacccattagagccctcccacgtccagccagcacttatattcttcgaagttaaaattgaagactctggaagcacagaaaattgggatttcttttaatctctttttctgaggcacaggttttcaaacattgtataaccaaggatttttttcatcttttcaaatgatagatgttttatgtgtttaatatgtgaagtacgtaaagaggaatggtctcaggctgctgtgattggcttggtgtgttcacctctcaccgacctgcctctgttctcccacccagcgtccgattgttccgtgagaacaacaggtaggatccataattgtaaggctggaaaaccttagccatagggcagagtttctcagagtatggtcagtaccaacattttggggcctctacccccagacaaatacatcaaaatttctggtcacagaaaaagaatgaaagaagattttttttctcgccattctggccatcaaagaaacatggaaaaacatgcaagataattctgcacatgagagtctgtgaatctctgctctagtaactttacgctatcatttttagtgaagaaaaataatcatataggcatactgtttgcatatagtcatttcaaatcattccattcagtcttaactcaaaccaagaatgaaccaagacatttgaagagatgaaatctcaatttctctgtataattttaaataaagcattcgctctaaaagctaaatgcacaggagttctgttgaatgactgactatgtttacaatttgaagcaatttagtaaacatgtatcaccactcttctaagagattttggggaaaactacagttaattggacaaaaactccatcctcaaagagattaaaaggtgaagtcagaactggagtacaaaatagcaagtaataagggagagtcctaagagttctgaaaaggattccctccagttctaatgagcaggagaggattacttgtagtttagctgttagtttaacacagagttaaatctgaaagttgacctgggatgcaccatctctcttttcccaatctttacagatgcaacatatctttacagaggccttttagtagcagcatgtagggtgccaggaagttgcccccagtgtgtagtggtgcagggagaagtgttaggatggcaaccctgcagcccccaactgcaccatgtagagttgcctgagccagtccctagcctgccaaaagcacaaggctggcaggccacaagacagaggggtaaatgagaaacagggtgatcagaggttagatgtgactcagacatgagtggaaagtcaaggtgaaacagcgcatcatcatagatcatacagtactctgaaggctgctgtcatttaccacattccataaatttactagaatttattctctattgtttgggttgaaataatcacacatttcaatttaaaaatataaagagaatattagacatttagcagaattttctcagtgcctactggtacttcagaccctatatagagagaatactatattttcttaaaatattatggtctagagagagagagagagtcagttgaaagtgtcaataattctaagttcattctcataaaagaaaattctggagaagaccaagggcaattttatgataaaacaaaataagaagactaaaattttcagatgaatatggttgataagagagtagagccagatgcactaggaaatgtattaaagaacatgaatatgtacacaacaggattcttgtgctcaaattgtttttaatattcagataataagtaaaggtttaattttgctctaaacaatgtgatttttttatttttagtaagaattttattttgggaaatcaaattaaagaactagtagataggtctcctaacataataaatccaatctgttatacagttgtacaggaacaaacatagtaaatatagggtttggtaccatttttggtttcaggcgtacactgggggatttgaaacgtattgcctgttgatggggagggacaactgtacatgtgagacacccagaaaaaatgcataaatctcaaagaggtgcctaaaattcaggcttgaataccatcttcaatggcaaaggaagaaagggagaggagaagacaagagtaaggtttgttaggcagattattcagttggtgccttctcaaggatcagagtctccagagactctgtcctcctcatcctagtaaggagagggagacacccttacaaatggagacttccttggtagatataaatttcccttacaaaagggtcacttctactctgtttttagagcttttcctgtgtctactgtttctcaaaataatcagcttaaaataatacttatgctaaagtggcatattttggggtggcatattctggtctcatacacactcaaggtggaattttccattgtttggtttataatgttggagcatgagtattctctagaggtgtcagtgtcagaatgatcttatacatactctggttgaaacgtcagaattgttatgggcttgggttcgatatttatattaatatattattctggtcacaagagtattgcaggggtttagatttatctcatttttccccatttttgacatttatttccatttctcaatttttctttccagacctgaggtgcccagctcacatgaagcagagcctctttccctcccacaatcatctcaagatcaccagagcatcagttaatgccttactttctgggcttatctactcctgtatttaaagatgttgtttctacattttcacttgtccttggaaattatctttttttattttttgcaagatcatcgaaaatttttaagttccttaaattttatttagtaagtttagtaggaggcatttcttattatgttaggcttccatcttgcaggccccagaactttctgacactgtgaaggccataccagcccacaactgccaggatctattgtatgtgggaggaaaatcaacttctaccctgtaaagtcattgtgattattttgtgtcttctgtcaaacacagtaaaaattaattctattacacctttgactatttagattagagaataaaagactaagaggcacatattaatttttttaaaataactaaacaataacaatctttgccaaagaaaagcattttgaaatgggtggtagcatagagagaaggaagagtcctttcacactaaggatgtcattgccattggcatatctggctttagaaactacaaatggctcgattagctttagagttctttctgctttttagaatttttctacatcactagaaacatatctcttatatttaatctcaatatgaaaacctgtttcatagtacttacaataaatgcattctcaaatgttacatcaaagtactccacctacagtgatgtctccttgtagtgaattagagactccaatccaaaacgtatcataaactaaatatgcacccggtgaggccatgctccatgcagactgcactaaacaaacaaacaaaatgctttaataatcttagagcattccaattacctggacttccagctggtggtgagtccttcctgctgtcagtgtgcagaatgacagccagccccacagagtctcctgggaggactgagctgctgaggtccacccgagtcaagctctggggctcccgctcacagcctcccgccgcgtttctggggtcgtcgcctccagttgcattcatttcttgaccttttctccacggtctctgcacaatgtgaacaatgctctgctgatccaggtcacaattctgtttgggagcaaggtaaaaaaaaaaaaaaaaaaaaaggaaatgtcaaacatgaaatgcgagatagagtttaacttgccctccgtggtagaagggaagcaaaagtgacatgtaactgaccaacttaggtgctcctttgcccacagcagttacacactacacacggtagacaaacaacactgaactggggccagaaacagaaatttgggaatacgtgaaacacaatagaatgctgacgtcatattcaaaaggacataaaatctagcaggaaaaaataattaccaaactggatctataagcacagtgaaaacaataattccttttttccccccaagacagagtctcactctgtcatccaggctggagtgcagtggtgtgatttccgctcattgcaacctctgcctgccgggttcaagcaattctcctgcctcagcctcccgagtagctgggattataggcgggcaccaccacacctggctacgaaaaatattcttaaatagtaaaactgattgacatcagaattgatatgtcattcatctctgttttacaaaagtacagaaagtgagttattatcaatgagagggcatttctttaaagcatcggaaatgaatgcgtttgagtaggctccacacacaccgctccacgggcaccaacacacacatcattacactggtggggaagcaagacaggagcacactcttgccacccagggttcattctctttctgacgatttaaccatgaaaaccagctaacatttacgaaaaggttttgcatctacatattgacacgtaggaacagaagactttaacattttgtagcataaaaattaaaagtcagattatttgctagcacaagaactaggctaccctaaatggaattctagtttcagaatatctactacatagggccggccgcggtggctcaggcctctaatcccagcactttgagaggcctaggtgggtggatagcctgaggtcaggagttcgagaagagcctgaccaacatggcaaaaccccatctcaactgaaaatacaaaaattagctgggcgtgttagcgtgcgcctgtaatcccagctactcgggaggctgaggcaggaggatcacttgaacgccacccccacccccccaaccaaaaaataatatctactacatagaagcagttactcatatgcttgctaccctcttaagacacagcaaggaccttactctctcagtaaatcgatgtggccggccgcagtggctcacacctgtaatcccagcactttgggaggccaaggcgggcggatcacttgaggccagtagtttgtgaccagccagggcaaaatggtgaaaccccatctctactaaaaatacaaaaaaaattagccggctttggtggcatgtacctgtaatcccagctacttgggaggctgaaacaagataattgcttgaacctgggaggcgaaggttggagtgagccaagatcatgccactgcactccagcctgggcaacagagagagagactctgtctcaaaaaataaaattaaattaaattaaatacaaataaaccaatgcctttcaaatacctcttgccattgtcattttaggaatgctccaagaacactcaagtgaaatgcatccataactcatagcgatgaatgatgcccttccctgctgctttctcaagctcttctgttgccctcaccatcaatgtccctcgaacagtggtgcccagcactcaccaacacccctgaccccaaatacaatggctagaatctgcctcctccacccaggagggcaccaggacacccttcgtccttaaatcccattccaacctcttctctactcttacaccctggggctccgtctcatccccaggccctgtgcccctccccattctcagagctcccagtctctccctaggactgctcctactcagcagaggccactgtgcatcattctctgacctgaagtgctcccctgcatgacttcccagtttctgtcaaaggaaaaaccatcccccacatcacccgcttcgagccttcccctcccacctaaaaatctcattatcctcccatgttttgtaacgggctgcaagagaatcactatcttgaattcctcctacctaatctttgacatcggcaaggcaccaacagttagcaattctgtctcagaattacccttcacatcttcaactcttttacatctcaatagtcacctccccgttttaggccttcctcatgataatagctttgtaattactccccacatctgatatcgccatactccagtccaatacatacaagaattctgggtgtgtgctacataatctttctaaagtgtctcagtattacttgtaaaatggactgtaacatctcccatgttcttcaagtgtgtttgtacttttttcctttctaaatcatgatctagatttgatttttcatcttccttacccctcctatatgatacatgtggcagattaaactattcttcaaaatcatgcacgcctgtacattagtgcgcatacatcatgctccccacttcctccctgcaatctgtgtccagccacatgaatggctttggccaaagggatgttagcagatgtggttgaaccagggccttatatttgtcccgctgctaaggtccatcaaaagaacatccctgccaggcacagtagctcacccctataatccaagcactttgggagactggggtgggcggatcacttgaggtcaggagttcaaggccagcctggccaacacggtgaaaccccgtctgtactaaaaagataaaaattagccgggcatggtggtgcgtgcctgtaatcccagctactcaagaggctgaggcaggagaatcacttaaacccaggaggcgaaggttgcagtgacctgagatctcaccactgcactgcactgcacagagcaagactccgttgcaaaaaacagaacttcccagaaagcttctacctgttcacacatggcccagacctgagtccaacccactgaggtgaccaagtgcagccacactcacagcatgaagcagggacccgcagctgaagccagcctgaggccgcgggcaccctcgctgacctgtaggcacatgagaagatggcatacttttatggcactgagatttctgcttgtcctctaatcaataatggcagacagtcctctattttccattctatttggacaagctatcactgtccatgatcagctccgtgtcaggcagcactcctccagctgtgcacagcctctagcctaagtcgtttcagagaaatgggcatcaggatccgagtatactcaaggacttgcacaggagcatgtgagctttgccacagaaggaaaagtggagaattagcaccctagcctatcttgaggtttctatccacattttttccctacctttccatgttcaggactcagttacttcctgtgatcctcctagagaaaagtaacacctttctccctcatctgaatctaaaaatctttgcttactgtgctcttcttattgcagtggttagagcttggacagtatatacatatatattgtgtgtgtgtgtgtgtgtgtgtgtgtgtgtgtgtgtctgtgtctgagtcttatcttccaacttattttagaaatacttgagagcagcaacttggccatagtagcattcatcagaacacctcacacagtgctttggagccaggagatgtagaaacatatctatgaattctaaaagtttgaaaaagtgaatgactgaagggaagtaagaaagaatgaaggagtgaatgaatcaatgaatataaacagtcataagctcagtgcccaaagtgccacagagggaaccagcagaacaagaaagaaaggacacagaatttaaagtcaaacggactcaagctctacataatttattagctgtatgaattttggcaaatgattcttcctttcccagctttctgccattgacaataatatatcaactttgaaggctgttttgaagatttaaggaaatgtaaagagctcagatcccgatccgcaatgatacatcgttggtagtattgttaccatttatgagtttcagaaaactaaagaggatgggtccctaatcttgtacatgaataaggtgtcagaattctgtttagctgcacacttctgtttggaaaatatacagagaaggcagaataagcagaagctatcaatgtgacaatctctctggtagcattccaactttctgtgaactaaaaatcgatacaaaaaaataattcctatatcaccatatagccagatgccatgaaacacgtgaagaacctgagtgaattttcagggacaggtaaaatgtgacaaatgttgatgaaatctaaaagatttcaaatccagattttcctaatgctcagggtacagctgcaaaggggaaaagaaagttctcaaacagatttcagtagttacagtgatacttataggacgcatttccctcagttggcatccctgtttctgaaatcattaattgcttaatctttgactcttacagaaaatcttcttggttccagaagcggtgcctttgacagacagtggactcacacaccacactggttcagttcaaagccacattccatggacagtacattggatacagtccagttgtacagccacgcaaaagccccaaatactacttagttctcctagtatacaaaaaaattcctcagatgtgggaagaaagagattttcggtgggaagacatcagagtgctccaatatggtttcaggctaccttagagcagaaacaatgtcttatttatctttgtttctccaataaataaaatattacctgtcaaagagaaaacccttaatacaattctttctttttttataacaatatattaatccaacaagtaaggcagtaacaaattcttcagtgtagacaaaccaagtaggtatttctgtaaccgggtttggtcttacactgtcaagcacagctgatgacccatgggagactgagggatcagtatcttgggctttctgtctataggatccttgacatggaaacataccagtattaacaaaacatccatgggagttttttttgccaaacaatgatcaactctcatctggttggacattatccaataatatacaaaaaactgatgtatttttctttttccaaaaagaagttccttcaacggcacatagttaagatccaaatatttcagattcttccaagcacttaataaagagttacaaatatcatctctaaaatgattaataatgagattctaaaattgttaacaataccacattattaatacattgttttcaggagttatgaaaatagttatgttaataataaaaaacatatagaatatacttagccgtatattgcagaccattacaggttttgagacataataaattatttattattctcacactctgatgagggaataactatcaccatctgctatgtctcaatgtgtcctcaaaatttatttgtttcaacttaaccatcaatgtgattgcatgaagaggtggagcctctagaaggtgattaaatcatgatggggcagagccttcatgaatgggattagtgcccttataaggcagtgcaagtgactttctgtcctttttgcccttttagctcttcccctcttccagcaagtgaagacacaacaagaaggccctcaccagacactgaataccaacaccttgaccttggatttcccagctttcagaattttataaattgcccagtctcaggtattttgttatagcaagacaaagaatacaagacaacatacataaagttagtgtgtaaacagagctagaaatagtgtgtaaatccaagagaactgtgcctggcacagataatgctgttttacagattacttattgtggttgctgttgattccactttatagaagacaaaggggagccacagagaagttcacgatgggttcaacaacacccagctcccgagtgtgaagccagggtaggaacccaggccatcgactcctctgctggtgttcattgactctgctgagaggaagtggagacttggatgaggcagacaaactaggacaagtctacaggggcccatggtgaagaccagggtttggatgctgcaacggaaccaccccaggtacgaaggaatgattcagagaagagccagatagctgaaatgttaaaaacatgagaagacaggatctgggacggggctgtataggaggtagcaaagtaaagattagtccagtgtgattttaaagaggaaacaaaacaaaacaaacaaaaaggatgaaagtaagaacaagtgggttgcagaggaatcagtgagagtatggaaagtgaaaagaagatggtataggtgagctggtaacacacctcgcagactccggatgctggtgctggctcaaggtaaagtctgtacctctggagatcccgtcaccccagggaagactgcacttatcacgtcgtattgtagtttctttgtatgcgttgctctctgttaccagacaataccgtctttaagaaaaaatactgcaactgtgtctgtagtacctactgtagggacctgttcataaaacacactcccctgtgtctactgaatgactctatgatcctttaagcacatacctagaagtgaggaaacattccagatggcgttagtaacttacccaagtcaagtctgatgcataattgggaaatgaaagagccaggcctgcagcctcagttttctggctctgagcccaatgctctatttcaaacatcccaccttggattgtccacctctctgtgctcacgacataagtagacatgttggcagaagtgcccagccagtgtgcttttatcagcatactgatcagtctatactcattggcatacttactgtaccactgtctatggtctgtaaagtaggtagggctgtcttcaatatcttcagtatcattcattcattttcagttccttctaaatctgttaaactctatttcctcatacaaaatgcttaaaatcatttcagtgtatggccaacaaacatatgaaataatgtttaatatcactagtgatcagggaaaggcaagtcgaaaccacaatgcgataccatcttactcctgcaagagtggccataataaaaaaatcgaaaacagtagatgttggtgtggatgcggtgatcagggaacacttctacactgctggtgggaatgtaaaccagtacagccactacagaaaatagtgtggagattccttagagaatctaaaagcagaactaccatttgatccagaaatcccactactgggtatctacccagaggaaaagaagtcattatacagaaaagatacttgcacacgcaagtttatagcagcacaattcacaattgcaaaatcgtggaaccaacccacatgtccaccaatcaatgagtggataaagaaatcgtggtatatgatggaatactgctcagccataaaaaggaatgaattaatggcattcacagcaatctggatgggattggagactattattctaagtgaagtaactcagggatggaaaaccaaacattgtatgttcttactgatagatgagagctaagctatgaggacacaaagacataagcatgatacaatggacttcagggacgtaggggaaagggtgggaggggagtgagggataaaatacaacatatatggtgcagtaggtactgcttgagtgttgggtgcaccaggatctcacaaatcaccactaactaacttacgtaaacaaataccatctgtaccccaataacttatgggaaaaaaatcatttcagtggaaggctgtcaaactttctaatgtgtaataactttacattttaaagactgaacatttctgatttttatttggatttttaatagactacattttctatctagaaaaggaatacaatcagccaagaatgatcagactaatttaaaaatcaatagtgttaacagattctaatgttaaaacatttttacattgagttctttcttaaataactttgaagacacacttttaataacaccttaaattgtccttttttgtgctgaacaatcttggcattctttctattttttgcttcttctgaaaataacttctaacaaacagatttttttttttttaaggcagggtctcactctgttacagcccaggctggagtgcagtggcatgatcaaggctcgctgctgcctcgaactcccagactcaagtgatcctcttatggcagcctcctgagttgctgagactacaggcacacgccactacacctagctaattttctagtttttttttttttttttttttgtagagatgggatctcacttatgctgcccaggctggtctcaaattctcaaattcctgggcataaatgattctcctgccttggactcccaaacactgggattccaggcctgagccactgcacctggctttaagcagatgtggttggaagcccatcacagtttttaataacgtattttctatgccaagaaaagacaaaacggcaatgatttaataagttaggccgaatgcagtggctcacgtctgtaatcccagcactttgggaggtcaaggagggcagatcacttgaggtcaggagtttgagaccagcctggccaatgtagtgaaacccgtgtctactaaaaatacattaaaaaaaattagccagacgtggtggcacaagcctgtaatcctggctacttgagaggctgaggcaggagaatctctcgaacctgggatgtggacgttgcagtgaaccaagatcgcaccagtccactccagcctgggtgacagagcgagactccgtctcaaaaaaaaaaaaaaaggtgttatttaaaggtgttttttaatgtaatggctaagaactattttgtttggtcactgctaacaatgaaatgtgtttcaagacaagatgagccagagatgttcacagtaagtcagaataatcaaaaagggaattgttcccagtgatattttttcacttgaactccagttcccctccatagttttcaatgaacactaaatgccaatttatattaattggatgagaacagaaactatcctttcaaactgatccttcatttaaaaaaagggggacttctaaaagatgaatatttgtgatttagcctttcaatttatttcacatttcttatgactgattttcattatgatcaaaaatattatgctgtgtaaagatactgaaaggccccttctctggttcccaaaggcaggcaatacaattactgtgaaaggtcaattagccccacactaattagccagtgcaggcctgggccttgtcacctccatgtccctcccaccacaggcctgagacctttctgctgctcatgaggatcctacaccagaggggctccatagggggcgggaggggggaccgctcaggaatcactcggtttggctacatgccagcaactgcagtaagtgatttagttttgaagagcagaggacagtgctgtttgagcatgtagggtcgggatttcacttctctgggttccctctttcatgaatacaaaggatatcggatcaccaaagctatgcccattaaacccactttaaaattgtgttttatattgtcaacattgcaagaaatgcctcaagtatcacttcttttttctttaagtattattttattactagttgtgataaatattatgaacactttaaaatatatatattttatttgacagaattaaattaatgtttttaaagccatggaatacgctgtatagaattactggggtcagggtttgagagcttaacaacacacgctcttgatgaagctgacccggaaactcaggcacgtcggggaggtcagcactacccaacagaaccacatgcgagtttatgccacgcttcccaaattccaatggttgcgattaacactcaaaatcatatacctccgcgattgcaaaacaacatctgcgcaaggtgtttactgtgggattatttataatagaaaattatgggctgggtgcggtggctcatgcttgtaatcccagcactttgggaggctgaggtgggcagatcacccgaggtcaggggttcaagaccagcctggcacacgtggcaaaacctggtctctactaaaaatacaaaaattagccgggtgtggttgtgcgtgcctgtaatcccagctacaggctgggaggctgaggcaggatactcgtttgagccgggaggcggaggttgcagtgagcctagatcgggccactgcactccagcctgggtgacagagtaagcctgtgtctgaaaaaaaaaaaaaaaaaaaaggaaaaaaaattttcagaaacaagtgaaatgcttgaccatagaagacaagtacaatctgtgaagaaaaaagaaaacaaagcagaaaatagaatatagtaagggactttctatgtcaaaagcaaagaaaattaagtacatacaaaagtagctgtttttgtaaaaggaaacgtagaaaggaaaatcgaagttagtgaaaatggttacctatgagggagtagggaaatgggttaaagggatcgaatgggagccatgtttccctaacgtgactatctacagtttcaggtgtgaggcacagaaaatgtttcacaaaatcacaacaatacttactaaataaaaaggagaaaaaaagcaaactctaaaactgaaaattaccagaaacatattgagctgacaatgtcagtacataaataaaagtagttcaagtaacttttggacacagtgctctgtatatcctttagtacaaaaaaaggaacccaaaagaaattttgtactttatttactaagttgattactggtatgatataggtgtaggaattcagaaactatttgtatttatgttaagatgaaaaattactaaacttactgatgtttttggaaaccgagtttttcacagtggctgaagaaggtgagaaggagcttcatgatgttggagttgaaataaaggaaacaaaatgtacttatgaatttttaaaaaatccaattcattgaggggaaattactcacctatccagaagttgcagaataatgagacccatgtatatctattcatcaccttattcaacaattatcaacttgagtccaaccttgttttatcagtatgaattatcatggataaatgatattatcaatatcactacccactttcccttcctatattattttgaggcaaatctcagatatcatattatttactcaacaaaaatgatccatatgtatctctacgaaggaggaattttcctataaaacctaactagaataccattagaggaactgaaaaattacaaataagcatttaatggcatcaaatatttatgtgtccataattttaattttttccaaatctgtttgaatcgagatccaaacaagtccatattttgggactggaaggaatgtatattatatcttcttgtaatttaattaattaatttattaatttattaatgtatttatttatttatttattttgtgagaccaggtctccctctgtcactcaggctggagtgcaggcatgatcagggctcattgcagtctcggcttccagggctcaggggattcctaacctcagcctccccagtagctgggacaactggaatgtgccactacatccagctaattttttgtatatgccatacagacagggttttgccatgttgaccaggctggtctcaaacttctaggctcaagtgatctgcctgcctcagccttccaaagtgttgggattacaggcctgagctactgtgcctggcgttcaatgtttttttattaagacataactaatatattgtagttctcccttttaaagtgtataattcagcagtgtttagaatatttgcaaggttgtgcagccatcaacactctctaatttcacaacattttctcttcagttgcttttacaagttccctcacccatctctcttcctgtttttacaattaaatttgaagaaaaatgggttaatccattgtagaatttctcataatctaaattttgccagttgcatatgggtggtattactgaacaagtttcttcattgtccttattatagaaaattttatatttgtggccaggcacagtggctcacgcctgtaatcccagcgctttgggaggccgaggcaggcggatcacaaggtcaggagatcgagaccatcctggctaacatggtgaaaccccgtctctactaaaaatacaaaaaattagccgggtgtggtggcaggtgcctgtagtcccagctactcgggaggctgaggcaagagaatggtgtgaacctgggaggtggagcttgcagtgagtggagattgcaccactgcactccagtctgggcgacagagcaagactctgtctcaaaaaaaaaaaaaaaaaaaaaagttatatttgattctacaggcttgactaggtttaggcttaatatgttttgctgggattcctgtaagggtgctgctttgttcttcaagaaggaagcactatgtgactatgcctgagtctgactacatttggctgtagtgtatcttctttatggaagatacgctaaaattgtaaaatggtgatcttttaatattatcacttcttctcaaactattagataacatatttctatcaagataaattttccctcaatagctattttgttactcagagataaattttgtataggaaggcagaataaatgctctattattttcttggtttatacattttcaaaataagttgactctagcaatgaataaaaatgcaatttttaaaagcattattaaaaaattatagaaaaggccgggtgcgaggctcatgcctgtaatcccagcactttgagaggccaaagcaggtggatcacttgagataaggagtttgagacccacctggccaacatggtgaaaccctgtctctactaaaaatacaaaaattagccaggcgtggtggcggatgcctgcaatcccagctacttgggaggctgaggcaggagaattgcttgaacctgggaagcagaggttgcagtgaaccaagaccacacaatcgcactcctgcctgggtaacaagagtgaaaatccgtctcaaaaaaaaaaaacgaaattacagacacacacatattaatgatgtccatcgattgtacttattattttgattggtggttatctatagctaattggcacatcttagaatgggatcctgaactgtggcagaggcgcaagagtctttggtagcttccctgccatcctgtatgacaagagactccagtctgctttgaacactttttgttctagacctgtaataaatcattttgacaaataaaaatggcatttaaagatgacgatgtggatggttagagatactcattgctagtggattcataaacgtctgtcagctttttcagtgacaagaggtatgttttgttcgttttttaaagataaaatacatcacgagttcaatctgatatttcccattcaaaccgaggagtagagggttttaaataatctccttcgtcttccatcttaatcttcttttctcttgttcaaaatcgtgaaaatgaaatgattagatgtcacataattactcattattttagactacattatatacacaatgtgaatgataccattaaattgattactaatcatagtttaagtttttctgcttgtagttctttttgtcttgggatgtacctcattaaagatgtatagtcaaactgctgtattctaaagtcacttggaataatgtggctatgattacaactaaagatacttgcattcatttttttgactttattttttattcttagaactttctatttaaaatatttaattctgttttataattatggaaaatattttcaagtttctaaagtcaaactttaaaaacataaaattgtcaaagatgtctcacttctacttttgtctgtttaatatattcactatctttttgtttgtttttagatttctgctttacctctaacagaagctggtgtgtgtgtgtgtgtctgtgtgtgtgtgtgtgtgtgtatttaagcacctctcttagataattgatagcatgttatatacttttttcgcttaatttcccctacaattaattctacagtagtatatacacatttccttattatttttcacaaccatacagtaacctcacgtgtggataaatcatagtttattcaaccaataccctatgttctatgacaaatgaggtcccactggccaagtttgggaaaatataaatacaaaaaagaatagattgataacaggttataatacattaaagaaaaaatccatgaatatatgataatattaaaaagtatacgtgtgaggagtaagaaagagttcttccatacagaacaacagaataaatatggcaagaactgtcggcacagacaatcatatttttgaaggcactgatataataattaattcactcaaggatcaccagtagaagctacagcaaatggatccaagattggtgggaatcgggattttggcagtttccaagtatctgcccacagattccctaataatttcaaaagaggagggttatttctgcaatgggagattcggcaggcatcactgtaactaagattcacacgggcattgtcagttacaaaggattcagcattaacgacaacaaagtttaacccaaatttagcaatgaggagacaataaaacaaatcgaggttgcaggataattctgcaaacaactgacccttacaattcaaatttttgaaggtgcaaattaggtgtgtgtgagaagactgttctatactaaagcaaaataaagatacatgataactgaatgtgatctgtatatttgactaaacttttggtcagaataatttaaaaaaattatccaaagcatacaaacaacctttaaaactcatcagtaaataaataaacaaacattaaaaaagggccaaaggctttaacagatacctcaccaaagaagatacagagatggcaaagaagtaggctccacatcttatgtcctcagggagcagcaaattaacgcaagataccactacacaccaattagaataaatcccagaacaaaggcaacaccaaatactggtgaggacgtggaataacagaactctcgttcattgctactgggaatgcaaaacggtatagtcactttggaaatctggtggtttcttacaaaactaaacatactataaccacacaatgcagcaatacctggagtatttacccaaaggagttgaaaactaaaatcatgtccacacaaaagcctgcacacagatgtttacagcagctttattcaggattgccaaaattcaatgcaaccaacatgttcttcatcaggtgaatggataaagtatcagacatacagatcatggaaaattattgagcactaaagagaaatgaagtatcaagccaggaaatgacatggaggaaccttaagtgcatattaccaagtgaaagaaccaatttgaaaaggctacatcttgtatgattccaatttgaaaaggccacatgttgtattatacgacattcggaaaaaggcaacactatagagacattgaaaatatcagtagttgccagggactgagggatgacggagggatgaatagagacagcacagagaatatttaaggcagtgaaaatactcagggtgatactatgttgatggataaatatcattatacatttgtccagacccacagagtgtacaccaagagtgtaccctcatgtaagctataaatgtgaagtgattacaatgtgtcaatttaggtttatcagctgcaaaaaatgtaccgctctggtgggggatgttgataatggagagggtatgggcacatttgggcagggagtagatgggaaataccttcctctctatgatgtgaacctaaaactgctaaaaaataaataaataaaggcttaaaaaagctataaaggacaatttgggaacaattgggaggatctttgaatatggactacaaaagaaatatcattgtatcgatgttaaattccttgaaatttacatcacacattacagcggctacacagaagattgccctttgcctttgtagatataggctgaagtgtttaggaacaaaatgtcagtctatctgcaattatgtttagcttcttgagagacagaggaaaggaaggaggggaaggtgtgagtgagggagacaaagaaagataaagcaaatgtggcaaagtgttaacagttggggactctggagaaaggttgtacagatatttgctataaatagatttttttaaaaaattttttaaaggtttgaatctcctaaaatatcttcatactcagtcactaaatggaaagtaaccactgaaaatcagaaatgttggcgaggtgaggtggctcacggctgtaatctcaggactttgggaggctgaggtgggtggatcacttgagctcaggagttcaagatcagcctggccaacatggtgaaaccctgactctgactctactaaaaatacaaaaaattagccaggggtggtggcaggagcctgtaatcccagctacttgggaggctgaggcaagagaatcgcttgaacctgggaggctgaggttgcagtgagctgacattgcaccattgcactccatccagcctggacgacagagactccattaaaacaaaaaaaagaaagaaagaaagagagagagagagaaggagagagagggaaagaaagaaagacagaaaaagaaagaaagaaggaaagaaagaaaaagaaagaaagaaagagacagaaacaaagagagaagagaagagaaaagaaaagaaaagaaaagaatcctctgtcttaatcctgagttctaatttgattgccttgtggtctgagagactgtttgttatgatttctgttcttttgcatttgctgaggagtgttttacttccaattatgtggtcaattttagaacaagtgctatgtggtgctgagaagaatgatttggggtgcagagttctatagatgtctattaggaccgcttggtctagagctgagttcaagtcctgaataaccttgttaattttctgcctcattggtctgtttaatactgacagtggggtggtaaagtctcccactattattgtgtgggagtctaagtctctttgtaggcctctaagaagttgttttatgaatatgggtgctgctgtattgggtgcatatatatttaggatagttagctcttcttgttgtattgatccctttaccattatgtaatgcctttctttgtctgttttgatctttgttggtttaatgtctgttttatcagactaagatcgcaaactctcctttttttttgcattccatttgcttggtaaatattcctccatccgtttattctgagcctgtgtgtctctgcacatgggaagggtctcctgaatacagcacactgatgggtactgactttttatccaatttgccagtctgtgtcttttgattggggcatttaagccatttacaattaaggttaatactactacgtgtgaatttgttcctgcattcatgatcctagctggttattttgcacattagttgcagtttctggaaactgaacaacctgctcctgaatgactactgggtaagttatgaaattaaggcagaaataacaaagttctttgaaaccaatgagaacagagacaatgtaccagaatcactgggacacagctaaggtagtgtcaagggggaaatttatagtactaaatgcccacatcagaaggagggaaagatctagaattgacaccctaacatcaccattaaaagaactaaagaagcaagagaaaagaaattcaaaagctaaaaggccaggcatggtggctcactcctctaatcccagcactttggaaggttgaggtgggtggatcacttgaagccaggagttcaagaccagcctggccaacatggtgaaaccccgtctctactaaaaatacaaaaattagctgggcatggtagcgtgtgcctgtaattccagctactcgggaggctgagggaggagaactgcttgaactgagacctggaaggtagaggttacagtgagtggagatgacgccactgtattccagcctgggctacagagtgagactccatctcaaaaaaaaaaaaaaaaaaaaaaggctagaagacgacaagaactaactaagatcagagcagaactgaaggagacagagacatgaaaaacccttccaaaaaatcaatgaatgcaggagctgttcacatatacaccatggaatactatgcaaccataaaaaagaatgagatcatgtcctttgcagggatatggatgaaactagaaaccatcatcctcagcaaaccaacacaggaacagaaaaaaacactgcatccatgccataaaatacaactcagcatagtattccatggtgtacaaaaaggatgagttcatgtcttttgcagggacatggatgcagctggaaaccatcattctgacaaactgtcacaaggacagaaaaccaaaccccgcatgttctcactcataggtgggaattgaacaatgagaacacatggacacagggaggggaacatcacagactggggcctgtcagggggtggggggctagggaagggatagcattaggagaaatacctaatgtaaatgatgagctgacgggtgcagcaaaccaccatggcacatgtttacctatgtaacaaacctacacgttcagcacatgtagcccagaacataaagtaaaattaaaaaaaaaataagaaaataagaaatgcggtattactacaaaatttttaggatgaaaaattgtatgtatttcatgctatctgtcatgaattcagctatctaacctgctatatcctacacatagcttacaaactgacctaagaaaggagggaaaaatgaaagcaaaatccaaagttgcttataaaaaagaaatctttgttttggaatatgagaaagctattgtataaatacagattaccaatatggtttaaatagaagaattatagtcaaataccatagcaaatgagttaaaattttgcagctcattacagttttgaggtctctaaagtgaataagcataatacccaaaatactgactttgtagaatcctaaaatccagttatgcagtctacagcagcagtcctgaatctttttggcaccagggagtggttttgtggaagacaatatttccacagatgagggcaatggggatggggtgtggtttgtggatgaaactggtccacctcagatcatcaggcattagttagattctcgtaagaagcacacagcctagatacctcacacgtgcagttcacaatagggtttgcactcctatgagaatctactgccactgctgatcagacaggagctccagcgtcatgctcatctgcccatactcaccccctgctgtgcagcccaggtcctcacaggccacagacaggttctggcgccacgggggttggagacccctggtatagagcaacgcatgggcaaaagcactgcatgagtaatcaaggtcaaaggcagaattaatggatgttctaatttactatggaggcaacatagcaaaacctcttaaacattttacaacaaagatcctgtccatattacagtcttcaaacagatatggacttccatacaagaagagtatattaaaaaaaaaatccacaccctctcagatgttcactcaaagtgataaaaatggaaacaatggaatcacatctgctaaaatccatattagaaagtatacaaataaaagtgcttatgataaacagctaatgagaataaatggatacactattaagctatcttggcagaatttatcaatgtcttagatgtacatgcagaaattctcacatatgtcctcaaaaacacatgtacatggatgtcctttgcaaccacagtaaaaaccatggcaacaatctaaacagtcatcaatattgggctggctgccattcatacatacaattggtaaacatttgttataactctagaagtacacggaaaagaaggcggtctattttttaaataaaatcagcaagttgcagaatagcatgcactattattattagcccatttgtctgtatgttgtatatcactctgtatatgcattaacttattgggtacacatagcaaattttgattaactctgaagaatgggattaagtgatggaagagaggaatttgaatgtttctgaaattttaaaaagtctaagcacacattactttgataattttaaaaagacacctgggaaattatttgcaagtaaaatactcatttaattcctgataagctttcctttctttctttctctctctcttttttttttttgacagaaaagataatgacagtaaatgctttacttagaatagaatggaattttttttctacttttctgtcaatgtctttatggatgatgttgccatcttcattttgtcactgttagttgtaacttctttctgacctatgttttaccctttctggctacaagctcattttacacacagttatttatatgaacagttgggagccactcactcacctctcttttgagaaaagaaaaatatatttgtgctttctaacttttattatctttatgccaataagtctttttattttcacctaagatttgtgtccatttttggaatggcagagatgctggaaatcatatttcaatccaactgaaatgtacgtgtgagtgtgtgtgtttgtatgtatgcatggttttatgtctttagaattctttgtgagtgctccagtaaatctggtgccttctgagacgacaagagaggattaaggaaatggtatgagttttttgtaactatctcaatgaaaaagtagagaagcatagagtgaaaaaatccttagaacagtcttgctctgtcgcccaggctggagtgcagtagcacgatctcggctcactgcaacctccgcctcccagattaaagcagttctcatgcctcaacgtctgagtagctgggattgcaggtatgcgctatcacacccagctaatttttgtatttttagtagagacagggtttcgccatattggccaggctggtctcgaactcctgacctcaagtgattcacccacctcagcttcccaaagtgctgggattacaagcaggaataaatgttactgtattaaaagtattagatcctgacccctgcttgatgtgttaagctcagtgtcctctatctgaaataaagatacacactagcgtgttctccagattcaccttaattttacctgaacaatattctaaaattttcaaattatagcacaaacatactaagtacacatataattcacaaaaattaaaaacatatatttagccaaaagtaaataaaataaaatcagtaaaataaacaaatctgagaacttcatgaatggcaaccacagcctaaatgcaaagaaggaataaaacagctacttcttggctcttgggctttcatgggcccaggatccactaatgtaagagtaatttcagagattttgaagggtaactgggtatatttatgtattgtgttatttctttcttttttttttttttttttttttttttgagatagagttttgctcttgttgcccaggctggagtgcaatggcgcaatctcggctcactgcaacgtccacctctcgggttcaagtgattctcttgcctcagcctcccaagtagctgggattacagacatgtgcaaccatgcccagctaattttgtatttttagtagagaccaggtttctccatgttggtcaggctggtctcaaactcctaacctcaggtgatccacctgcctcggtctcccaaagtgctgggattacaggcgtgagccaccgcacccggccatattgtgttatttcatctcacatcttgaccttgaactttgccagttctcctataaatagcaattccactgtagtgacttacatttgaagtttgggcagtttttgataaatatccttattactggattttcttttcaaaatgaacaagaatattggacaactcaggtcctccgtttgaagacattcacagctgagaatgatattcgtatacatctgggccacagactagcagttcatctagttaatcagttactatgtagccaacctcacaagttgctatttactgccaatatgctgcacagctacaagtgttatgggctaaattgtgtcccctcacaagtcatacattgaattccaaacccccagtatcccaaatgtgactgtttggagatagggcctttacagaggtaaccaagttaaaatgtcagcattagggtgggtcttatctaacatgaatggaatccttttaagatgagattcaggtatagacagacacagaaaacagaccatgtgaaggtacacggagaagacatctgtaagcccaggagagaggccacagaaggaatcaaccctactgacaccttgactttggaattgtgagaaaataaacatattatttatttaagccacccagtctgtagtgaaggttcattttatacaagaattatacaacattttactggtccctctcgaattctatagcagcaggcatgtatcagggatcttcacagatattttggagatttttttttttttttttttttttttccgagagggcctctggcatatactcttgacataacatctgggcaccatgggtagtacctcctttatgacagatacttcattttaattaggggatgactgcattatttcaagacaaagcaggtgtaggttattattgggtgttgtatcaaagaaataaagaaatgtaggatgacatggggttattcatttctgcattgaaaataaggggaaataaggagttatatagtaggatcttcgcaattacactgaaaccagtatagtgcgtgcttgttgaatgaatgaatatcagtaataactctcaagaactgtattaagcaccatatttactaaatatcttacatattatttgtaatcatcaaaccacactgataaataagtattgtagcagagacagctggcacctcatcgaaatctgtttcctcctcttccccgacaccagatgacctgatttcccaaattccttaacatttagggttggctacactgattccttttatctgatgggtatgactagaagagatgtgtgccactttgaagccaaagcatgttcacagaagttgtagtgaacacagacagacaacaaacagataaatacacgacaaaatggttgataaatgtgtggcggcgggggcatagatggagagatgggcaaaatacaagttagagacaaactctcaactgtaagctgggagctcacatcctatggtttcaaccacacaaccaaagactacaaaatgcagcgtggcagcataatcaaatttacatcatcaggttttggattgtcaataaactttctagagattactctgcacagccaaaattttaaaatgatatcagatacaacagctaaaattactgggttgaaactggaagcttcctttttaaacagagctgtaaatgtataaaatgccacattagggcacaggttttatcacgtttatttgctagctaattattgaatccaaagcctttccaaacttgtttttggatgttcttgtgtttgtttgtttgtttgtttttcctaaatctttatagccgtgagccttgatcttcatgttttctttctcagaaatcaatcattcctttgtgctacataccacctcctccttcctgatagtatgtaggccatcttcaaactccctacaacttcaccaacatttccaactcattttcatacttttaagcccactggcattatacatgcaatactgactccaataaaatttatcatgtgggattagcataagcagaggtggcaaacttctcatttgttgctcccaaaaacaaaatgctagatcgctctcaagtaagaagaaacttgtatcacagtgtggtttggatggttgctatgacaatatcgagttcttctttgagaaagaccatgataaggcattcattaggaacataagtacctagcagtgagggttgttttctttttcatttttaaaatatctggccaagtagctggcgtttaaacagatcaagcattttacctacattctccaaactttaatttcataacgactccttgaaataagatgatggacaacaaaactggagctcaaagagatgcataacttacctaaagggatatcactggatttgcatccaggttcatcttgtaaaaccacgttgaactgcttaccttgactgaataaatcagcaatgagtacagatatctactttaattaacacatctaaattttgcttcattctataaccaaagcagttaaagggtagaatttggaagcacttaagatgaaccctccaattcttctctattgtctccaaaggctgtcccatctaatggtacagatgtgtgaaactcagaaaaatgataacagattacagatgagacgcaacgaaagcttccagccaggaaggtgagtgaggcagatagacaagctcatgaatttccagaggaacatatcacaattctgatttgtctgtgaggaaaagacatgatgtctccctataaaaattcactgcacattgccaggcatgggggttctcgcctgtaatcccagcagtttgggagtctgaggcaggaggattgcttgagcccaggagttcagaatcagcctggacaacatggcaaaactctgtctctacaaaaaaatataaaaatcagctgggcatggtggcacatgcctgtggccccagatactcaggaggctgaggtgggaggatcgcttgagtctgggaggtccaggctgcagtgagccatgatcatgccactgcactccagcccgggcaacagagagagaccttgctccttgcaaaaaaatcactggacataatgaaattatgaacataagaaaaggttggatttaagggctattttaatgtaattcccatcattttcatcattcttttgtgattcatattatttaccatggaagacttctatttaaatcaaaaggattaactgggagggttacattgataacaaataactagctatcacaaatagaaatttgtgaagggatggaatgtgagaaaattagctttgattatgaaaaatgaaagagaaaagcctaatgtagaattcgcagctaagtgggggcaacccatgccaatcatttcaaaggctggtcacacccgaggcgtgactaacccagcagcagatggaacctggattctacatttcaccatgcttggggtgggcttggggctccatgacccacaattttcccactgcatttcccaggccaaatgcctcaggttctgtcttattccggaatcctgttcatgattagaatcatgctcaagagctaaaatcttcttctgaacttaagccccactgacggaagcactgaatatgcctaactcttacagtttccctccctgcctggaagtgggctctataccaagccaggtggtccagagccactcttctgcccacatcctatcctcatcctcatcttaaatgtagccaacaagaggaaaaacatccattctggttttggctgctggtagtaggcagcggtctaaggtagctcttgagtgtctcactccctgatctgtgtatctgccttctatgagcagcatctgtgactatgaagaatgccacccgtgtgattaggttacactatagggccaaggagaggggggttttcagatatacgtcaagtctgtaatcggctggcttgttcagcaaaagggagattatccccggcgggcctgaactactaaaaagaagtgtgcaagtgagctccatgaaacggggtctcaagttcagagacatgaagtgacagagacttcacgttcctgctaggcttgaagaagcaagtcatcgtaagttctacagctgcaagaaagtgaacttctccgaaaaggacacggagccctcaccgaggcccccaccaaccccttattgtagcctcatgagcccctaagcagaggacccattaaaccaagcccacaaacatggaaatggtgaaacactcacatttttctaccatgataccatttataaacatcggatacatttatcattccaaggattcttgccatttgcagatacctatgcttggctgctgaggaaggctgaagccccttgaggacaaagaaacatgagcttgttgtcatttgatcaaacgggctcttgaagcttaggtcagcagtaccattgtgaagtctgtttttcactttaaggccatgtgagacaaagagatttgttgtggtctgtagggttttactacaacataggatgtggaatatggcaaaagtgtagtttcctacacatgggtttcctaggatggcagtaatcaagtaccacaaactaggggtttaaacaacagaaatgcactgtctcacagctctggaggccagaccctgaaatcaaggcatcggcagggctggttccttctgagggctgggagagaaggacctgctccagggtgctctccttccttgtagatatccaccttccccttgtgcctgcacatcgtcctgcctctgtgcttgtctgtctcactttttttcccctttttctaaggacacttatcatattggattaaggcccagcctaatgaccacactttcacttgattaccactgtaaagacctgatctctccaaataaggtcacattcccaggtgcttcaaaataggtgtttttttttagccaggcatagtggctcatgcctgtaatcccagcactttgggagactgaggcaggtggatcacttgagctcagcagttcgagaccatggccaacatgatgaaaacccgtctctactgaaaatacaaaaattagccgggcatgatggcaggtacctgtaatcccagctacttaggaggctgaggcaggagaattacttgaacctgggagatggaggttgcagtgagccgagataactctagcctcagccaacagagcgagacactgtctcaaaaaaaaaaaaagattttttgaagaacacaattcactccataacgcccataaaagaggaaggagagagcatccaaggactaggtaccttactggagggcagatagccagctgcctctgctgtggcagcaagacaccaaggtgaccctcccaatttcaatagccgtgggatcatcaagggcaggagaaagggaaaggaagaaccttgaatgtgactgcatatctaagtccctaaattgaaacagaatgacctacctggaagtaagagtatgatttttttctttccttctgagagtggaaatgagggcttgtgagaaagttgaaaaatagagaaagtttcatttcagcttatctgagttgtgctgcatgaatatttttattcgcctcctatgtcctgagcatgagaattgagcaccagaggaagaatccaagactccttcactttatccccagtccacagaccgaccattgtcctcagcaataggctgactgtcattccctctcattttgcatgcagggattgtacacgctgaaaaactcccttctgtctaacctcccctgcagcaggtcaagtatagttgtttgctttaatataagatatctgttgtactaagacttcattgaataagtttcttaaacagacgagcaagtcatttttccactcttgagtggcctcttagtgagttaatcattttgtggaaatacaaataaatctaacacaaaatatcagaattttttccttcttaatagaatttaaattctttgatttaaaacatcataatttattccttgttagatttttcaaataatatattcaaatgtccatgttaaatgtcagattaagagacaatgatttttatgagtaattttttatcaccaaaagttaattgcctcatgtatatttctccactgagttagtaatattatgacaatattaatgccgtagattttcaagctaaaacagatctatttttcaaatggaaaattaattctaaaaaaatgaaagtactaatttaaatcattaatggcaatttcctctttgcagactgccttgaacttttccagttctgccctaacagtccaggagaaggaaaatacaaattttctggcatggaaataacataagaaggagctgcaagtttcttggcaaagacattgacaacttttcaggataatcacaaaagggataggataactctaaaaatgaacataatgctagtctgagccagttaagtgctcactttcatagcttctggtagaaagagcattcatggaattaaatattaaatatgttctccgaagttctgagatagtaggataactgtgtgtacttataagaaaggagcgatgtcatgggtgattttcctaaacatagcagagaatcaggaaaacagccaagcatttgctgagacggaggcacataaaacatgaatctgagaatcccaagggtagaagagagaaatgtggagggttatcatcataaatcatgttagaaactagggcaagaaactcatggtgacctctggacactaaaatgcagctggtcataattaagcttcaggctttgctcttcctgggccagttcattggcatcgtctactgccaggcctcgtaccagtctacagaagagattgcctggaacaagcctcttgatgttattcacacttatgaaccaactctggtactagatgcaaaaagcatgtcacaagagggatgggtgggatgggggggaagggacatcgcaggaatcatgccactttccagccccaccaccctctggtgccacgtccacccttgatcactattaccaacccagtatccctccagcacttcacgggagggtgtcagggatcacaaggaaacacatgggacccacacatttcgagatgcctcacctcctgctcgaaagtcaggtgaagaaggattcttgagccaaacatgaaagattttttgagagctaagctgacaggagaatttcccgtaaaaagatgaaagccctggctttaacagagccccttttcatttttacctttaaaaagcttttcctttcatgttaccctgaggttattcaccgctacgacaacaatctccaaagacgttttctccattatagaagaggaaaaggttggcgttgggatttggtcaggaaatgaagcgttgaagacaaacaagatgttctaatatagagcaaacctgatgagtcattttctaagtgagcagccacttccagatacaattcatagtatcttcctagttattactattattattattgtttttttttttttttttctgagacggactttcactcttgtcatccaggctggagtgcaatggcgggatctcgcctcactgccacctctgcctcccacattcaagcgattctcctgcctcagcctcctgagtaactgggactacagttgcctgccaccacacctggctaatttttgcaattttagtagagacaaggtttcactacattgaccaggctagtctccaactcctgacctcaggtgatctgcccacctcggcctcccaaagtgctgggattacaggtgtgagccactgcgcccggcctcttccaagttattctgtcatttggcactgatccgtctttcaaagacattcaattaatcaccagagatgcaacaccataaaggagcagaatatttcaatatattacctgatatattttcttttgtcattacccttttgtaccctgtagctttctaccttaaaggctccacctacaggcagaggctcattgccttagagaaggagagacttaaaaaaaatcccaggcaaacagagggtcaagtaaccagacttggaattgcacagatgttggtgaatctacagcagccacaatggtccaggattgaatctactccatggaagcttcgaagtgggaagagccgaggatgacctagagcccataagaagataagtctgaatcagctggaggaaggtggatacccacaggatgtgtgatggggtctggatgagagcagctgggtgagaagcagcaccactgccttccttagacccaccaggatcagttctttcggtagtgatggagatggggagggggatataaaaacccccagatctctttgattaggtgaaagtaaagcaaccaatggaatgccctaattctttctgggatctcctacagcacacaaaaaaacctgatttccaacactgggtagcagcaatactgtaggtatggccccacagagtgtctatgcacagagtcctgtggtcgctggggacccaaggggtgcagtaaatacctcatgaagggcaaggaggaggtcaaagagactttctgagaataacagtatttccaaagggtgctggctcaaaaaatgaaaatatgtaagccagatgtttagcatcctgggtaagatattaacaagcttcaacatcagatgtaaagggaaggaaaagaaaattgattccacaacatccccagtttcacttcagtagaggccaataagacagaagccaacaggaaattagacttcccttcttcaggcagaacagtggtgaggccctatgggctgatcatccccaggaaaaggatgaaaggataagaagagggaaagaacccgaatgggaaagagtatttctcaaaggggcccaagttttaatttataagattaaaagaatgagggttaaaatgtaaacaaagccaccaaaatatagaaaacacagatttggaattctaaatccatgtactccattcatggaggaggtggaaacttgctgagttctcggaccactcagccagttcacagacataaaaggagacccagcggagagggagtgggtgagtgggagatcaccgccctggagagggcagctgtcccattggggggccccacctccactttttcgagtgctcttcctccacctcaagcccggtggaagccaggggatgactcagagatggggacacagagggctctcctcccagcctgaagagctagagcaggctgtcaggaggaatgtgaatacagtgggtggacctgtactccagggctgtgggaaagactggggttccccaaggaccagatgtgggcaggtggagagacagaaagagagagagacagaggaagaagggagacagagagtgcccgccaccgcacccggctaattttttgtatttttagtagagatggggtttcaccgtgttagccaggatggtctcgatctcctgacattgtgatccgtccgcctcggcctccgaaagtgctgggattacaggcatgagccactattcccggctgggagaagtcttagggcttagacatgagggccacctggagggtggcaggaccctggaaacaagaagccaaagtcaagtctttagggcagcaggagagatcagaaggggccatgcaacccggctgaatagagaggcatcattgggaggcaggagagatgcagaaaagaggtttccagcggtgcaaatgtactaagagttcatgaaagcccccggtgctgaggaatcagctggaacccttggccaggctccaagtacccgagccaaaagctctgtttcctggccccattctcctccttcctacaccctttcaagcttcctcaaacttcttcagagcttggcctgagagagagaaggaggtgaacagagagagaggagagagacagagagagagagagaagcagagactctaattaaacctcttcctcaatgtcaatgtcaggcagagaagaacctgtggcttgaaatgagcaagaaatacaaattgtggaattgattaataacttgcctgaataccaggattagtaaatttagactttgttcactacttcaactgcccacaggactgagtaaaacaaaaatcacagaccctgctgaaactgcaggaatgatttaactcctgcacacgatttaattgggcaactggaaaaggaaatacaaccttttgttctgacgttattaaagatgtgcttgctcagcatcattattgtattaagttttctgctgaagaagattaagaagagaataagaatagaataagagtaaaaaaaaagagaaatacaatacaataaaaacataaaagaaaagaatagaaaaaagagtaagaaaaggaaaagagggatgtaagtaatgcagattcaggtgtaagcacaaactaagttccatctagagactactgaaatactgcactcactttgataacccagaaaacacaggacaagatctgaacgagacctggatctgggttgtgcttcctcgatcactaaccctagtaaccatacttattagctaaaacctctgcctctagcttttcatttggaacatacatttaatatacagccctacataagttcagccaatatgcagctcaacaatatattaactaggcaagttgtatttcagaatctgtgtgagaagcggcatgcacgcagcctcccagcattcgctggtgctggggcttgtgcgtgacaacatcagggagctcttccaaatgctggtcgctcggtacccatatggaggctttcttcctctagattgccaagctttcttaccagaggaagatttaggctgtgtccacttagggccaaaataatgaatcagttcagttgttatgtgtgcaccatttatactggggtttgacagaattttaaactttttactcgattgccttgatatcatggaattattgctatttatcagtctatatttacacaaaaggcctgacatggctacacacaggccctgtggtctgataccacgtaaggcacccacagcatccctcgccagctgagatcgaatttattcacacacatgcgtctcccctccaaatggaacttattctgactttagatctcctattaggactaatgccattaactaattgtccaataatttcagcaaaattcaaagtataaaacggaagtattacctggccccactacaggagttgtgggaacctcactggcaatcagatttttcctgtctgtcttctcttgctcttcacttcccaggaaagcaggcagatccactaacttcataattctagagcaaagtggggccttacacacaagcctacgcttgcccttggagtttattttgacttctgcataggtggctgccactgcagttgtcagaatctgaaattcaggagatgccccttgacaggcagggacaccatctgatggcagtgtgacaaggagcattgttaatacaggaagggctttctaattgagagtggatacccatgcagaaattttcggatgttcccaaggccactacaaagaaacatgaaataaaaagatatatcccatgaaactacaattttggaaaagtaaaaataattacagcaagtttgtatctgggatttgttcattttaaataaaatttaaaaacaaaaacaaagcaaaagagaacaaggaggggagagggacagtaaatgggtaaaaagaaggaaaagatggaggagaaagaccaagagctgtcaaggcccacagtcgccttaaaacagaatgtgcccatccccccacccccttctatgccccccacccccttctatgccagcgcccagtacctcactccctatctgcgctgcctcccagccaggggccttgacaagcccacactctccaggaagggtatgagcacagcctctactgcaggagaggatggagacaagctctgttcttcttgcttttatgtgagtctgatactcatatcactcatctcctttctgagcattgcaggctttaaggaccctctggctggctccttaacccagcttctgaaatcccccggagctgcctgacttcccactctggaccctaagtaaacatttacagaagcagtggatgccgcttatttcttactccacaactatctatccattcttttgccaaccaaattattatgtgccaatcacattgaggtaaagcaaaaatgaacgcactttaaaaacattaaaatgtgctcagattgcaaatgtatacagctattatacccagcaggaaaaaagccaattaatttacgtatttaagaaaattttcttacttgaggacaaaaattaaaaaggggaaggaaactcatgttgaatttcacttagaaaagtcaaagtgaaaataatcagaatgtcttcagctacccaaggatttactgttaactagaaaaaagcatcgtttccatgccacctcagctttccaaatctatcattctaatccatttttaaaaaagaataaaatctgaaaaataaagtacatctccaggcctctcatattgcaaatgacgtgtccaatcatacttctacaaggaaaaaattaatggcaaagggggccaagagttaactgctggaatggttaactagaaaaggcccagtcgaaattaatccccatgatttcatgtgaatttcaagccatagcttaatcctacatgtcagtacaacaggaactgcttagctctgctaatcagattctagaatttttcttttctttttttttttttttgtaagcatcttagtttcgcaaaggcagctggctgtgatggtattggtcactctgctgaagaatatacatgggacctaaaatagctctgggtccttttcaactgtggcagtttcatcaatggcatccgttacaagatcctggtagtaatattgatatatcaaagtaccaattaaaccatctgcacaagggtatccatccacctgtgtctgataccatgtaaggcattctttcacatctggcacaaagaaggaaaaaaggcacaattctacaagattggattttgaaagaacttctgtttgaagagtgaaaagaatagatgtgacatgaatggacagatgaattaggaggcatacagtgtaataacacaaagaaattattgtgggttcatatctaaactccatcagaaaatatattcatatattctgtaacatgaacacatttaatctatagtggttgttctcagagtaacagaaaaaaaatattcttattattaagttcactttcagaaaaatataattaaaaaccacataggacaaggagagacaaagaataaatttccttgaatcatctaaaaataaatgtatcaatatagcaacataccactgtgggctcttcatccttcctgcttcattaattacagtccagtgacacctccatgcccagtcctagctaaaaatcatactctcaacactaaatattaagtctcagattctgacaagtatgttcatgtcagtagttacaacaagcaaaatatgtgaaatcaggattatagctgtgggtgctagaagtggattctctgtcctattattctccattttcacacaactacacatccatccatcttccatctttccgattctgttctgtgccctcagaggttgacacccacaggccaaatcacttgggctcccttgtcctgcaacctccagttgggttttgacaaggggaggtaccaggaggtcaatgggtacagacggaggggagagagagagagagagagagagaaattgactggggcttccctccatccttcctggccctgcttgcttgaaatctctggttccggtggggactgcaaccctctaggatttaccatccaccagatgtcccttctgctagggctccaattctcattagctctgggaacagcatttattcctcttgtccctaaagacctaacaatagtaacagcttcgcaccatgaatagttcaggtgtcttgacatccttctttgttttttttaaaactgttttcttcagcctcctatctgagggtactgttttcttctggaatctgaactgacacaccctggaattacagggttatgtttccctgaagggaagggtgacaataggaagtactaatgaagatatttccccctcaggatgacatatgctctctaatttagtgactctcccacccccccaccaccccccaccccccaaccccatgaggtcagcatggaggcaccagaggacatatttacaattcttggccttcaccttgatgaaagcagcaatcttggggagagggagaatggtaaggaaaaactgccgaggtgcaagctgtttcttgaccctgtgcccatcctgagctgtataagattctcagagcacaggaaaagaaagccagagccagggctgagccaggtggaggaggggagggctggaagcctggacctctgggaggtgctgccccgccatgtgccctgagggccttgatgtgggagcagaagagatggcctggtgtgtccaagacagtgagggcctggttccagcccccgctcttccaggagctaaaaagagcctccacatcctactgcactgaaaagaggagttggccttgctgaagggaggatggcccacaggggctcacagggtcagggcaaagggttgctcttggggaaagctgcaaggaggtgtgaactggaggcagagctgctggaacacatctcagatgccaaccttaacagcgaagacgcatcaggcatctcagccccttcgggcagacagagacactgtgctggatggtgggacgctgcccatgacacggctcactgtgagctcccgacttagattcaatgccagaaacaggggcagagaggccaatggctgaatagaggagacttccaatctgaaacgcttgagtgtctctcccggtgggtaagattctggtttttacccttaggtggaaggtggaatgggcacactagaacactattcttttctccctctttgtgagcagcttcttcgataaaaacagtctatttttttcccaggtgcacccaagtgttcagtggcttcagtgaataaagtcactggaagatatggggctcatttctatttaattagatataacttttcattatcattattgtgaacttggctttaaattatgcaaatatatataaactatacattatcacttccctttatttaatcctttatatatatatgtatttattcctttaaataaatatatacatatatttattcctttatatatatgtgtgtctataggtctgtgttttcatggccatacagtgggctgcaggccactttgcaggaattcttcctacctaccacacttactgcttagcacacaggtgttcaaaagacatctgtaacaaataactaattacacataattgtaaagtaaagtaaagctagaccaaaatgacataaaatctgaatcaatgtttccatgcagaaaatcctagctttcactacagctttattcatttcatacttatataaaatactcatggtatttttccacatacttagtgctgagttacactcatgtttgctttccattctctgctgtctttttttaataatacagaaattttcatacaaaaatgtactgaacacgtgtagtagcattatagaatcagagcagtagctgcaaatgatttatgaaactatctactctggataatacaacagtgctatacatacacaattacttcataaaatatggaatacaaacatgaataggaatgcctatgacattcaatgtgttttgtcggcctttaaaaacttatttctgaacacagtggcttttcttcttctttaaaaaaaaaaacacattctatcagaatccatctaaactatttcagagatgtgaaaagctgtcatatttgcaaagaccaacagagaaaaaggtattacagttatccattccacctcttgatgccagttaaatatctttgggagctcatttaggtttctaaaagagaagatcatgcaaaatgcttattttaggtctccttaatggagactgaagaatgttatgcagctctctgcgttttttttttctttttatgtctaaattatttgacttctttaaacctttcacctggatacttttcaagttttccacatgcatctttaatagaggaggcctggaaccaaccaaacatagattagaacacctcacttctctaaagttaacctttatcgggcaagctcagtcactcaagaaagagtcaagagccaggatgtagacaaaagaccactgagctgccacatcttcacaggaccaactaacaggcaacagaattgcaccaaagcttgaggtctgtaacctgtactcagatccatcgtaacccacttattctttttgtagacaacctaccaacaaccattaacaaccttgtcttcaacctatacattaacaaaataaaatgcatgtcaggacacagatgacagtacctaaacaccaatagcaaactggagctgatggtggagctacatccacagacatgcactaaagaagaatagatttttttttaatggatgcaatcagaactccacagttttataacttctgaaaaaaagagataatatatttatctagtacttcttatacatgatttttatagaagaaatcgtttaattgtatacacatatatcaacataaaaaaaaggccacagaaatgcaaaaacttttttaaaccttccaatgaccaggaagatatgcactatgatttctcctttgtgcatcaagcgctttgggagctaaagaggcttgccaaagtaaagtagcgcgtccatggaagagagaagaccagattccaggccatttaacccccaaggctactgatctttgtagtatagtcaaagacgcagactcagcattcttaaacttctgattgcctttcactcacttgcctgctcttgcctcctaaatatatgtctgttcttaggaactgtatttggtctttgtagtagtcagtgagggatgccataaccaaacactactgacagggcggcctagacaacagacactgattttctcgtggctctgcagattgcaagtccaaaatcaaagtatctggacgtttggtttctcctgaggcctcctgcgttggtcttcagatatccattgtcttgctgtgtcctcacatagccttttctctgtgtttgtgctctcatggtatttctgccttttcttaaaagcatgccagacctattacattagggcccaatacttacagcctagtttaacatgaattgccttggtaaagaccctatctctaaatacagcctcactggggaggttaaacttcagcaaataaattggccggggcggggggggggtgcagaattcactttccctgaaaggcatatttattctcaatgcttcgattatatctccaatatgatgtacaccaaacctgtctcttcaggtctcaggtcttatttgtgctacagtcacaaatgtatttccaactacctacgcaatattctcattctgatatcctgttagactaaacttgtatcaaaccaaactcattggcatcctggtcaaagacattttcttttctcgtgtccttgcattaatcaatggtttgatttggtttgaactacttttcactattcctgtcttcctcatttctccagccgataagcaagtcttactgataactctgttcaaaatgtgtttgcatttagtcattttatcctccccctctaccacttgagtaaaggccttcataacctcacacctgaaagagcacgataatcatctaccaccttggacccaaggtagatgctcaaccttatttaatgccctcctattgtgtatgagaggaatccattaataggatggtatgtcactcttattgttaggttatgttataagacataggtagctttaagaaaggattaacctaagttagacttaacctaatcaagttaccccttaaaagagacgtagctcatcctggtgaaggagacttcaatcatgagagaaattcaacaagaaacagattgttcattgttagctttgaaaatgaagggagcactcactgtggcacggaatgcaggcaggtgacagtccccggggaagagccagtgaggaatggagtcctcaatcctacaaccataggaattgaattctgccacagctacctgagcttggagaatgaccccaagctcctaatgagatttcagtccttattgacaccttgatttcaatcttgtggcactccaaacacagaacacatctatctatgttatgccaaaacttctgagctacagaaatggtgagatcaccaacaggggtctctttaagactctagatatgtggtaagttgttacacagccatagaaagctaacattacttggttaccctctaattcacctcccactgccacatttatatttcttgttcaattagttcattattttggtgcccttttaccaacctcattgaacattatcataatgctaagggcctatgggtgagtattatatgccttaaacatacacacacacacacacacacacacacacacacacacagacacacacacttcccagagaaagcagttacgtgacttttggaaacataaccaaactgtcaaaagaacataaaactagttactcatatttggaaaggtaattcagtactatttgttctgctatggtgtaaaaaaaatccacaatattttaatggcaatagttattaaatagtgaaaatctagcagcatttacatcaactaatgttaagttccataagtactatgcccaaatattattttatcccttatcatgttaattcctgccattgaaacttacacccagttttcaaagaactttgatttttgcctcacctaagacagcaagtctattcccccaatttggcaatacaaaaacttttgtttcaggcaagccaatgttctcagtgctccactgtgcatctctgttcaatgcgattcctttcagaaccacttatgaagaagaattcctctccatcaatccaaacctttgagatgcatctatgcatctatgaacttcttgttcataaattcattaattaacaaacatgtactgaagtacctactgggtatactagaaatgatgagatgctttttcattggaaattggttaaaactaataaagattaggaagctgtaaaaaaaaattagacaaagatctctatgcaagaatatcaaattatactggtcaaaattcatctctactttacaaaagatgtctgtaaaccacaggaaggagacattgtttttaaaagtatacatgtatagttggctatcttttgcttaacagagaaggaaaataagaaaacatttgcttatctttaagaaaacaagctcaggaagagtaagctggaaacatggcgttgatggaacacaagtggtggatggaggtagtggagggccaggaggaggcaatgggaggataggaatgaggagggaggcagccttctctgcagggaattttttgtatagattttgctcctggaaatatgttaaaggtccaaatacattcagtcaacaaaggcaggacaatcctataactgaaaacatactgaaacaaataaacctaattatatctcaaatggatatcattacctctgtgaagggagaaaaaaaaagaaatagaagtaatccaagtgattataattcatttggaataggccttttcctcacctctgaattgcaggggttgttggtatttaagtgattgaaggtcgtctcttatgttgccgcaatcccctattattttggcaggactcatgactcgtctaaatagtcagttttcatcttttatttatgctgtttttttctcctatgtacacactatagaaatggaaacttcactgtagtaaacttttccctctttgttaatgaccactgctggcctaaaaatgttacctttattttaacactgctgcctatggctattagaaaaagttgtttcacacataaacatacttcttggaaccaaaaactttccatataactaaaatgtaatgcttgactcatccagttctatctatctatctatctatctatctatctatctatctatctatctatctatctatttatccatctgtccatttatctatctatccatctacctgtctatctatctatacttcccccacacttatatatgatcctcttttaacgacttggggaacttttcaacattttgttactccactggcttttcacacaaatggggaaaagacagacttaagggtaccagataaacaaaaattactaaatagctaagagcaactgtctcaagggtcctggggacctggaggccctgctgccaatgctgggacccagcacctccactccagctgctgctgccagatgtgagtgccagggtagtcagatgtgttgtttaactcaagtgaaaatggaaatccaggtttttagatgtaatcaaacagtttccaaatattggcattcaattcaagatatttatttctaaactatctgagggccactcccaacccatctataggtcacattcagctgctgaggacattgtgagacctcagatatggaacaacaaagccaactagagatacctaagcaccaagttatgtattacaaacaagatttgcacacaagggagaaataaaactgggagcagaagtggaaagtgctgcagaaggaagacttgaactgaatttagaaggaaaacactacatcttagagtatagaaaataaaagggaaaaaaaagtttgccaatatgtcatggctaattatgccctcagtgtctttgtaaacggaagtgccaggccactattcactgaaacttagcttggttttaccaaacctcgaaaagttaatattatgatacatccagaaagatgaagataaacatgacatgtttataatgtgatttccccattctacctctaattttttaaaaaaattatcattgctttttttttaaagttgtgagtatgtttcatataatgtttctgatcttttctcaatgtccagttgtttttacttcttgctgggtcagagtataattcttgaacgagcttcgctcttatttccaaatgcttttagaccatgggtccaaaaagccatattagctagaattttgcataaactgaagataagaaaactatgagtgcatgacattcttataagaaaaatgttttggtttttagtttcctaattaagttttgttaaatcaatgttgtcagctctgacttctagtgtctctgtgtcactagcatttgattgctgaataagtattattttggtgtattttaaagtattattatctgtcacaatatatatgattttggaactatttgtaagtatactgaaaattctatatctaaaaccatatatacatttatcatatagatacacctatctatagtatctatatctgttttagatacatattttacatatatacatgttaatgtcatgttaatgacatgttgatatcatctcttttcttttacatgttttaatctttttcttgctcaattcccttgactatttcacaatggaaataaaaaagaagttcttaggaccaaatcttctataaccttattacacaattgggttatttctattattttttaaatatatggaaaataatcttcataagttccctttctcccaaatagtatattgtaaatattcttatacaattaaagatgggtcagaaaaagaattctacaagaagtaaccctaaatgaaccctagtctacataacaaaagatgtacaatggtcagagatggcctgactgagggtgtcgggtaatttggtaatgctggttcacaagaaatgatggttctaaggggctgcagggctggagagagtaccagacacccctctctgtggaggccactttctagtaaatgatcagctggtgttaacccctatggggcaatttccaatatgagtaattacttcttgtgcatctaaatcttccctgaatgtgcagctgggaatactttcattacatgttattctttccacaccataaattaatccctacacgtgctgtagatcccctgtgaatctcaaaaaggagttgcgaagattaatcatttaatttgtgtgaattgtgtgaaaattgttttcccctggctctttgagaagctcagtatatgctcagctgcacacaacggaagtatttgaacaaattaatttactgagcaactactatgtgtccggtactacgccaggcagtgggagaatgaagaaaattattagacaatctctgacttcaagggatttattagctagtaacaaaactgaaatgacatggttaggccacaacctcaaatgcctatggccaacgaggcagagctaagagcaactgtttcaaaggcccaggcacgctgccaatgctgaggcccagcacatccactccagctgatgctaccgatggacacgatcaccagtgtgtccaggtgtgttgtttaactcaagtgaaaatggaaatcctgctttttatgtgtaattaaccagttctccaatgttggcattaaattcaagatttgtatttttaaaactatctatctgtgggccaatccccacccacctataggtcacattcagctcctgaggacattgtgagaccatggatctgaaacagcaacaacaaaaccagctagcgggatggtgtggtggcttgtgcctgtaatcccctcaatttgggaagccaaggcaagtggatcacttgaggtcaagagttcgagaccagcctggccaacatggtgaaatcccatctccactaaaaatacaaaaattagccagtcatgctggtgggcgcctataatcccagctactcaggaagctgaggcaggagaatcgctttaacccaggaggtggaggttgcagtgaactgagaccatgccactgcgctccagcctgggcggcaaagagacaccgtctcaataaaaaaaaaaaaaaaaaacaccaactagatataactaagcagcaaattaagcaccaaattatgtattatgtacataataaattatgtattacaaacaagatgtgcatatatgggaaaaatgaaactggaagtggaaaatgccacagaaggaagacctgaactgaatttggaaggaaaatactatacctttgactatagaaaatgtaaggggaaaaaaacagtttgatgacatgtcatgattaatgatgctctattgcatgctaatacaatggagattatcctaaatgatggagacatgaccttcacagaaaaatctggaaggcactgcaaacattgaataattttcatataaactcagatgtgaacaacatccatgctcccaaacatttctccgctagtaataagaagatgattatgaaaatgaaaaccttgttcctttcagctattacgatataaaaagtggttattgttaatacattgtgagatcaagagtgttatacagacaagaatgatgaccctaacatttgctttcaagatgttttgaaatatttgtcaagctggtcattgtgtggagatgacatttaaggattaaaggctctttgcaaactcccctctcctggccatgcctggcctatgcaggatcctttctaataagaaaggatgcaaatgcatgggtggtgacaggcacgtggccttcttcaccgtcactgctaccaggaaccgagggatcactacacatgtctcagttgtttgtagcccctcagggtcaggaaacacctttcaaatccacgttttatttcctgatcgatgaaatgcagccactgtggcatattcatgcatctctgctaagaaagaaataatattcatgcatctctgctaagaaagaaaagtcaaaaatagaaggggaaaaaaaactttttgtgggaagagagaaactggaacaaaatgggttggaataaaagattgatgaagaggtattcaatgcttgcagggaaaaaactgggaaaacaattgatgtcaggaagctttagataagacactcaagaatttcattttaatatttattgcttgtagtgaaattgatcggtatctccggcatgatgaggtcatgaaagaagagattgatgcaggcaaattcattatttctgcttctgttctttctgttttgatattagtctattttctcccaataaactatcctattgcatacctcccaacttttgccatttgtggtaatgtaattttcctgtcatcttttatgaaatactagagtacccatctgttgtacgggtagggataaaatagcttccttcagaagaaaacactgactgtaaacagccaagccccatgaaagacaagtgaatcttctagtggtcctttatcagattatattttctggtgccagggcagcccatcttgcttgaccttttttacttatgtacatgagaaaaaccgtgggtcctaatcagtcatatgataatattctgggtttttttttcctagcatagttattcaactaagatattttaatgcaaatactctgatttcaatttattgaaatcaaggaaataaacataaaaaaatggaaacaaacaatgtaatttagtcaggtatcttgaaagatcaagcactacattatgtgtctcagagactggcttcagaagtcagccgctgtcctcagagacatgactgaccttaaaacgcaggtgacaatgataccccttttcctcagagattgtagcaaatcccaactcaaaatctcacaaaaacaaatcacaacaacagagtctcactctgtcacccagcctggagtgcagtggcatgatctcagctggctcactgcaacctacgactcccaggttcaagcgattctcctgcctcagcctcccgagtagctgggatcacaggtgcctgccaccatggccaactaatttttgtatttttagtagagatggggttttaccatgttggtcaggctgttctcgaactcctgacctcaagtgatctgcatgcctcagcctcccaaactgctgggattacaggcgtgagccagaaaatcacaactctatccagaagatgctcctgaatctgacatccagggggataggatcagctgccttcttggatgtggtgaagggatctttatctcagctgtcttgccgaataagcacatggagctgatttcgattgtgcactgcagatcagcaaaaatctttctacttacactgtgcgtaagctgtatggaaaaagttgtactgttgaaattatttttaatattatcacattgtaattgttagattagattttttttaacttttaagctcaaaggtacatgtgcaggatgtgcatgttagttacataagtaaacttgtgtcatggagttttgctgtacagattacttcatcacccaggtattaagccaagtatctattagttatttttcttgataatctccttcctctcatcctctgccttccagaaggccccagtgtgtgttgttccctatatgtattcatgtgttctcatgacttagctcccacttatatgtaagaacatgctgtgtttggttttcccttcctgaattagtttgctaaggataatggcttccagctccatccatgtccctgcaaaggacatgatctcattcttttttatggctgcatagtattcaatggtgtatatgtaccacattttctttatctagtctgtatgagaatatagacgggaagacaaagagagagtaatgaaagataagagctaaagtcccaccaaaccatcttaatttttgccaccaacttaggatacttccctcatgtcacatgtcaaccaaaactgcagctgtctgatccaccgtctcatgtccaggccaggtggcctctcaacatctgtaataccataatagcttcttccttggatgccctgcctctaccaggccagttccccaccatagccagagggccgaagtcctagcaggtgccatggtgacggaagcagaggatgccagaagcagaggatgccagatgcagggtcaggagctgaggaaagcaggcggcctgcagcaagaaaatgggtccctggagcctgcaggagcaacagccctgccgacaccttgttttctgcctggggcattctgacctccagaagtctaaaggaagaaatttctgttgtttaagttcccacgttcatggtaattgtggggtggggggagcggggagggatagcattaggagatatacctaatgtaaatgatgagttaatgggtgcagcacaccaacatggcacatgtatacatatgtaacaaacctgcacattgtgcatatgtaccctagaacttaaattataataaaaatatatatatataaaaaaaagcagcaatgggagactttacagtactggatacatgaaggttttatgtacaatttttaaaaactagtgaattcaaaacaactgacatacctttagggtcaatgaaatttgaaacaaccacagcaaatactttgttagtgtccatattattacataattattaataacattaagtataccatcttttcagtatttaagtgaaaatttacaatcattcagtaaggaaagttttctgatgaccatagcgttctttttacttggtaactgaaatagtgaaaacagaaaatcataaaggctatctttttccaacaaagccctgactggaaagaaataacaaggtcatagtctctgctaacaagggcaactaactttcctgtaacagttgaagttttgttatagtggtttgaaagattgctgatttataactttgagatttaaaacacttgctataagaatagatttgttaaaatatttgttgtagcaaagaaaaatagctgtgaaagatgcttcctgggagatggtttgtacctggcaactcataatcattagctcacaatgacttcactgatctgggtctaatcaaagcatgaggaatctgaaaatcagaaacatagctaagttattctcccctgtaaaatctattatacaggtgaaaataaaagttactctaacgacacataatctcaacttgtttaagtaataataatttttttcctttttttttttttttttttgagacagagtctcgctctgtcgcccaggcaggagtgcagtggcacaatcttggctcactgcaacctccacctcctgggttcaagcgattctcctgcctcagcctcccaaatagctgggactacaggtgcgtaccaccatgcccagctaattttttgtatttttagtagagacagggtttcaccgtgttggccaggctataaataattattatgtcatattcttaagactgctcagtgcttagggtgagaaagccttcccaagggagggtctgttctctcctgcctggtcatagggcatagtacatctctctccatttattttctattctttgagacaattattcctcatgttccaatattctttttcttttcactgtctttctgtcttgaataaatctccaacatcccccacaactatcccttttaagtttcagatacccagacaacaaagcacataaccaagacgcttgatcacacacacgtgcatgcatacacgtacacacttatacaccatgcatatatgtgtgtgtttgcacacaaaaatcttgcttcgcaaacagaaggcggcatgtaaataactgcttggaactcattggcagataaagaaacagaggagatgtcaattatttaagataacaaatgggtcttttctcttagtattgctcccctgccagagcaggttcaatcttaagaattttacctttatcccacccctctgccactgtttcattttatggccttaggactgtcatttggcttttccttgaccagttctttccataagacttgctggcctttgtttcctttctgatttttactgttctcttgtccttgctgccctcactgtaactggcttctgttcatttctccaacctgtcaagagcatttagaatcccattcctacccagctaggttctgttgccccatctgactttacgacatcctcatgcaaggtgaccatgtactctactccatcaccccagtcactgacgaagagccctgggcacagggctgacccaggcgatacaacacctgtgtctgccaagttaatggcattccattattaattactcgttaggagaaatgtgtgggatgacaggggataacacacacctctaacattcccagacatcgaagcaagcatctcatgggcttctgtggaagttcatttacataagtggttcttgatcctgatcttgtagaggtcataaagcctttgtggatcggataaaagctatggattatcttttcgaaaagctgtgcacacacacatgccacagcattttgcataaaatttcagaagattcaaggatttcccttgaagtacatctctagaactcctggagtttagaacattcaggttaagagtatctagtgaaggtaattttaaatattgtagcatctacattatctttaaaagaaatgtacactagatgccagaagaaaatataatttgaaggattttctttaatctagatgatatcacatatataccttaaaaataatcttgattgacctatgctctcaggccaaagaaagaattattcatgcaatcaaatgaaaatgatttttttctgctgtaaaaagtaaaattattttttaaattgtggtaaagtacacatttcatacaatttgccatcttacccatctctaagtgtacagttcagtagtgctaaggaccacagttgtgcagccaatctccagagccatttcatcttaaaaaactgaaactctatactcattaaagcattacacaataactctcaatctcccccttaacccagtccctagcaaccaacattttaccttctagtctctatgaatttggctactctaggtagttcacagagtatttttctttttgtaactggcttatttcacttagcatcatgtctcaaggtctttgttgctgcatgtgtcaggatttcatgcgttttcaagggccgaataatattctattgcatgttgcatgtatatactgtatcaatttttttttatttttttgaaatgtagttttgctcttgttccccaggctggaatccaatggtgcgatcttggctcactgcaacctccacctcccgggttcaagcaattctcctgtctcagcctcccaagtagctgggattacaggcgcgtaccatcatgcccggctaatttttgtatttttagtagagatgggtttcatcatgttggctagactggtctcaaatccctgacctcaggtaatccacccacaccagcctcccaaaatgctgggattacaggcgtgagccaccatgcccagccgctgcatcagatttttgtttatccattcacacatcaatgattacctggattgtttccaccttttggccattataaataatgctgctgtgaacgtgggtatgtaaaatcaaatttttagcaaagaaatcttactgctgtgtaaatactattgtttgttttaaatttttgaaacttttaaaaatcatttcattgttaggcacaactgacaaaaagagaagtacacaaaacaactcaatgagtcatcaggtagcaaacagtcatatcgccaccacccaagtcaagacacaaagaaggtttccatgtagcgcttgctctctgaggtgtgtctactacacaacacagagttcccatgcagaattaatctggtctccccaagaatgctgccagacagagattagtaatcccatgttctgggttgagtaaagggaagcttagagaatgtcttacaaggtcacatagctagtaagtgatagaaataggattctaaacatcagcctttttcaccccacctccacatgggttggactacatagaggccagctggtgcagtaaaacacatcaattatattaaaattatccagaggtataaatgtgactcatacttggttaatgaccacattgtttatccttttgatattcttcattgtgacttctgaccactgttctaattttgccctttagagtaatttaaacagatgccttaacatttccacatgcaagatcctaagtagctaaagaccgtgggcacatccccaggaagactcattcccaggaattctccctaggttctctcagggaacggcatctccaggcaacttactcccctgactgtcctcttgtggtcacattagtgtgttaacacccctagtaagtaaaggtatgtccagaactgacactgaattttagatgttcactatcaacccaacgaacagttcattcactcattcaacaaatatttctttagagctttgcactattccagactatacctcctctgacaatgctttgattaatgcagggaaagtcacaggcacatttttctactcttgccacactgttgtcttatactgaacatgggatcaagtaaaatctgtatgcgtttcacaggaactactgccaaggaaggtccccagcatcctatatttatataattggtttttcgaaatgatctttgtgctgtcttcacagtagatcaccagggtttcatgtggtaatatttcaaaattagtattttggtggttgatcaacagaatccaataatattttttaaatgttttttcagactttaaaagttaaatttttatatctgtttagaaagaatcctttccttccttatatgcctctccttccttaaaaacaaacaaatgaagtgtgtataattgttctctgttgttatggtttgcatcttatagccatgaactctaacgaccgacttcctatgtgctaaaagtggtaattgatctaactgcattacaatttttcaatataagcaactagttattgaagtggcttaatttggcaaggaaacacctaatgagtcaatggctttattcggttaattcagtgaaaagtgctaatgattcagaaagtttaaggagttattgtaaggccgcctgtaggaaagtactaataaccaagctatgaccaactgcctcaaaagcagggttgccagggtaggcaacttaggatacaaagcactcagtgaaatttgcatttcaaatttgttgttcatctgcaattcaaatttaactggttgtcttgtgttttatctagcaactctattttgcagccttcaacatagcaatgattaattaacaggagatgttaataccagatttacttctccatgggcattcactacccacaaaaaaggtagccaacgtattttgatgtttgacttctgcaaaattagaagacataagtcttttttggaaatggcttaaaaatagaaggggcaggataaaactgcagatgccaactgtcattttccactccatccattcatttcataaaattatacagccagaaaaagatcatttagtccaaatctatttacttagaaatgtcacaagaccaagaaagtatcttacttttcaataattcctcagaatctgacttcgcatctactcaacctatttcattttggatgctgtaaggtcttcagagctagaaaggatgctgcagtaaatctggccatcaggcagctaacaaagagggcacaccagacagcagacaatgggctaatgctggagatggccctggaagggcatgggtcaggttctatgatgtcctggtgatagaagtattccaaggctggacagttctgcaaaagggataggagctggggaaatcaagaggagcagtggccaggaaaaatgtgcgtgacttaggcatacaagatgtataggaccatgaaaaatgggaaagcaaaactccataagaatttttggtaggctgctagttttttaagttacattccacagccggatgtgatagagtcccagtcatgatacctcatgtcactggccaacagggttgattgagccacaaccaggcttatgaagttggctttgcccctactcactgcttcagctgaatatctccctaaactgaacattctggtaaaaatgacatcttcctagaaataagaccaatttaagcataggtgagattcacagtctataatagagaaaaccataatttatgactttttataagctaagtttatcattgctaacactgttctttctttcatgcacacattccaccgacaaacagccaaaaattttaaataaaccaaaaggattcaatacatattcacagttctagacttattggctctagaaattggggccttttccttttgttttatgctaattaggcttgaagtcataatttcccttaaacacatgagcactattaagcgccaattctggggtatttaaagagttacaaagagagtgcaaaaggggaaaaaaaacatgaatacgacctcattcctttctttaaaaggatctcagtatagttaatgaaataagacatatttatatgaaaagttggcatatattgcctgtgcttttatgtaaaagctgcattagtataaaaaacagtaaagattatagaaattcaaagaatccatatcacttttgataggggtgctcaaaatttcattgcagtaaaaaaaagagggaattgaacctggacttaaacagttaagattcaagtaaaactgattatttgagcatctactcaacggggagagtaggcttattcacatatattctctaaatttatgtcatttcattcaaacattaaagcatatcatttaccaataaagcctcaaccatttacttcttccatatttcatatataggtaatgatatggtttggctgtgtccccatccaaatctcaccttgaattgtaataatcctctcacatcaagggcagggccagctggacataattgaatcatgggggcactttccccgatactgttcccatggtagtgaataagtctcaagagatacgactgttttataaatgtgagttcccctgcacaagctctcctgcctgtctccatgtaagacctggccttgctcctccttgccttctgccataattgtgaggcctctccaggcatgtggaggtgtgagtcaattaaacctctttgctttataaattacccagtcttgggtaagtctttattagcagcatgaaaacacactaatacaggtaatgaggtatgctagtagaaattaagtttgtactgtgtttgttttccctatgtcttgggaacagatgtatcagaaactcacacactcactcgattggggagaaacgtggggattctctctacaaagagcacaatcactgaaagtagtctgcctgaaggatagtgtcctatttcaactttgacatgtgatggctcctgagggtagagcattgaaaagaaggcaaaggatggtcgagatacatcccattcacctatttccctgtctcaagtaaatgtatatcctgggaaggacagacagacatgtaatagggagaagtgaggtggctggctacattcagttcagtaattgaatatagatacaggtattggttctgaagtttttttaacatggtaaaatatatatataatctacctttttagtcatttgtagttgcacagttcagctacattaagcatattcacattgttgtccaaccaacaccaccatccaactccagaaatttttaattttcccaaactaaaactccatacccattaaacactcacttcctgattcctacccctctccaggccctggtaactgctattctattttctgtctctaggaatttgactacttgagtatctcataaaagtggaatcatacgatatttctgtgtgactgcttatttcacttcgaatattttccgagttcttccatgtcatagcatgtatcaaaattttattcctttttaacggtgaataataatatcagaatatgaaaaatgcctacagcagcaaaaagtaagccaaatagatgtgaagccaacaaagggcctccatgttatatacatacataccacattttatttatccacttattcattgatggacatttagctactatgaattatactgctatgaacagtgatgtacagatatctgttcaagtccctgccttcaggttttgggggtatatacctagaaatgaaattgctgggtgatcatctatatttcagttgtgtggaaccaccatactgatttccacagcggttgcaccagcaaagtacaagaatttctatttctctacatccctgttgaactttttacttccttttttgttgttttgataatagttatcctaatggatgtggtacttcactgtggttttgaccagcatttccctaataattagtgatgttgagtgtcttttactgagcttattggcgtgattatgaagatttgaaagttacattttataaacatagcatcaatccaggcaggccaaagatataacatttgtgaaagcaaaaacgaattgaaaaaacacaaacaggtgacttttcaatgccattgatcagcatgctacatttagtacttaaatactgaaaaagaaacttaaaaatccaaatatagaataaacggttaagtgtattacgaagcacttgtcacaaaagaacactaagttataaaagtaggaagactggtaggtaatacaccaaaatgtttaaggtggttatttttaagtgtgtttcataagtaagctttgttttattctttacacagtcttcatccttggcactcaagaaatatttcctgattaagtcacaaattgatttttttataatagtgtgtaattacgaaataagaaacaaacatatttgttttaaaaggaaaaataaagtaaactagtaaattggttctgctgtacattagaattgtctagggagcttttaaaataatataaatgtgtggtacttctcttcatcaaagatcagaatctttgggggtggaggagcccaagcatctgtaatattaatacacaaagaaagttgagaactactgttgtggaaaataagaatgaattaggccctttggaagtgttctcttcatcgtccgttgctgcagttgattaaagatgaaccactcaaccagcctaaattgttgacccacaaaaccatgtgcaaactataatagctgttttaatgctctaagttctgatgtggttacttacacaacaacaaattattaactcacttaaaattttccccaataagggcttattgtgtgttaggcacaatacaagtgcgtaacattcattatctcattaaattgtcctaacaaaccaataaggaaaatacattatttcaaatgaaaataggcttgggatgcttacacagtttgctctttagcatccaattccaatcactaatatactaacatttgcctaatataaattagaggaaattaagagagacaaattgcaagatattgcattgtaaatacataatacatacacaaatacacaaaaattcattgtaaataattcatcagcatgcttatttttcaactaatgtaaacactcaacattaggtagtcagttaggtatgcctttggcataactgaataatatatataatatacattgtactcattaggtaacttctcatcattcatcctacttccacccacttaccctgccaagtccattgtctatgactgcacactccatgtccatgtgtacacattctttagctcttacttataagtgaaaaaatgagctatttgtctttctctatctgacttgtttcacttaagataatggcctcccgttccattcatgttgctgcaaagtacatgattccatgttttctatggttaaatataattttattgtgtatatctgccagtttctttatccaatcattcattgatggacacttaggttgattccatatctttgctattatgaacagtgctgcaataaacacaaagtgcaggtatcttcttgatgtaatgatttttcctttgggtagatacccagtagtggaattttaaaactgtaatagaaatacaaaaagccaaaaaaaaaaaaaaaaaaaaaaccaagcattttaagatcaaacaagcaaaaaaaaccaaaaaaaaaaaaaaccccacaaaatttcaagatacttcaccaaaaaaaaaaatatatgaaaagcaaataggtaaatgaaaacatgtgcaacatcattaaccattaagaatgtgcaaattaaaaccattaagacaccactacacacctattagaattgttaaaaataaaaagactatttcaagaattggccaggatattgtgctgctaattgggaatttaaaattatataaccactacaaaaacagttttgcattttcatgaaaggctaatcatatacctcatatggtctagccattccactcttaggtattacccaaaagaaatgaaagtttattatgaaatattgaaaaaatgaaaatgcatttctaaacaagccttgggtaaaagaagaaatgaaaatggaaattaataaaattcaaaagtgaatgaaaatgaagacataacataacaaaatttaggggatgcagctaaagcaatatgcaaagaaaattttttgggactaaacagaaaaaagtttccaattgtcttcacattccaccttcacaaacaaaaaatgaagagcaaatgaaaagcaaagcaagaagaaaaaagaaaacaataacgatcaaggtgaaaaatcactggttgagaaaacagaacaataggaaaaagaccatgaaaccacaactttgttctttttgttgatcaataaaaattatactgtcttgtcaggctgatcaggaaataaagagaaaggatacaaattaccaatgtcagaaacaagagaagtgacaacactacacattgtagagataccacaaggataagagaatattctgagcaattttctacctataaatttggcaacttagatgaaattttacaattcctgtaaaggctaaacacaaggacctactaaatttcaagccagagagaaaagaaaacttgaatagacttatgtctattgaagaaactgatactgcattaaaaaacctcaaacgaagaaaacttttaggcccagatgtcttcactaatgaagtctatcaaacatttaagaaagaaaaagaagcaattctacacaaatgcttgagaaaagtgaagacaaggcaatacttccaatttattttttttcagccattattactttgatacaaaaacaagacaaagatattgtgagaaaagaaaaccgaaaatgaatattccttaagaacacagaaatgttaacaaatagaattcaacaatatgtcaaataacgatacattgtgactgaatggggtttcacccaagaatgcaagtttgatttaacctttgaaaatcaaacataatttaccatggtaagagagtgaaaaagagaaatataatactctcataaggtttaaaataaaagcatctgacaaaaatctgaagtctgtcttatacagtcccacagcaaattaggaaaaatagagaactttctcaacctgataaagatcatctatgaaaatctacagttaacattacatttaatgatgaaagattgtctactttccctctgagattgaggccttaatgttaagtcttacaacttccactcaacattatactggagctgatagccagtgcaataagtcaagaaaaataaaatgcataagattagaaaaaaattagaaaattcctattctcaaatgacttgattgcctccatagaaatttctatagaatctaaaaaatgtcattaaaactaataagtaaacttaacaattatctcggttataaagtcaatatacaaaatatctaaaattggaattaagaaacaccatttacaatagatcaacatataaaatacgcaaaaataaatttacaaacagtttgtgtgaattgtacactgaaaagtataaaacattgctgagtgatattaaagaagaaagacctaaataaatggagcagtatttgctctggaattggaagacgtaacattattaaaatgtcattattccccaaagtaatctacagattgtcaatcaaaatcttagaagatggtgatagaaactgacaagctaattctaagattcatgtgacaatgcagagaacctgaaacaggcaaaaacattttgaaaatgtagtacaaaattaaaagactaacaccatctgacttcgggtctcattgtaaagctacagaaatcaagacaatgtggaattgacatcaagataaataaatatatcaatggaacaaaatgagggtaaattcaaaaatatgttgaccattgagcttttgaccaagtatcaaaggcaatttaattgataaaggacggtcttttaaacaaatggttctagaacaattgactatccattataaaaatatgaactatggtctatatcttgcatctcttgcaccatatataaaaatgaacttgattcacaatagcaaagacttggaaccaacccaaatgtccaacaatgatagactggattaagaaaatgtgacacatatataccatggaatactatgcagccataaaaaatgatgagttcatgtcctttgtagggacatggatgaaattggaaatcatcattctcagtaaactatcacaagaatgaaaaaccaaacaccgcatattctcactcataggtgggaattgaacaatgagatcacatggacacaggcaggggaatatcacactctggggactgttgtggggtggggggaggggggagggatagcactgggagatatacctaatgctagatgacgagttagtgggtgcagcacaccagcatggcacatgtatacatatacatatgtaactaacctgcacaatgtgcacatgtaccctaaaacttaaagtataataaaaaaaaaatgaacttgaaatggatctcaccaataaatgtaaaatctaaaactgaaaatttgaaaaaccacttatagaaaaaaacataagagaaaatctttataatctttgcttagacaagaatttcttagataataatacaaaaatctataaaaatctataaaagacttcatttattttgactgtcaaaataaaaaaaattaaagacttcaaatttaaagatttttttaaaaagccaaatattgagagaatatcttgcaaatcacatatttgatatatgatatattcttgtatctaggatatatataaaaattttcaaactcagtaagaaagcaaacaatcatattgaaaatactaagaaaaagatttaaacaaacacttcatcaaagaaaatacttgagtggcaaataagcatgaaaagatgtgcaacatttttagtcattagggaaacgcaaaataaaaccacaatgagatactactacaaacctatcagaatgtctaaaattaaaaaggctaatcataccaaatactggtgaaggttgggaataactgaaactcccatgcaccgcttctgggaacataaaatggtaatcagtttggaaaagattttggtgatttttacaattgagacataagctgatcatatgactaagctattctactcctagaaatgaaagcatatgtctattcaataattagtacacaatattcagagtaactttatttataacagtgcaatagccaaaaatgtgataaaaacaaatgtcaatcaacaggtaaatgggcaaatactgtggtaagtctacacacctgtatacaggtgtgcaactttctagtgtgtagatttaccacagtgtttacccacttacctgatcatttgtttttatcacattaaatataccagcaacatgaaaaaattttaaaataattatgtttaataaaacaggccagagtaaggagtgcattctatattattccatgtaagtacattatagacaatgcaaactaatctagagtggcaggaagcagattagcagcttcttgaggctgggaaagagtggggaaggtgccgcaaagcagcacagagaacttcttggggaatttctgtgtttactgtcgttactgtggtgatggtactgaggtatacaaagacactaaaattcacaaacatttatatgccagatacatgcagtttattgtatgttgattatgcctcaataaatccacatgaaaagaaacccaaattaacccaaaattatttgtaggggtaaagtaaatgcattagaatacaggtagacaaggagatactggaaatcttgaacagtatcagtaatgctttgctaagcactggcacagggggtccacaggtgcgcagggggtccacaggtgctcagttcataattctgcttcacaacttgcacacacactataaactctagtatatataaaatagtaaaaatattgatccttatatacaattaaaatggcctctatttcacaatgacaaatatgtgtgtatatgtgtacgtatctatgtgtaagtgtatatgtgtacatgtatatgtactggaatgtgtatcggcatgaaggggaagaataaaaataaaaataaaatgacaaaaatgtctcacatgaaccaatggcaatattgtgtcctaaactagtgagtatgactaattcaacttttgcatctgatgtaaaacaaaacaaaacaaaacaaaattactactgttgctttaatccactgggtgatttcccagtaatttaatttaaaaaaactggcattaagaactaagcagaacgaggatattttaatttggaaaaaaaaatccataaatacacaagtaataacattattttaaaattaaatgactgatttcagaaggaaatgttttcaacaactttattagtgctagagccctcatgccacagctcctggaagacttcaggctctcaatttaagctctttgaatgtaaagagagccagacaaacagcttttcttctgtaacactccatttggctggttaacacaagttatcgattctgggatttagggttgccaaatgctttcttaagagctctgtgctattgactatcctcgtttcctctgcacttcttttcttagtcttgggtaaaatttaaaactctttgtaccatttttcaactcatctcgacggaaacagcctcaatttactataaaaatgtcaatggctcactagtgacctaacctcaaaggattgggaacgctgcctcagacatctcttttctatgttcccagggtctacagaggctctaccacaacaagatggggaagcccagtctgtaatccagcaggacagtggaatgctactggtgagacctacaaactaagtctgcagcacagtcctgcagcttccccgaaagctcagcccaacaagcttcctgaatttcacattcattttacacaacatacatgttagtagatatttttaacgtacatatgtctatttaggggaaattattagcatcattattgccaacttacaagttattattttgcaagttttatgccctttagaagtgactttgtaacagtttaaaatattattttctttaggtaaagagtcatatttgaaaaagagtaagtcaaacaaattgtatacattttataaatttgttgaaaaccttattcttagagactgtaaagcaatggagatctttgcaaacatccgtggtcatgtctaatggtgacggcacacataatagccaatcagagctcagtaaaacataagccagcaaatcagaggccgctcatagaaggagtccaaattcctttactgcaggatgaataacttgtaaaatcctaacattcacattctaatcctctgaatgaatgctgagtagggaggagacgaagcttagaagcaaaaggaagcttgcatcctttgatgtcctctattgttgaagttacaacaaattaagacaaaaataatagttatgttagaagacaaattaaatacacgaatcataaagtagaaagaatttttgaagaaatgatattcagcgttcccagggattataagtcaggcaaaattaagtcatgcagcattttaatgtaaatattttgcatgatacatttacccacaggcttatcctaaagcagtatgtttgcacttttatcatttgccttaggatgaaaaaaaatcaatgaatttaagagttttaaacctctttaatatttgcacaatattagatgtgctataatctcatataaaactacctcctagagagcttttgagaattgcttttgcctggggtctctggtactaatacttcaagagattagaaacatcttacttaagaagagttttctttttgcccattaaaatcaaacaagctttgttaaacactgaggcagaagagattcataaatcaatgatactcccctgaactgcccaaggtttgcatcatagattaaaaaccaatctcagaattgaaaaagctacagtgccacatatctgtcacaacactaatttactgaacttaggaagaaaataacactagcatagatttaaatagttttctatgcaatatgcaatgaatcaatgtactgacttgcttggggtttatgaaaacaacaactgacaatgaatatcatcctaagtaaagagaggagttatggtttaaaatcatgtgactacacaattcctacatttttttaaagaataatttacatcaaaatttttctctaactctaccctattatcacagattcttttccttgcattcttttcaatactatttatctgctatgaataatatttccatgtttaaagcattctattattttatgacctaacaaactccaggatttaaacaatgctcatctaacaggaaataccgcccttccaatctaaccttcatatgctttcgttttcttccttttcttctctctgaacatggaaaatgagtgccatttctatgctgaatattgatcaggagagaaaaatatatgaggtgtgagttatattgtgactacggtgattttccatccactcagtattacttatcgtgtcaatcacttaatcctgcagcataagttcttttttgcttatgatggaaagttttgttgtgttttattttttatttttgttttttgaaaaaagacatgagcaatctgattttctttggacttcacaaaatccaagaaagaagatttactgaaaattcatttcttaaaaaatgtgaggtccttgacaatggtcttctctacagtttcaatgttaggttttgaaaatgtgaggtccttgacgacggttttctctacagtttcaatgttaggttttgaaaatgttaggtccttgacaatggttttctctacagtttcaatgttaggttttgaaaatgttaggtccttgacaatggtcttctctacagttttcaatgttaggttttgaaaatgttaggtccttgacaatggttttctctacagtttcaatgttaggttttggtcatctctgagcgtgcataacatgaatggaaagtttttttcggagatcagaccgttatgatttttggaagtgtttcctgtcaaggagaagctcatggtctccaaggtcttatctttctactgggtggatgggccaagggaacacgaagaagcataatggagctctgtctgagagaatcaccagagtcttccccagcgtttctcaatggtctacaaacaggtctgcgggcttggatcacagacggagatccaagatgggcatgggcatttacgtgggcagggcaagcgacgctggccacactgcaaggccctcaacgttcccacgtgaaaaaagaaattgttcctcaaacagcaccactaggtcgggtgcggtggctgacgcgtggaatcccagcattttgagaggccaaggcaggcgggtcacaaagtcaagagatcaagaccatcctggccaacatggtgataccccgtctctactaaaaatacaaaaagttaatgggcatggtggtgcacacctgtagtcctagctactcaggaggctgaggcaggagaatcacttgaacccaggagacaggagacagaggctgcagcgagccgagatcgcaccactgcactgcagcctggcaacagagtgagattccgtctcaaaaaaacgaacaaacaaaaaacagcaaaacaagcacacgtgagaagccctgcttgttctgtgaacacagtcatttctgcctttccttcacagtaattcaaaagcatttactgaacaacgaatgtgtattagaacttacaaagatgggtgaataagaaacagctccttccttcaaaggtctccctatctacgggagaaaagagaccggtaaataaagggccgtgcagacgtatcttataagtgctgagctagcagcaggacaaacgaataaaggaagaaatggcagctctgatattaaagccctcagctcctcctggaaagaggaaccaagccttggtgaagcttcagagaagaaggaacaattaaaacaggctccagggatgaggagaatggactggatggaggaggagcgagcggctgccaaggtaggtgtgcctccaagcacagaaggcagccaatggtcatgcccggttcctgggccagagagcaggggggtggtaccaggtggtgctagggcccctgctacatggctggagtttctcttcttctctagttcattccatgttctaaacacaacaaatcacattgcctccaggtgttaggaccaagaatattaaggtcctgaaccaaaatgccaatatttggtaaaatggcattccctcatttatatatataagtgcgtatctgtatgtgttcgggtacttctataaaatctgccagtttttaacttcctaaatataatggctaactcttttattgtagacaaaataactaaataattgcacagacataatccaacatcatgggtttgattttcttaagggtagaacagctccagccatataaatgcagtgtgtgagtgaaaatgaggacggaagagcgggtgcagcacgggggacccagcagtccttgagccaaggtctggaccctcaaaagcagtggacgtggaaggtggtagctccgatagccagtgggcatatacgcacagagagcctcactctccagctccaaagccttccatatcgatggctccttttagcactacagggtcctaaggagagatgtcaaaaatgtttaacaaccgttgcagcagtaccgggttggaagggactccgtaagcaagttcctacctcctgagcatcaggtctggccttggtgatggtttttctctgtcaaggagattttcagcatttgcagtacattaattttatgcatgaaatttatcttcatgtactgttcctttgtttatttttgagaggaatataaaggggaactaagaacaaacttttgctcgaagccctactctagaaagaattctagagtaacaggatctctaaatttcaaaggaagccaaaaaataaaaaaataaaaaaactcaataattttgtacattttatatatgttttggtagaataaaataaatcctgtaaaaccacagaaaggtaatttaagtacttggaaatctatgtcaatatagccaagataatggaggtaaactaacctggatcagagaaaacaaaagttggaaaacactgagggatcatcttgtcggcctatcagaaacggtatccaatctacaacatcacagcaagtcaacatccgatttcttcttaaggctttccaacagcaagaactttgccatcttacaaggcagtccatcctatcaatgaatagctctacgtcttagaaagttcccctcaggaaagaaatctggtcctctatacctttcatctatcaatccaagttctgtcctctggtgtcctaaagagcaagtcaggtcttttgaaaaagatgtctcttctcatatttccagtgcttatcatgtgcctctataattatgctcttttccatggtttataagcacattgctgatgtgatgtggggtctctgcattttttcttggtgctgtcttgggaagcggcatagtatggtggtatcttctgaaactgcagactccaggcccaaatgggctgtggaaaggggaccttctttatacatgtacataagttctgagcaataaaaaattttattctatctggtatttgtgcagtagctttttataaaagaaagcaaacagcttcacctttgtttctgttatatatcctcctgttggttcagcgcataattccaactataaaggctgaaactgaattctagatattgagtctgtcactcagggcatccgttgttcctgcaagctcagaaccaagtctgctatgcattccttctgtgttttgtacaagcagatggaaaatgtctgaaacaaaaagaaactaaacaggtagtgctttcacatgccactagagatttccttctacttcaactgtgccattgtatttaagtgaagttctggaagttacaaatccccctgttactctgctgtcctatgaaaggctatgaagaaggtgcatgtgtgaaagtgccagctgcttcactgacacactcaccttcacagcctaagcaagggtgttgatcccacttgacacatcaggaactcgtgttgtggaggcattcaacagcccacctaaagccactgagtgggtgggaggcaggtgagtgactgcaatacagaccccaggggtccttcacttacaaacacatcaagagaagacacagtgttgatgcccagatatatcgtttcaggttttccatcactctattacgattttagaaataattttaggcagggcacactggctcacacctgtaatcccagcactttgggaggccaaggcaggccgatcacttgaggtctggaattcaaggccagcctggccaacgtggtgaaaccccatctctattaaaaaaaaaaaaaaaatgccaggagaattctatcacaagaagcacaaggatgatctgtgccccgccataattcaatcgctcccaaccaggcccctcctccagcaatgggaattacaatttaacaggagatttgggtggagacacagagccaaaccatatcaaccatcaatcctaaacagtgggtttaactttcctttcaggtctcagaaaagtacacaggacaataaaatatgcccgcttcatcatttcatttatgtatccatcccttcattctttcatgctgtaaacaacataaactgtagctcattcctttcttctgctctatgaaaacatttttacagcttcccatctttcttcctacttatccttggttacttgtcatttcttcagcatttgtacttcccctttcaaaatgtgagcttggtggacaccacctaaattggttttgttagatatcaccccatttttctttctgagtatcatcacatgtcagtaaatagttggaatttattcttccagaaccttaaatcaaattccttcagaggatctagaccctgccttttctagaaatgtggaggccagttttcctaaaagccatagtacgtgtctgattgacctggcattttctttcttgctgactgagacctccgtagcggtggggttattgtctctgacactgcaactcagtatggaatatgtgttccccttgtagcttcctccaccatttttgagaatgcatgttaaccaataaagtcaaaactttaatgacttttagtgggatgtattcagatatttgttcattcaataagtattgatcaatttcttgcaaaatgccagtcttgtgacctatgtagttaaaatgtcacccctactcttccttcccaagaactctgccatctgctctttaaaggttacaaatgctggctcagctcaaccagaattaatccaggcatgtggtttctttggctaacatgttgcattacaaaacgaagtcatttctccaaaatttcacatacaagatttcacatacaattccaaattattaattcctcttgaaaaactggaagacaactctgagactatatatccatagggccaaaaccagtgagagacaagcagcagcttcccctgcagaaaggttttatttctccatgtgaatgaagataagttctccaggagcagtgtcaacacagcacacaacctggcctgcgcccctctctctcctgagccctgtaggcatccaggtttatacctcctgccctaagtaaagcctcaatcctcctctcctttaggacgcacataaattatttctgccattcctgctcccttggattggtaaattatcgtatcagtataaacccatgccatcactagcccatatggcccttcatgaaaaattggaaaaaggcaccctaattctactttatatccatctgttggaaaattgctgtgaattactgattttgtcatatgaagttacatggcttctttatcccagaaatttatcataataaataaccaatagcaaatcttggaatcgcactgtgtgaatggtgtccctccacatgagacactggcaggcagggcccagacagcaccaacatccacgacagcccccaacccacacctgcttgtcacctactacagttccatccaatagcaccaccaccaacacttccactgccccacacacagcttcatgaaggccattatgccaaggggaggttttttccttccaactattatttctatgaaattttttccttctaaaatttgctctccaaatattttaccctgcacagggctctacatgctgctatttgaaagaccagtagcagaatcttcactaaccttccaaacagatattttgagataatattaaggggactttatttccatagtttaaagaaatattttgccctgttactatactttttcctattttgaattttaactagagaaagagacccatatattcttgatgtgaaaagggacaagttactctttctctgctactctctttttataaaaaataaagcaaataaaatgccacattaaaatctttttttttttttttttgaaacagggtctcactgtccctcaggctagagtgcacatgcaggcacacctcttgtcattgtgcttcaagttgttgtgctttgaagatactgcattttttaacaaattgaaggtttatggcgaccgtgcatcaagcaagtccacaggagacattttgccaacagccatgtgctcacttcatgtctctgcatcacattttggtaattcatataatatttcaaacttttccactatcattatatctgttattgtgatgtatgatccacgatcactgacataaatatcgtctagttttggggcaccaccaaccatgcctatataaaacagcaaacttataaatgttacatgtgttccgactgatacgccaactgcctgttagacactgtctctgtctttctcctcaggtgtgcctcccgatagcctgagacgcaactatactgtattagaccaattaataatgctacgacggcatctaaatgttcaagcgaaaggcagagttgcatgtctctcactttaaatcaaagctagaaatgataaagctcagtgaggaaggcacgttgaaagccaagacaggctttgcaccaggttggctgtaccaacaagttagtcaagttgtgaatgctaagaaaacttcatgaaggcaatgaaaagtgctactccagtgaacacacaaacgaaacgaaagcaaacagccatattgctgatatggagaaagtctgagttatctggatacaagatcgaaacagccacaacattccctaaagccaaagcctaatctaaagcaaggccccaactcccttcaattctacgaaggctgagagaggtcaggaagctgtaaaagacaaggttgaagctagcagaggttggttcatgaggattaaggaaagaaactgtctccatcatgtaaaaatgcgaggtgaagcaacaaatgctgctgtagaagctgcagcaagttatccagagcatctagctaagattggatacaccaaacaacagatattcagtgtagagaaaacagccttttattgcaagatgccatctgggactttcatagctagagaggaaaagtcaatgcatggcttcaaaacttccaaggacaggctgattatcttgttaggggcaaatgcagctggtttaaagccaatgctcatttccattaaaatcctagggcccatcatgctgaaatttctgtggccatgctctataaatggaaaaacagcctatatgccagcacatctgtttacagtgtgttttaccgaatattttaagtgcactgttgagaactccagctcagaatattactgcttattgacaatacaactggtcacccgaaagatacacaaggagattaattttgtttttatgcctactgactcaacatccattctgcatcccatggattaaggagcaattttaacttgcaagtcttattatttaagaagtatatttcataaggctatagctgtcccagatattgagtcttcttatggagcttggcaaagatctttgaaaaccttctggaaaggattcctcatcctaggtgctctaacaacattcatgattcatgggaagaggtcaaaatatcaatatgaacaggaattagaagatttggattccatctttcaatgacttactcctcagtggaggaagtcactgcagatgtggtaaaaataacaagagaacaagaactagaagtggagcctgaagatgtgaccaaattgctgcaatctcattacttgaatggatgaagagttgtttcttatggatgattttgtttttgtttttgagacaagagtcttgctctgtcctccaggctggagtgcagtggcctgatcttagctcactgtaacctccgcctcctgggttcaagcgattttcctgcctcagcctcccgagtacctgtgattataggtacacggcaccacgtttggctactttttttctttttcttttttttttttaattgttgtatttttagtagagatggggtttcgctaggttaggcagggtggtcttgaactcctgacctcaggtgatctgcctgcctcggcctcccaaagtgctgggactacaggcatgggccactgcacctgacctgtaggttggttttgagacataatgctatcgcataattaatagactacattacagtgtaaacataacttttaaatgcagcgggaaaccaaaacactcatgggttgcactttcttgctatatttgttttaccgtggtcttctggaatctaacctgtagtatctctgagggtgtgcctgtaacaataccagagttcattttttctaaatataccttttgttaaatcaccaccattttcttaaaaagcaatatgtttatgccaacaacatactcagagtgagattaaattctttaaaagaagttgactttttgaatgtaataaacttaatatataataattacatcaaactgctcttatttctcctattttatcgctcaccagtgattttgataatgccttcttctcctcacccttctacacagttcaaggccaggcctgccattccttcagaggtagagggctacacaactggtaagtccatgccgagtgaagcgagggtggccaactcttccagcaaagagaggggccctgggacttgagactttaagtgctgaaacaggaaacgtcctgggtaaactggggaggattggtctcacttaagggcaactagattcaagtaattacagtgattctgccacacaccttggctttctctgagcagtgcggcccatctcacactggaatgcgtgatgctaaagaacctctacagggtaagcaagggcagcaaggacaatggaatagttgggctccatctgtgaaataccagagcagcaaacaggagtatgagaggtttccataacactttctgaagactgtttgtcatttttccacttatctaatcaggtgttttcataaaactcaacagaatatgtatacaagtataaaatgtatacaatgtatacaagtataaaatgttcatattactctatcttcacctcttcttctttttcactagaaagatgtcacactctcaatgccaatttcagtctatgttacagctacaacgatacctcctctctctggaagcctcaggggaatgtctgggtaatggagagcaccgtatccacactttacaattttaaaacttaaagccacacatctgcggcacatgacagtgccaactgccaagtactgaactgacagagattcacaccataatgctaattctctgcacaaggaaggaataaaagtatgtgtcaaaaatctgaaaatgattgatgcctgccatctcatcaagactgtctgtcacacgatttcgattgatgatttgagattgcatgtgagcgggacgcaggtgctgcaggttgcctaactagctcaacacttattctcaacaacacaaagacaaattaatctccacatcagaatactttccataaagttcattagactttactacatctacaaaaggcttgaggtggttggcctaatctcagggatactaaattcctaaccatagaggacagctcaacaaatcagccactttcaaaggtactggtgagtccaagagacccaaaaatgtgagaagcagtgctctggccattgtgaaggcactgaattgttttcatcactgggggagaacatatctactctcagataaggatatccctggattttctggctgtccagttgagactgctaaggactcggtcagaggtgtaattagaagaacaacttgtgatttcagtgattatttctaaagcacacagtactgtttaaacatgactcttatgtatcttgtgactacaaatattgaattagtaaactctcatctctaaaaaggaaccccaaatattgacttgaaaataaccacttttagccacaagattatagatgcaacctgttgaaccatttagtatgaatctgcctaattaagcaagaggatttcaaataaccaaatatttctattataaaacacaacccaaaataacagttaagaaaagttatctcacctcccccatcctcacataaccaaggtatttgaaattgttttaatatttgcataaatatttaaaaagtttcacctttaacagaataggtaactagacgatgcctcatcttttctcagagttcaacacatttggacccattctttagatgaatgcacttgtttataaaaatgtgtgatgaatgtcactacattagcacgtaatagataatccaagttattttcagacttaatcagttgtaagtaaagtgtgagggatttgagaacacagagagagggctggtggctctgcagctcctggtcaacatggaaaatatgcagcatttcccgtggagcctctcagtctcgctggcagctgcaggatcagcaggtctcgatccatcatcattcctccttggccccatacgggctgtgaggacacctgggtctaataacagaagctaatcactcggcagtcatttatgaaagagacataggaatggaaagaaaaccaggaaaaatgaaacagatgaatacaaaagtacgctgaagagactgatgttaaatggaatgggattataggatattttaagaaaatgtgagagtattacaagtaacaaactacttctaatagcaaaatattgccataaaaatacattattaatgttacataatacacaatatttcattataacatattataaatgcatctttaaatatctttaaagttttaagaggataaatctaaaaattaactttccgataagtttggaacatgcatagaatgtagagatttaactttgataaataactctgtactaggacagtggcccgggagacagaaggagaagaagcatttgctcctgacttcaaggttcttaccatctccaggagagacaaatgtacaattataaccacagcaggagatgataaggctaataggtaaatctaaaagaagtagtctctgaaaaagagtgttctctccctctccctctccctctccctacggtctccctctctttccacggtctccctctcatgcggagccgaagctggactgtactgctgccatctcggctcactgcaacctccctgcctgattctcctgcctcagcctgccgagtgcctgctactgcaggcacgcgccgccatgcctgactggttttggtggagacggggttttgctgtgttggccgggccggtctccagcccctaaccgcgagtgatccgccagcctcggcctcccgaggtgccgggattgcagacggagtctccttcactcagtgctcaatggtgcccaggctggagtgcagtggcgtgatctcggctcactacaacctacacctcccagccgcctgccttggcctcccaaagtgccgagattgcagcctctgcccggccgccaccctgtctgggaagtgaggagtgtctctgcctggccgcccattgtctgggatgtgaggagcccctctgcccggctgcccagtctggaaagtgaggagcgtctccgcccggccgccatcccatctaggaagtgaggagcgcctcttcccggccaccatcacatctaggaagtgaggagcgtctctgcccggccgcccatcgtctgagatgtggggagcgcctctgccccgccgccccatctgggatgtgaggagcgcctctgcccggccgcgaccccgtctgggaggtgaggagcgtctctgcccggccaccctgtctgagaagtgaggagaccctctgcccggcaaccaccccgtctgagaagtgaggagcccctccgcccggcagccgccccgtctgagaagtgaggagcccctccgaccggcagccgccccgtctgagaagtgaggagcccctccgcccggcagccgccccgtctgagaagtgaggagcctctccgcccggcagccaccccatctgggaagtgaggagcgtctccgcccggcagccaccccgtccgggagggaggtggtgggggtcagccccccgcccggccagccgccccgtccgggagggaggtgggggggtcagccccccgcccggccagccgcgccgtctgggagggaggtgggggggtcagcccccgcccggccagccgccccgtccgggagggaggtgggggggtcagccccccgcccggccagccgccccgtccgggaggtgaggggcgcctctgcccggcggcccctactgggaagtgaggagcccctctgcccggccagccgccccgtccgggagggaggtgggggggtcagccccccgcccggccagccgccccgtccgggaggtgaggggcgcctctgcccggccgcccctactgggaagtgaggagcccctctgcctggccaccaccccgtctgggaggtgtacccaacagctcattgagaatgggccatgatgacaatggtggctttgtggaatagaaaggggggaagggtgggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaagtagtctctgatttttgcaattttatttcgtgagaaccaagaaaatcagaaaagctctctaattctatgcattttgtcccaattactcagtttctctatttcaagtaaattggatataacacttgaataggattctgccttgataagtatttatccaaccttattctaaagtttaattcattgttctgaaaattggatgaaaaaagtgaacttcttaaaggtttgtgaataaaaaatatatagtcaaaccataatgaaattcttcctgaataccaatgtctagacatttccctgtagaaaactggcagatatctaatagagtattgcttctgaaaattaactgtgtagttctgtggtacaaaatcacttgtaaaaaatctcctggtgtcaaaacagcatggaactggtaccaaaacagatatatagaccaatggaacagaacagaggactcagaaataacaccacgcatctacaaacatctgatccttgacaaacctgacaaaaacaagaaatggggaaaggattccctatttaataaacggtgttgggaaaactggctagccatatgcagaaaactgaaactggaccctttccttacatcttatacaaaaattaactcaagacctaaacgttaagacctaaaatcataaaaaccccagaagaaaacctaggcaatacctttcaggacataagcatcggcaaagacgtcatgactaaaacaccaaaagaaatggcaacaaaagccaaacttgacaaatgggatctaattaaactaaagagctttgctcagcaaaagaaactatcctcagagtcaacaggcaacctaaagaatgggagaaaatttttgcaatctatctatctgacaagggctaatattcagaatctacagggaacttaaacaaatttacaagggaaaaaaaaacatcaaaaagtgggcaaaggatatgaacagacacttctcaagacatttatgcggccaagaaacatatgaaaaaaagctcatcatcactggtcattagagaaatgcaaatcaaaaccacagtgagataccatctcatgccagttagaatggggatcattaaaaagtcaggaaacaacagatgctgcagaggatgtggagaaatagaaacacttttacactattggtgggagtgtaaattagttcaaccattgtggaagacagtttggtgattcctcaaggatccagaatcagaaataccatttgacccagcaatcccattactgggtatatacccaaaggattataaatcattctactataaagacacatgcacatgtatgtttattgtggcactgttcacaatagcaaagacttggaacaaacccaaatggccatcaatgatagactggattaagaaaatgtggcacatatacactgtggaatactatgcagctataaaaaaggatgagttcatgtcctttgcagggacatggatgaaggtggaaaccatcattctcagcaaactaacacaggcacagaaaaccaaacactgcatgttcccactcataagtgggagttgaaaaatgagaacacatggatacagggaggggaccaacacacactggggcctgtcagggggtggggggatgggagtggatagcattaggagaaatacctaatgtagatgatggattgatgggtgcaggaaaccaccatggcatgtgtatacctatgtaacaaacctgcctgttctgtacatgtataccacaacctaatgtattaaaaaaaaaaaaactcctggtgtcacttcggccattcaaagtcaaatgttcttctaaatctaggtattcattaaattaacattgtagagggtttgctttttaatgaaatagttttttttgaaacctcactaattggtatagtgactcttgcatggctcttccatcggtatacatatttaagtttgaattattgctaaatcctctttgtgaataactaacttggccttgttctttagttctgtgtcaacctatttggtagaaagtggcaaaagtagaggcaagaatatttcaaatcatgcaagtgatgctgaactcagtttctgtcatatatttaagcacatctgattatggccaacgtttcccttcaactttcactctacatgattgcaatatagtttttccacgagtaagtgagaagtgcagataatactttcaaaacaaaacaaaacaacgttggtgtttaataagaccctgaataagctattgatctgtgaattagcaccaggcacgatgtgaagtagtttacatatattatctcatatcaccttcttaataacttaatgaggtgctattatgataaatattatagggtgaaaaggactaatcattaagaagtcaggtcacttgccaaagtttacatagtaagtaagtggtggacctgggattttgactcattgattaattgacacgacaaataattaagtgtctactatgcaccatgcagtgtgctagggagggaagaatcatttacttactcctcagtgactctaaggcagatttaaggcacggcttctctaagctcttgtgttgtcatttgccgcatgacacagacatagaaactagagtgattttcctccttgtcaagcccaatcatggtgatgattttaaaaaatattattaatgattacctttggcttctaatccctaacgtgatatacttatctactgattacagaaatctttgcttagttttattttccaagcaaacacaaaatatgatggtaggaaaaaagagtccaggttgctcctttcataaaatcttattcctaggtttctctcttgtggcactttaaaaaaaagtatccatgaaagccaaggattgatgtaaataaccattaggaagagcttaatgttgacaagtagaagtcgagtttgttttagaaaaacaataggaaaacctgttatatactgtctgcaatgctaaataaatatttctcatcagaagaaatatctgcttattacatttttgtcttcctgattagtatgctttattcctgacatcaacttgaaaaaagatgcaataaatgagaagtttaaataacacaggtataagactgttaaccttgggatcaagggattatttgttaatatttttaaaatgataatacctttatattaaggctaggttctagacgcacctcacattctccacccctttctggctttgcagaagccatgactgggtctgtggaataaagccttagccatcccgtgtggttgttgtttgctactacagcagtagccatagctcttaccctcccctaggaacagcaagttgcattgctatcctggtttcccagaaacagtaataagaaaagagtaggaagtataatggtagactacatggtggcactagtggtggatcaggtgaagtatattggatatctgagactagatggggtttttttaagtgtacttacataggatcaaacaacatttaactttctgaatatgcatttagtaagtataaggcacaagttgtttctgtacattcattttcatggaaggggtgtgtgtgtgtatgtgtatgtgtgcaagcatgctcacaagtgtagaagacagggattatagaagtaaaataataatgcaagatatgcaaaatttaaacagttaaaattttaggaaacctacatgatttctaatgttgcaagataagaaagcttctgctaaaaccaacatatacaaaaacgttacttatgaaatacttttgtagagatttcacccatgagcaatagaaaaaaaggaaagttatttaatatattagaaaaccctaagaaacgtggtctgtggtcactccctctctggcacctttaccacagtgatgacagagctatgcggaaaagaatttctgtgccagttcagccatctgctgttggctcacaaatggagttaacagtctaaaaggaaagtttgttttgaggtgccattcccatgtgcatacaatccacaaactgcagtgtataaacgtggctcagtctaataccaagttaagacttggtttttttgaagagcatattgcacagcattttctggaaatgctcccaatattagatacatgtcacattcgcatagaaacatatggtcttcaatgtgcaatctcaaatcgtctacagagactctgcaatcagagattccctgttttaccttccttttataagtcaattttcacttagcaaactatcacactgtggtgatttggaggcattattttaattcctaatgtaaatttacttttaacagatgtgattctatgaatcatatagcagcatatgatattagttattagctgaaatgatgccaaggggtgttacgtgctggaaactagagcaactgagccaaaccaaggtcacccccatcactgccctcacagctgggtcagggaggtctggcctggcccttgtccattctgaaggttgagagaaaaatggcgtctttatgatgccccctgcccaccgagatactcagatatatttcgccctgtccttgaagcagccccactactactaacagtggctctgaaaatgtggacttgacagatagtacctgtcactggctttctatccaggctccattcctttctgggctgcaggtttgaaaatggatgtgccccagggaacctgaatacagtgagttcacacacaagcaggaaagaagtgagtttcttttggtttgggttgaagcagttgctcaaacgtgataggcagaagaggtaaggatttcactgtgctttaacaaaatgcttccatggtaatcagtcctgtatactgtataatcactatacagaaacaaagtgtgcaccaaaaggtaaagaattttcctaggacaagaccgcagctccacaaacaaccaaggaagctgttcagaaacctctttctgtgctctcttactcccctgagttcatccccaggccccagggcctcccattccagatgtgaagaggtgaagaccacgcctggaataactccgaatacaacacaattgctcctcacatatcagctgttcttttccctgttcactactgagaaaacatagataaatcacggcactttctgtctagcattgaaaatggtcattttaagaatcagggcagatgttggctacacacagaaagctgcccaagggtaggcttgaagcaaaataaattaagaaacccatcatgtactcttgagtgcagggaaacaaactgataatagcaacaagtatgcatccttttcaagtaaagataatgagtcaacctgctgattgcatattgtggtgactgaatacattgtgcaatgattaacaaaagaactgattgttcgtaattcaaggaatatctttccatttactgaggctttacttaacctctagcaatagttttgtcaagttattcacaaaggccgtataaatcttttgttagattattccaaggttcagcatatttttgatgcacgcaattttaaatggtagcttagaaaaatcacatcttctgcctgttgttagcatacagaaatgcaattgatttcagtatgctgaatttttattcagcaaagttatacattctcttatgaatttatatgacttatcgttatattcttttgagctttgtagtcacattagctatgaataatgataggttcttactttccaaccttgaaacttgctatgttttgaatgtgtccctcaaatttcatatgttggaaacttaatccccaaattcgtatgttgatggtatttggaggtggggcctttgggaggtaattaagattagataaggccatcagagtggggccctcataatgagactggtggctttataagaagagaaaggagatcttagctggcatgctcttgccctctgccatgttatgacacaggagaaaggtcctgaccagataccattgccacgttctaggacattccagccttcagaactatgagccaaatgaactcttttctttgtaaattacccaggctgtggtattctgttgtaacaacataaaacaaagacaataacttttgttcttttactagccatattcctttcagtggactggtcataatgaatataatcgtgttttttcccaatcttaaaaataacctttgagcatttttgccgtattttccacagtttttaaatagatctttttctattagattaatgaaaatttggctgggttcagtggctcacacctgtaatctcagcactttgggaggcaaaggtggatgaattgcttgtgcccaggagttcgagaccagcctgggcaacatagtgaaaaatctgtctctacaaaaaaaaaaaaaaaaagctagccaggtgtgatggtgcatgcctgtagtcccagctccctgggaggctatggtgggaagatcacaggagcccaggaggccgaggctgcagtgtgctgcaattgtgccactgtactctagcctgggtgacagagtgagaccttgcccccatacccccacccccaaaaacaagaaaaaaaaagtcctctatttctagtttgatacgtttttaaccatgactgcatgagaaattttttaaaatactttttcagcatctactgagatcatgtaattgttttaatctgtcaatatggtaaattacattattgattatttatgtttacataacatgactatttcatgttactccagacaggtatatctggaataaatcctagagggttgtgagatatatatctatggatatatacatatatctatatatgtgtctatatctatttctaaatttgctttcctagtatttgtagtcatatcatcctttaacaacattttaatttcagatttatatttgttaagtgtacttttttattcctaatattatttgtgtctttagtatttttttcttgatcagtcttgtgagatgtgtatctattttctttgctttttaaagagcaaactattatatttattatatttattttatttttttctttgttgatgtctggaattatttttattattttatttatccattttctttaggttctttctgttgtcttttttctgacatcttatgttggatgcttagttcactaattttcagcctctgttcctttctgatgaaaaaaaaataaagctcaccaattttccttgaagagccattatagccacacatgtaaaaggatcaatttttagtatatagaattttttttttattttgtatttttctacattaataataccatctaatttcctttatgatttcttctttgatccattagttacttaagaggttttcttaattttcaatatgggttgacctagttaagttttctaacttcatttcattgtattcaaagaatactgggtataagaaattaatctttggctttgatgattcttgctttatgacttaaatatgtgtgtttgaataaagagaatgtattatttgtgatgaatatcacatttataaatttgtgtcagatatagtacttatgtatatatatatttttatatagcatttgttaattttattgcttaaattttatctatggctccctcttatttcactgagacaaatagatttagaaatctcccattacattgctgaaatgatctatttcttcttttaaaaagagcttcaagctcattcatatttttttggtaattattttacttgaaacaatggttttgaagatactggctatcaagcattgaaaactaacaatccctaagagacagaaacaaataaggtgagtcttaacattactccaacttactgccttgagagcgtttccaggctggggcctaaggctaaagtgaggagataaagctgagagttgagggagacgatggcctccaaatttcacaggacaaaatattggtgagaggtgctcagagacagagtgtcagagatctgcaaagacttgttcaagtttatgcatgtgagaaaactaaaaagaacctacccaaaaggattagagataacagtgtcagggacccacgagggtaaggaacagtgcctcttatacccaccagtgaaactgaaaaccttgctggttcacagagcattgagtagaatacacagagtggccggcctctggtgggcaacagtaagtcctagactgacccttattccagttctgcctaacaaccaacaacgtgacctggaaggataaaactatttccaagtaacttaactcggtcccagaacaacgaccaaaaatatctgtagaagagaaaaaaacatatctaataatccacaaagcataagtcacaatatctgatatccagatattgtggtcaacagaaactgacgaggaatgcaataaatacctatattagaaaagaagatctcaaatcaatgacattttctataatataaaactaaataaagaagaacaaattaaatccaaagaaagtaaatcagagtcaaaatcaattatataaaacagggatggacaaattttttctgtaaagtgtcagacaataaatattgtcatctttgtaagtctcctatggttttgttgcatattcttattatttctttttacaaccctttaaaaaagtaaaaatcattcttagatgcaaggccttacaaaaacagagctaaatttggtctacagactgtaatttacccaatactgaagtaaaaagcaaaaaagaaaaagagagagagaaagagagacagaaattctaaaaatcaacagcaaattagttgagatagtacaatagataaacatgtaggcagagagagaagacataaattataacatcagcaaaggcaaaggttacatcactacagattgtgcagatattaaaaatataaagacagattatggacaattttataccagtaaatttgactacttggatgaaatggacaaattctttgaaagacatagtcagtcaataaaaaagagataataacctgaatagaatttgttgaagagactgattttgtaaaaacctttcagtgaattctagcaaatatttagggtaaaaattacatgaatctacacaaactttagcagaaaattaaaaaggaatgactggcctggcacggtggctcacgcctgtaatcctagcactttgtgaggctgaggtgggtggatcacttgaggtcaggagttcaagaccagcctggccaatatggtgaaaccatctctactaaaaatacaaaaattagccaggcgtgttggcatgcgcctgaaatcccagctacatgagggggcagaggcaggagaatcgctggaacccaggaagcagaggttgcagtgagctgagatcgcgccactgcactccaacctgggcaagagagtgaaattctgtctcaaacaaacaaataaacaaacaaaaaatgaatgactactttccaactcaatgaagccaccactgccataataccaaaaccagataaaatattacattcctcagaaacagataaaaaattaacatttttcacaaatgaaattcaacactgtattttaaaaagtacattatgatcaagtagagtacattccaataatgagaggtgatgcaaaacgggaagagaagtaaacttccttgccctgataaagagaatctatggaggacctacagctaactttatagttgacggtaaaagactgaaggctttccccttaaaaggaggaacacagtgaggatgtctgctcttatcagttctattcaacattgtactggaggttttagtcaatgcaataattccaaattaagaactccagataaacaaaagacatcgaggctgggaaagaagaagaaaaactgtattccttcaaagatggcatagtttctatgtgaaaatcctatgggaactcctaccagaagtactaagtgagtttagccaagttggaagagaataagctcaatatacaaaattaattgtatttctacatactagcaacaaactgttggaaattaaaacgttaacactaccatttaccacatcatttaaaaaaatataaaacaggaaaacatctgaccaaacaacagaaagaaacagaagagacattgaaaacccaaaacaaaacaccactgagaggaaataaagtagcctcaagtaaatgaagtatgttatgttacaggttagaagactcagtgttgtcaaaatatcaatactctccaaattcatctatagattcattgcaatcctaatcaaaatcacaacaggctttatttatttattttagaaactgacaaagtgattctaaattttatagagtaacacaaatgacctggaatatctaaaacaaagttagagaacactactaaatttttagaactaatcaagctaccgtaaaaaagagtacgttattggtacagatacagacaaatagatcaatagaacagaagactccagaaacagacacaaacatgttgacaactgatcttgataaaggagcagaggctattcagtgcagaatgaatagtcttttcaaaataccatactgtagcaattagagattgatatgcaaaaaatgaactttgatttctgctttacatcatatacaaaattaacacacaattgatcatagtcttaaatttaaaacctaaaactatataacttctagaagaaaacaaaataattcctttatgaccttgggttaagaaaacactttttagctaagatccccaaagcatgaccaaaaaaaagagcaaagttacaaattaaatgtgttaaatttaagactttctgcttgtgaaatatactattaaaatatagaaaagacaagtcacgaacttggataaagcatttgcaagttatatatctgataaagaggacttatgtctgtaatgtagcacatgcagaactcaatggtaagaaaacaactcaccatcctgggcaacagagcgagaccctgactctataaaaaataaaaaaataataaaaatccaagcaaggtggcatgtgcctgtagtcccatctcttcaggaggctgagatgggaggatcacttgagcctaaggaggttgagtctgcagtgatccatgatcctgccactgtactccggcctgggccacagagcgagtctacgtttccaaaaataaaaataaaaaataaaacaacccaataaaaagtggaaaatgaagaaaacaacccaataaaaaaatgggcaaaagatttgaatggacactgcagcaaagaagacatatagatggcaaataagtacctgagaagatgcccagcattactttctattaggaaaatgcaaattaagaccacaatgagatactactacacacctgtcaaattgaataccttttaattaaaaggtagaccaaaccaagtgttgtcaagaatataaaacaactagaattcatctatgtttctggtctaaatggaaaatggtacaactactttggagaagagattgccattttctttgggaccaggacatttcgcagggaagtatttgcacaagaggcaaaaaaaagcacatgactacacaaagaactgtatacaaatgtccagctttacatgtactcgtcaaaacctatttaaacccaaatgtcagaacagataaacaaactgtagtatatatttatgcaatgaaataatattcagcaataaaaaggaaggcacttgcaaaatacactgtaacatagatgaatctcaaaatgattgtaatggatgaaagaatccagtcaaaatgtatataccctgaggtttttgtgtgtgtttgtgtgtgtgtgtgtatgggtgtgtgtttattaaaatatatgtaacttttctgctagagtttttttcctgtggtataaaaacaaggtagttttcctaccacctttgagtagataagtgtacttaacattaaatgccaaaggtagacaccagcaagcttttgagccaccccctccggacaccagagtgctacttattctaacataccctaccgggtcagatacaaatgaaagacagactgagcaggggacacagagctcagtaatattgacagcggggttcaaaaggatttgagacatggacttcacaaacagcagcaccgtaggtctccctgaagcactcccagtgaattcctatggttggcaatatctggaagatctctgcacccaggtcatcccaccagggggccctgagaaccagaactactttttatcactgtgcttcacgtagtctatgaagcagaaaaggcagattacggcaggttgtcacaaagaacaaggtgagtcaaaccgcaggactgcctttacttaagcatacaacagaaaaggctgtgtgtcaaactttctgaaccatttatcttttatagactgctgaagactgttgagttcagcgtctcttaatccaaagcgctgttttagaaaagataatctacgtggcaaaaaatctggtcaggtcagtgtgactgcgcatcctggggccatcttgattatgaaaaactctaatatgggaggagagagactttcagtaacaatcactcaggggaaagcaatggcatcaccctgaagggcatggattaacagataaatagtgaagcaggttaaaatctaacagtcacattcctgtaaaagatatcttcatctcacgtctaattattttcttttccattgctcttctctaattagtacttgcttagtaatggaagcatcgagaaaggacagagagagtattataattctagcaatagaaagctagacacctcattttctagatttgattacacatcttaaaagtatccatttttccccaaatttacatggcacctataatggcataatttaaactttaagtagataagatgaatagatggggactgaatgcagcgtgcttactttaaaacaaaaatgtgggttccttatttcctaatgagtaaacagaaatagaactttcctataattttcaatgctgtattttattttgattatctttactagtatgttgaatgagaagtttttcacacaccaatgtccactgcaaatgtttttagaagttctcactaagtggtggtagcaggccaatgccaccatgctctcaacctcatcgtgtggcaggttgatttagtcagcttcccatattttccaagttctgcttttatttccatccccttaagcaatgaaagtcacaccattagagttggctctaagctacctagggtaagagtggacggttagcagaaaatacataagcaataaccaaatctaatttttatctttctctcgaataggcagcacaaaaattactggaactgctaaaaaaaaaaaatgaaattgagtgctaagcatttcagcagctattctttcacatatattaaatgctatttagctattatatattatgtacataaaataaatgttaaatgctaaaatgttaaattttaaaaactaagtatacgtatatgaataaatttttaaaaaaattcatattcacatatgtatacttaattttttgaagaatattaaaggtaagacaatatagagacatgaataatacacaatctgcaaaaattaactattggattaatcaactatgtagtttaccttgtacatagttcctggaatttttggaaagtggcatgatataatagaaagagtccagacattagaattaggtagactgatattgaaaccccacagcctacttgattttgagcatgtattacttaagttgtagtgtcctcatctgtgaaattccatataaatctaatgtggggattgaccaattttatgtgtctgtagtgtcagtatttgctagcacatattggctagcaaagaatgtacagtttttaatatgcaaatctgctagaagtagggacaaactgcacacttacaacttaagcatgcaattctccatagcttttatgatgattgcagttatattattattttatcgttataagttccacaagtttctttgactatccgaatataaccaaactagtttcctttatctcttcatatgaaatgggtgtatttgtctagaatttaattctgcagcatatggaaatttgcctctgcaatgttatgtattcctgtgacattctctggaccattctcaaccgaagaggaaggtatacacaccattccttgatttttaaaaacttaacaataaaagaaaactaagagagtggttgttatcatacctcggtatttaaaatagcaaggcaaaagcataaatcctctgaccatttactcacaattgctcatgaggcagatagtggcaacttttaagaagacaagatgagaataaaattgcgtcacaaagcagtctcttgattaccaatattaaaatcatttgtacttatcaggaacaatggggagatcagaccttctaactctaaatgagtaatataacagattatagtctctattttggccagaatcacaaaatgtactttttaaagtatactttaaaaatatggatcatatgaagtatgcataaaaataagatggcatttccacctctaattagcagctggaaaagctagagtaagtgtatggcaaatctctactatggccaattatatttccaatgaagcaataaagcatacatttattacataatttaacagatatatatattttcagttccttcctcccttcgttatactgaggaatcttcctctggacagtgctatcctcagatgttttactctttgtattatttgtctttactgtgtctatcaaccatcagcaaaccattaattgaataagttgacgtattagcttttatatttttgaactaagcaaataaattactagtttatttatgcagttatccttatttggagactcttaaaatatcatatgaaaggtttttttttaaatgcaaacacaatttacttttcctcagtcaattaaaaaaataatattgttactctcacttaaaagaatatacatcaacaacagaaatactcattaaatggaactatgtcaggctctgtgggagattagaaatacaaagcctataagacagtctacaggtttgaatttctctttaaaaatatttattatatttttctgttttcatagaattagagaataatatatagtttcatgttatattgataatagagaaattggactttatttacaatttaattataggtgtttgaaattatgttctaggctagagatctaaaacataattatgttttagatctagaacataattatgttctaggctagagatctaaaacatagatctcacattatctatttaattaagagactttttaaaaggcaagatatgagaactggaacttaaattttaacaccatctgtaatctatctatctatctatctatatatatataacaatttagtttttcattttgtgtagatatatatacacacacacatatatgatttctgggaggagtcaggaaatacctctaaacaatacatactgtctctctaaagtccttcaccaattacttcccatattaagtactgaaacaaaaaccatttacctaactgcagctgtagtagcaagaagaaaagcccatttcttcagcatgaataaaaggcaaaagtaagcaggaaagtgggttggagatgaaaaaagaaattactcaggacaaactgggtatttccttttgaaccaaattaaaaaaaaaaaacatggtcaattttgatggattctaacattcatctcagggaccctgagtgacataaaggaaaccaagtcaggaacaatgtctctgtcttcggaagtctcctgtgaagcagaatttgtttacaaggtaaaggattaattaggtttaccttaactgatctatttgacaaaaactcaaatgtaaattattaagagcaaagatcaactcatcaaaagaaatgaagattctgcatacaagtgcccagcagatccatctataggttgatacagggagtacttatacaggagtcttgttggtcctccagtatacagggctatctcagacattctgtgtgagggcactgtgggcactttacacctgccacattcagagacaaggccaaaaccaccaacgtgacctttattatctcccttaaatgtagatttctgtaattaaatatcttctacccttggtcactactacttagcaggattacgctattcaataaattgactacgtaatgtagaaagcagaaaatgttcttgcagctttaatcttctctaactgaaagatgctaatctttctactctgtggtcctaaattgtgccccttgctgctttcatagccgtccccccacccccatcccatttcttccagggccatcatttcctctttcaggacaagaaatgactacagtgttccatgaatataataccatggtttacaccacgataagagactgtgtttcactatgattgctgtaaggtggccacatgggccccagactaccatagtagactacaatatttaagaaataatctaatatataatacatttttttttgcttggtcaaaacaaagtttaaattaaatattaaaatcacataaagttattttgaggatatcaacaaactgattctaaagcttatatagagaagaagaagacccagaaaagcctacacaacactgaaggagaacaaatatcattggtaccacccgactttaatgcttactataatgtcacagtaataaagtgtgattattagtaaaaaaaaaaaaaaaaaaaaaaagataagatagacaataaacaaatcaatggagatcccagaaatagatccacacaaatacagtcaactgatctttgacaaagaggcaaaggcaatagaatggagaaataatcatcttttcaaaaaatgatgctggaacaaatagccatccacatgcaaaaaatagaataaatcattacagtttacatccttaacaaaaatcaactaaaaatgcgccataaacttcaatataaaatgcaaaactataaaacatggagaagataacaaataagatcatctagatgaccttgggtttgctggtgattttttacatgtaacaccaaaggcacaatccatgaaagaaataattgataggcagggcttcattaaaattaaagacttctgctctgcaaaagacactctccagagaatgaaaagccgagtcacaatcagagagaaaatattcacaaaatatatatctgataaaggagtagtatccaagatatacaaagaagtcttgcaactcagaaacacataagtaagggacccatttttaaatggtcaaaagagttaagcagacatcctaccaaaggaaaaataaagaaataaataaatacagctggcaagtaagcatattaaaagatgctcaccatcatatgtcattatggaattcagaaataaaacaaaattagatagtactgcccacctagttgatggctaaaattcagaacactgaaaacagccaatgtcagtgagaatgtggagcaaaaagaactctcattccttcctggtgggaatgcaaaacgttatgaccagtttggaagatagtttggcagtttcttacaaaactaagcagatttaccatgcaatccagcaatcacactttattcatatctggacaatacctggaaacaagatgtccattaatgcatcagcaggtgaatgaacaaactctggtttatccttacaatagaatattatgcagcaataaaaagaattattgagtcaccaatagatatgaaggaaatttaaatacatattgctaagtgaaagtctgtctgtaaaggctatatactttctggctctaactaaaagatatttggaaaaagcaaaactatatatagaagcagtgaaagatcagtgattgccacaggttcaggggaaggagggagagatgagtacgtggagtacagggtatgtttagggtagtggtgctcttctgcatgacgttataacggtggatacatgccattagatatttgtcaaaacctacagaatgtacaacacaaagaatgaagcttaatggaagctatggactgtagttaataataacgtatcaatattgcttcaccaatttaacaaatgtaacacacaaatgcaagatgtgttaataacagaggaaagtgtatgtgtgtgttgggggagaaatagggaaaatctttgtgcaacttttctgtatgtacaatttgtctgtaatcctaaaattacagacaaaagttagtttatgaattttaataaacagtttggaatatttttcgaaatctttatttttcacttgccatactgaaagttacctggcatggttcttttcagccttgtaagcaatcaaaatatttccacaatctaattcaatcaagcttggtattttactgtttgaaaatcttagcattatttacagatttaaggtatttctattccttctttttaaaataataattaaattgtttaatgaaagcatttctgactgtaaacgtttaaatgctacaaatttacatttctctgttcataaaagaacttatttttggtttcttatctttaagacaatgccacattcatgataaaaatatacttcaccaattttgaaatagttctagtagataactattaaagatcattaaaaactcttgagtggatgcattcagttctctaaatctagagtgcagcatatcataaagtgtctcctatccctatcttatcattttagatttttttctccaaagtagtgctcactatcagaaatcaccttgtttaggccaggcagagcagctcacgcctgtaatcccagcactttgggaggccaaggcgggtggatcacttgaagtcaggagttggagataagcctggccaacatggtgaaacctcctatctactaaaaataaaaaaattagctgggtgtggtggcggctgcctgcaatcccagatactgaggagactgagtcaggagaatcatttgaacctgggaggtggaggttgcagtgagccgagattgtgctactgcacaccatcctgggtgacacagtgacacactgtggcaaaaaaaaaaaaaaaaaaaaatatatatatatatatatgaaatcactttcttcacatatctgtttacttgtttcctaaatcatctctcccaattccccagcccatcagccccataggaacagatgtacttggaagtgccacagcagaggaaaaccaccaggtaaataaatatttgggaggtgactgattgaataaattaacttatctagatttggtttgtcaaggacattcggaaaattaggtagaatttagctccatgaatgttgagaaagttgagttttgagagccctaacatggccaattcattttacagaggtggaaaatggggctgacagatgttaactcaccttgtccaaagtcttagtaatggaatcaggaaaaaattcaatcacttgacttttaaccaataatcttttttactacaagagttaatttgctaatgaaatctcctcagtattttctcaaaacagaacaaaaccatgagttaagtattcctttttctttgctataactaaatataccttttaaaattaaaaaaaaaaaaacataaacatggttataagtgatcttatttcctgcatttgaggcagctaaaccagtatttcccaaaatgtcttaatacccacttcttgatctgctgcaaggaaaaatattgttcagtggtcaaatacgttcaagaatcatgattattatatagagaatagacgtttgcctcttaatggaattggaaaattcctacagtaaagatacatgtttagttaagggttggctaaactacttcactgtggcatcctctcttcaaagaacccatcaatattctacagaacaaatatgccatacaacacatttttatccgaaaatcttttataattggcttatattattgttttattcttcaaaatgttttctaaactgtctcagttctcgtcccatgtcatacaatattttataatttttcaaattctcacttttatgttctcacttactaaaatacggcaaaatataatttatatatacatatgtgtgtgtgtgtgggtgggtgtgggtgtgggtgcgggtgtgggtgtgtggtacctggaacacaataagtggaaaaatttgtttcctctgtcttatcgcacccctttaaaaataacacaaacagaaagtgttctttctaatagtgcaacttacggtccatttattttttaatatttgttatttaatccatggcactcacttttttgaactgcagtaaggtgttcttcaacaattcctaatttttctgtgaatcgtttacttggacaatgccacattcacatatacatcccctaacatttgcatttattcagtttccttttaaaataagtgctaaacaaattaatggattttgaaggagaaaggctttcctttcaaaagaatggtaacctttatgtagttgtttttagatatttcctataaaacctgtctactctcgatacagtcagacatcttttcttcttttttaaatattaaaaataagcacataaaataagtcatttgttctttaaaaaacaaacaaaaaaaccaaaaaacaaaaaacctacaaacacaaaatcatgtaaaccagaaatctttcacagaggtcaagaagtcaaaagtaaacaccgacaatgaaacaccgacaatggtaagatccttgtgaggctctcgctccacctttctcattacttctatgtttccgtggcacaccacgggccagtgcttactaagacctctgcttagcgatggagttagtgggtctgcacctctgattgtgctgggcatgagacatactgattaaaaatggtaaaaggataaaggaactggcctttgagagacaacatggatgaatgatgagtttttgaattaaatttttgacagctttgatctttactgaaaatttaaatgaaaaacaaaacaaagcaaaacagagttccaggattttagaagtgccttttatcttaagtgaaatgttctcatcagaaactttggcatcccatccagtgcctttgatgctggctgtgaaacaagacaatccatcttcttagctgggaagacaggcccttcaccacccaggaaaccataacttgtaaacatcagtcaagttcagatggctacatttttacttcagaagttcgctttgcatttggagtggctcattaggggaaaagagagagagagagaaagggttatggaccaaagtgtgtttctcaaaaaattcatatgttgaacccctaacccccaatgtgatcgtatttggaggtagggcctttcgaaggtgattagggttagatgaggtcacgaggatgaggtcacaagccaggattggaaagcttgataagatgaaaaaaaaagagtgagctttctactctgtgtgagaacacagcaagaaggcatctctctgcaggccaggaagagaggcctcaccagcaatcaccttgatcttgaacgttccagcctccagaactcagagaactaaacatgtgcgtttaagtgcccagtctatgagactttcttttatagtagctggagcagactaataccgacagaccaagagagagaaaatggagagaaattttctggcttgtcttttaattattctttatttataaaaaaagccacattgatttttgcagcagtgatgcaagtgtgctgtgcataggtttgatgttctgctcaaattaagtctaagtttttccactaaaggaattatagtgttaatatgccaagagtcctatctgctcacgtacttccagtctctgtaaatacgtgcagcctgatatcaaagcaaaccttgaggccattaactataacattcttggagaaacagctgaagacctactaagaaaaaagtaccaaataaccaaagctggcaattacaattccaccccgaaaagaaggaaggcatgcatatgaattatgaaaaatagggactgtgcagctctcagattttcaacaatgaattgctcacattctacaccgtgtgtgttaaatgtttaaaagtaaaagatcccaaacattttgccaaatatgcagtgttccaaagggaagtatcaaaaggatactcatttataaaattatggttcagtagataaattataaggcctcaaagaacatgctgttacttctacttgccaatttataaattgactcaagtcttcatttaatttatgaaaaatcaaatcatctcaagaatgttttcgttatttttctctaccatgtaaaatatatgttttgtatgtttgataagttgtatcctgtcaattttagaatttagctatttggaacatataaaccacatttctacaactcaaaatagtataatgcttagttacctatctttaaaaaagtaatagtaatgcactgagatatttgggggtgggaggtggcggacacaagtttaactttcaaaaataagggccgtgtaaaataactgaaaaataatcctatttgaattaaaattgaataatattaaaaataaatttctactgaaaattacacctgtttctctattttatttttcttccttttaggatagcagaaaattctgttagataaatcagactaacatgggagacattgtaaatattaagaaacaatagtaggaagaggcggactcacattcatcttgctctttctgctattcccttccaaaaccaactgtgaacaagcactcagggtggccagggtacgtgaggaagcctcctctagcccagaaaaaaactttatttcacaaaaagttatccttcacaataaaaaacactattctataaaaattgtttcccctggccaggcgcagtggctcacgcctgtaatctcaacgctttgggaggctgaggcgggtggatcacgaggtcaggagatcgagaccatcctgactaacacggtgaaatcctgtctctaataaaaatacaaaaaattagccaggcgtcgtggtgggcgcctgtagtcacagctactcgggaggctgaggcaggagaatggcatgaacccaggaggcaaagcttgcagtgagccaagatcacaccactgcactccagcctgggtgacagagcgagactccttctcaaacaaaaaaaaaaaaaaaaaaaaaaaaaattgtctcccctgacttgagttatgggaaagagggttagcttcacttggccctccatgcccctgcccaggcacgtgtctgtattagtgttctgcagaggcaattcaaagtacattgtccaaagcccctctttgaaaatcttttgatgctgctgtaattcaatttggtttctatgttgaatctgaagttctgtgttactactaaccccctttctgtaggaaaaaaatgtatttttctatacaaacccatatgccatcgaggtacctgtatttaatatacctccatttagtagctaataaatatgtctatttgaaaactatttattcttccatacttaatcatagtgaactataaatccaaacttgacagcacaagaaaagtgacatttttcttctttcatttctatgctactttttccaaattatttcttgttctttttaaaaatgaagcaaagacatcatcattgttactattatgccttcagttaacaaaaaccttttaaaaagattatttgaaatgcatatgtaatatgcatgactacgttaacaggattatatgctattagatattgtgatataaaattacaactcactgggagatacagtcctctttgggcctctctcccttctatacatcttgctggacttgccaagatcaaaaggtcctgcccgcttttaacagactattactcagggttgcttatgcaactggtaacctaaagagataaggcaaggtcttcccctagacaaaaggcttgcatgcggcttgctataacagtagtcccagctcagtattcaccggctgtgatgcaaatccacccatgagtaagttccctctgagccaattgcttcattccctgcacacaagctgctgcactgctgagcactgtgtaataaagccctttgcctttggccccaagactcacgtcttccaccagcagcctgatacagtagcaggctcactgatttgtaagaggggtaaaatcaaaccccagacttgataataccatctacacagacattcactggtatgattcaagaatataaataactggtattcaatgtatccaaaaacaatcatgatgaatatttcaccaatgcattgctctttaaaataatacccaaataattatctgtactgtttccataccttgacctttcaactggacttttccttaatttgagcttttttgagttgtcatcagtgtcgtggagacttgcgccttccaattacacagtggtgttcaaacagaagaaattccaaacttttcttccttttgactataactaccctgggagtaaaatgtcccccaaataaaaacataaaataaataaaataaaagaaagaaagaaagtatctacttggcaagtgggaggtcagaagaaaaggggcttcaaacatcaaagaaggttctcaaaatactctttcaaatgaagaaagccccacgctcggtgccttatcttgcaagctcacatggccagacagcaacctttaaaggattatcttaacatgcggcgagctgggccctctcatgtgttctgaaatttaaaccagaaaatggctgcacaactgacatggttgtggggtgtgaaggggaatcaggaagagggaggagaggcttacatttccagaatgagccagagttcagataaagatatttgtgtaaaaaacaaagcaaccaggaatatgatcctgggctgtcaatttgtagaatacaatctaatacttatacgccataggtagtcacagaagttataagaaactacaagccctaaggcattttttagaatagaaatctctcttctccctctctctctctctctcttttttttttttttttgccaatatgtagtgtgggattttctttggctaaaaactgttccaatttccctgttttctaaatatactttactaagcatttttttttacaatcaggagtattgtaacctttgtatattttatcaataataaaataaatccataatttaaaaaaatcacacaaaagtgtataaagtaaaaagtcaaagtcccacatccccacctctgaatttcacctttatctgtgtgtatatgtatattttgatattgtattttgtaagtgtattgttctgtaatgtgctttttcatttaatagcatgattcacattcttccatgtcagtaaatacagagctttctatttttttcatgtctagacagtactttacaagatgattatattcagtaatgtatttaaccattcccctactgatgaatgttgaaatattttcccctaattttttactgtttcaaaatcaaaaatatgtacatcaacttcaagctttttactatagcccgtggactcttacgtgatttactacctgtctttgtcttcctctggaacttcttataccaaatctttgtgcccctggcctttcttccatgcctgggctaagccaaccttgtctctgcatctctgtggaatgtcctgtcccaaggtattggcgtggtggttcctgctgtctcatcactcgctccaaggttacttccttggtgaggtctttctagagctcctgttctacacaatctaatttatccttagtcaatatcttttataccttctcggtttattttctgtacagcacccatcaccctctggaataatcttgttcatgtatttcttactgtttactgttttcatgtaagatttttctctggtatgctctaatgtgtcctttattagaacaatgtctgccacatcataggctctcaataaacgtccactgagaagatgcataatggaagtatacttcaacttggattgtagcacatttacacaaatatttccattagagagatgcctcgaagtaaaattactgcccaaagatttgtacacacaaaatattgatgggtacttgccatgggtactgcaaaaaagctttaatggcaatttatattgtcaccaatattatggcaacggcccttttcccacaaatgcagttttataatgccaatttgacaggttataataatttttttgtaaattaaaaatcaccttgttctaaagaatctttttacatttatcacatttgtgttttatctccaaattaatcattgttgaaaatcttttttattcttttatcttttgggattacagaatgtcattctagttttcttccattattatacaagattgaaaggattttggttggctttcttagatcttatatccaaatgggatttattattatatgtggcataataagaactattattcttttaaaatgtattaattgtcttttgcttattaaaaaatagtcatggtggacatttctttaaattttcaaaaataaacacagaaaagaaaataaaaatcaccccaatagaaacttgcctgatttctttccactgcattccctgtaaaggtgtgttaatagaaatgtttctttgatcatacctataaagtggtgtttataaaaatgtttattcccggccaggcacgatgggtcatgcctgtaatcccagcactttgggaggccgaggtgggtggatcacctgaggtcgggagttcgagaccagcctgaccaacatggagaaaccccgcctctataaaaaatacaaaattagctgggtgtggtggtacataatcccagctacttgggaggctgagacaggagaatagcttgaacccgggaggtggaggttgcggtgactagagattgcaccattccatgccagcctgggcaacaagagtgaaactccatctcaaaataaaataaattttaaaaaattaaaatgtttattcccttatacaacattccctcatactcttttgtatacagtttgatatggtttggctgtgtccctacccaaatctcatctcgaattgtagttcccataatccccatgtgttacgggagggacccggtgggaggtagttgaatcctgaggccagttacccccatgcctgctgttctcatgatgtgaatgagttctcaggggagctgatggttttatcagggactttttccccttttgctcggcagttctccttgctgccatcatgtgatgaaggacatgtttgcttccccttccaccatgattgtaagttcactgaggcctctccagccatgcagaactgtgagtcaattaaacctctttcctttattaattacacagttttgggcagtcctttagagcagtgtgaggacaggctaatacactgttttttcgcttatgctatgaacattttcttttgaaaatgtgatttttaataatggtacagtatcttaatgtgtatgtgtattgtaatttgtatgagtgtattttaatggttcctattgttctacaagtaattcctttttctgttattaaaaattaacccaccaatgaaaacccatgctcataaaatctccaggaccatctctgatttcattcacaggatagattcctaaatgtggactcaataagaaaaggagtataaattatttcacagctcttttcaggccttttacaggcaggttgtgtgtactatttaaagtactattaatcccaccacatacaagatgtattaggtacttcttaagagtgcactgaatataagaaatctgttacaaaatgttagcagagcagaaagagaaaaaaagaaagaaaaaagggatagaatgagattagatcacctggtaaactgtaggaaacagctactgcccccaggactcaggaaactcaagaaagtactttatcagaacttctgagtgctgagtgcatgccaggacccctgaggatgggccgactgagtgggtagaaaccaccaaggcactgcctcccagtcacggaggagtggcatggagaagggatcacagacacttccagaagcaggagagagggaagggtagaaaagagaaaatgacagcgcctttcccctgacctgcctttggatccactgagcagatgtcacaggaactcgctggcaagggcatctgggaaatacagtttcctcccgagccaagcattgcggagcagcacaaagggcgtggctggggaagggttgggagaacagggaatcactctcacacccaagagtgcatggagcatatctgggtgtctacacaggtaagagagtgaggggtcaaaaccgggcttcttatgactctaaaatgtatttttagagcagttaccaggagagctgacattgttgaatctacctgagaagccagaagccagactctttgtattactacagaatgtgattccatgctgttgccaaatgccaggaatttctacatcgactgccatcaggacatggaagtctcattgtttcttaaaacgcaactattcttgaagacatggaaggtcatccttcttacatccttacatccttctttctgtggccctcctaggcttgtcacgagtcagcacgaatcccaaaggtaccagcagcacagaagctcacactctgtcatcagagctgggttggcagtgacagaaatgcttatgcaaacacaggctgacttctcactgaatgtatagaacatctaggaaagaaaggcaaaggatttaggccaaagcaatacctcaatgcagacaactaactagtggcagctagctagtcacctgctctcaactcttcaacgtccttcaaatattttctctaattgatatagcataatttgtgatgccaacaaccaagtgttttttcacaattacagagagccaaacctgtgtctctgctgctcccttaggctacttataatattggcctagttctcttagctgtcagcacaattaccttgtgattaaaaagataacatcaataggaatttcttttttatcagctaagccatggttacatgttgcatggacactagcactcattaccccatccatattttggtgagatttttgcccatttccttcgttttcacagaaaatgaaataaagcataagcttgttggttgcaaaggtgacatatagtaagtcaaataaacccataatgaagttcccttatacttcaggttagcttcaaaatcccactcaaatatgtatccaaaaagaaataaaacaggaaactttctggaataagttcttttgttgctatttttatattgaattggcaaatgtcatttcactgtctgaggtcaagggaacacaagggaacaggcagttctcgaaacagaaaagttggaggtgctgtgccgtctctagctaagaaaactctagttctatgaaatatcattccacctgagaaaattttcacatgattaaaagataacagtgccataaatctacccttgaacatcaggtgtgactcttactatactacccaatgtcttttaaaaaatatttagatcattagccaatttgtgtgggtgatacaattgtacacattccacaaaaatatcagccatttgtctagttcagcatctggtaatgtcaattaagggttttatttactcacaaagagaaaaaagtaaagatattagtttcaaattaagtccaacagtctattgagtacgtagtttaaatgtatttcagctcttcatcctccccagggcagagatcactggcagaaattagcatccacggataggaaccaacaacagggtagctgatgatgtttaggtgaactcccctctttataataacagaaataaccccttttcccctacaaagcccgtctacattttgcatagcactaaggatggcagacctaggagctgagttagccaaccctgaaggtatcctgcctcaagacttgtggctatttggaaaaataagcatcctcgtcatggggtcagtggaatcggggcagtttgctggagtgaaagcccccaattaggtcaccctgtacttgtcatcaagaatgagtacacatggcctctctatcatcaagtggccacctacgctttttgagtggtaattcttgaaatatggttttctctatgaagaaagcttttctctccatagaaaaagcttaacagcaaatttcactgtagtcgaaatgtttcacctttctttcctttttgatgtgatcgtcagctcttgactgcatctcgttttctcatgcctgctttctttctgctgtcagtcacaatcctttgtgacaaggtgggatcacctggcagatgatttggatgttgcctctcatggagatatatctcattgaccctttcgaattcagagatttttttttaatatagaaaaaaaggcatagcattttaacatcactaactaaggcaaaagataaggacactggactgaaaaaccaaggatgttgtataaatattcgtccttgtgtcactattttattggcttgaggtatccaggaaacaacttcatttccccaaattacattttattaccaaacaaaagatgaaaaaagtactacttatcccattaaactagcataatggttactttaattggaggggtgggagagaaagaaaggtgaatctacttagatttcttggagaaatgaacttacaaaaatggaagctggtggcaaagccaaagtgaaattcacgtttacttattccatgcaatatttctctgtccaacctatgtaaagcactacaaatgaatacagtcatagcaactaattgagttatcagcatctccagagtagatgttactagtatgtcctggcatatgaatggtagtattatgtgggatattagtagttcactaagagtcctataggacttcttgtgtctggaaaaagagtttagtgagtgatactgaaaaaccaacagcttggctcacgggcatcattgaacaaatggtactgagcatggaacgcagctactcagaacttatgagccaaatgggtgttttccgtacatggcttcttgtccagaatgctactgctattagcccaatggccatcactggttatcaaacatcctgacccaagtcaaagccagacgaagacagaaggccatcgtgggaaggtgaagcgattcatgcttagggcaagataattatttggtatcctttcaatccatttgttcaacatttgctcccaggagaggcgggatgcttcctggggacagattagagaagaagggacactgctaagtgctcatgtattatttcaagcagttcactctgggccccgacccaaatcctcaggcaacaaagcagcaccctgcaggtaataggaactgtcttctttagaaagcagtgtggtgaccaggtgttgctaatcatcagagtctcttggtgactcacagccgccctcatgcagctttgcgagttctgactgccaacacacacaggactcttcctaagtattatttcagctgaattctgggatgtgaacatcagactttcaaacccggctttctcactttctactggggtgaccctaaatacaagttatttcatttctctggactcagtttcctcatttataaacatgagaataacattatctactccactggttgctgtgaggaccaaataaaataacacaattaaggtgttatctggtatataataaccattcgataaaacttagcgattattatttatggcatccattccacaatggtactcaatggtactgtgtacactgcctaagaatcctaacctttatttttgctccactcatcacttctatttccagttctgtgatgccaacaaattgggtaattgtacagcagcatgttattatgtttcttcacctccccttcttactatgggtcccttctccgccttcctcaaacatggcagccctgtgggatgttgaggctcttgaggctcctcagtttgaaatgaatgagcttgctgaagtggaaacattagaagggcatgattggcagattattttgctccagcaccttcttgacagaagtgcacaaagctcttcaagaagatggagctgctgccagatgccctctgtccagcctcctggaagcccaggagaaagctggagtggacgccatccttctggcctcctcctgaaggacatactggtttccttaatttcttttctactttttgtccttcagtctgttgtccctgcacagctatagagaaaacaaggattacagattccatgtcgttttgcagccagggaacatctttggctagagatttgacggaagtcagtgccaagtggctgtgtccctgtaagcagtccattatttctaatggtctatttgcatgcaaacctccaggccagaggcagaagtaaacatcccagaaacttgtccctggagactctgggacactctcatttacacgctgtgctccattcacggcgctgagtttactcacacgtgctacacatgcgatcctcacgacagccctgtaagatggtattagcatctccattttatcagaagaaaaataacttccgagagggttaagcaatgggtaaacacggacataaatatggcaacaagagacactggggactactagagaggggagtgagggaggagggagggttgaaaaactaactattcggtgctatgctcactacttgcgttgcagaatgatttgaaccccaaagctcagcatcacgcaatatacccatccagcaaacctacacaggtaccacctgaatgtaaaataaaagttgaaattataaaaaattgtaaattacaaataaatgaataaataaaattttttaaaatacagttaagaaggggactttgcagtctggtgtacctgacactaaagcccgtgtatctttaccatatcatgtttaaaaaatcattttcaagagaggcaagaaatttcagtggagaaaaagactgagtatgtagaatggaagattctctagatgtgttgattttgtttatcacggtgtcaactaccggaggagtaggcaattttatgtggatgtagaccatgcacctttatcaggagtactttttcaggtcaattcccttccctagcactaaaaataattaatagatctctttgagagactaagacagtgaggagaaagtacatttacctaccacaactaatgagacctgaataactggaacagaatatttggaaaaaaataatggtttaaatggttaacgatgtgtaactagtaatataatagctacttcaacggagctttcatgtaaaacagaatttcattgcaagtttaagttttcttttgagaaaaatttggctatgtaaaggtgagtttggcaattttaagtttacaacttattggtcaataagtagtagtaagcctcttttgtgtttgttgagttaataaactatggttcttggacaatttctttgttggatgttaatctataactcttatttgacctgttatttgacatttctaacctcttccttaaacattaaccagaaccctgagtactttcttttccaacacgggtaagggattgattttttttcttaatttcataacttatgaagctaaaatgtgcaatattttgactgagtgaattaggaattcttgttgggatttgggaaaaagaaagttatgagaaactgatgactgcctatgtaatacttcctttataggaaattcttaatacccttatataggaaattttaatacccttcttacatatcttttgttcctggtgacatagaagaacaagtttaacaacatcttaagaaagaaaattattaaatatttacagtcacaaacctttgttcaaaaaagcacttaaaaattatatttaatagagtttaattgagtaaagtgaatcacatagccctcaaactagaataggtttagagagactagtgtttttgtgtggtcaaagaagacttatggaaaaaaaaggaaaatgatgtacagaaaatggaagtcaggtacacaaacagttgtattggttacaccttggtgtctatttgaactgctttgaagaatttgtcacctttcagaggccaaaacttggtgatcttcgtgattggaacaagaggaggttatagcctgattacacagtttactctgtacagggaaaactttaggccagacttaaaatacgcaaggaggcagcttaggctaaatttgctttaacaattctctctttatggtcaacctccaaaaatcatgaggggttaaccaaaactctaggcactgatgacattttgtcactattataaacatattcacacagttttaaattttattgggaagtagttggatagtgggttttgtaaagtgaaaagaaggactttaggttacttttctgtaaggattagagtagaaggaacctctgtgtgttgaaattttttgattttaggagataaaacctggtctgctatagtttttttttttttttaagttttagtttgtttatgtgatatttagtatgagtgactttagtttggtttggtctggtcggttggagcctagtacatgagtttagtcaaaagcaatagcctcttataattttatgttttatttatttatttgtttgtttgtttatttatttatttattcatttattggataggtgagagggtgacccaaactttactgttggcttcgtggtacttttagctattattattttcagttttcggtctcagtgtgtcttatatgttacagtgacttgttgatcactttttggagtttttgttgtttgggttgaagagggaccagttgacagtttatagatgtctgtatgtaaacatttgagaaaatatagtattttggggaggctactattatgactattaggaagataatattaagagtttgaaatatggtttctggtcagagtctctatgaatcaattaaaattgaagagttttaaacgtgagttagataaatagtatttgttttagccaagtagtctgttaatctctcacaattgaatctttataatttttatgtataacaaaaagtgttcataacaaaacagattctttttgtgtagtcaatggataatctagtgtgattttattattaggaacaattttagtaacagaatttagtcttttgtgtaacaatagtctttgtagtagaatttcttatggagtctattatgagggatgcatttataatgactgtcccatttattttaaactatggaaaaagagacctaataagtcatgtatcctgagaagagtgaaggacaaaatctttaggccaaacgttataaatagaatgaaacagctttagactaaacttcatgtaacaccttcaagtgtgagccacagtgatgagtaaccagggtctcaagctggtattttttcaagcaaaaaatacttcaaaaaagccactggagtaggggtggggagcgggtaagaagatccatatctgcttatcaactcctgtttttttttttttccatttctttttgtatttggtgtctacaaaagagccttaacatggtttaataaacatgtgtcatagactgcatggagttgcttatgttgtttcaggatacttaaaggaaatgctcactggaacgttctagattttggatttggaatgttcacccagttaagtatactgtaaatattcaaaactccagaaaaatagtctgaaatacagaacacttatggtcctatgaattttggatagggatactagacatgtacttacaaaatggttttgaaaattccttagtacaagaaagactctgccaatctgatacaaatatggctttgtacacacacacacacacacacacaaacacacaccccactctctctctctagatatatatacatatatatacatattaacatataacacatatacacaagtaaatatacttttcactgaattttgggtggacatggacccacggttcttgtctgggacatcagctactaggtctgagtcccctgtctgtgccctgtgcatctgggaatgtgtacacactcttcaaaactccagttaatcaccatcctccctgggaagcttccatgctagaggattgaggaatccaactcttgagaaacaagaacatcctcttcagctcttcattctaatacttagcagatatcatagtgttttcttagttgggagactagattctgtctccctcatttgccccaacttcatgcccactggagctccagacacccactggaggaggcagtgacaacaggatttgcctccaaagaacacagaccgcacccttgtgtgaataagggaattttgttactcctgattactttacccatcctagaatacgctgaatttagccataaaagaagttgaaaaagatactcagaagaagaaaaaagaacactagagtggcaaattgtattatattaccagttttacacatatccacatggatccttatgtttgtggggtccacagcctgaccactgtaatccctcacattcatgtttccccgccgtgtagaaaagctatacagggtattcctgctgtacacgcagccactgtgcaaagatgaccctactctccttggcactgaggagccgaagtcatcccctgagagagaggcagcctacaaatgaatacctggggccaggggcctccagagaggggagttactacaccaggcaatgcttctctcccagacagcttgaatattaaatgtgtaaacatactagacagcaaagtagtgccgaaaccaagaaatggacacacggagagagagggggaaagggaaggggagagggagggagtgggagagggagacggagagtgagagggaaagggagggggagggggaggggaggaggagagagagaggcagaaggagaagaacagggagagggagagggagggaggggggagggggaggggaaagggggaggaagagggggagagggagagggaaagagagaggtaggaagagaccacgaggagagaggaggaggaagacaaagtaaaggcaggaggagaagcccagtctgggaggtagagacagcaacaacttgagtcatgcgctggacacagtgcccacttagcaggaaccgctgcagctacagatgggtcccaaatcatgaacgaggacgttctggttgcacttccatcctaagaggatggtggagggtgatgctttttgtttcttactcatttccctgtgcatccatacagttagccaataccctctaaagtaataaaagtgtatttctgctccgagtaacttggttgaactaatattcaaatccaaatctgcagactggtaggctgactaggctatgtgaatgtgtaaggaacacagaatgtgcatacaaattccatacagacagagaggactgggctggcattaaggaagaccagtcacttcagaggactggccaagaggccagtgacaccacgctcggtgacaccacagctcttctcatggtttcaaccccagaggcagatattcttggctgccttcttgagtgccctgacgggggccactccttttgtctctttctttgatttctctgggtgcagactaaaattctccttgaatctagttcaaactgtccaaaagaggggatctattcagttcgattcatcacactggatggagttcttagaccaacacacgccacaggcccatggccagcctacagatcggctccctgatgtcatgccatggccatggaaagactgaaccatcacagaaggggctgccagcactgggacaggcatgtaagtcatatgagaccatctaccttggtcaaccaggcagtgctaatcgggagagtaagaggacagcacggagattagcaacccaaagcaataccccagcaggtattagagttgaccattggagcttggcatgttttggttattaatactccaaactattcatgcttaaggcaatgtggaatttcaagtgaaagccagatggttcttgggcaagaggaggaaagaaaaacaaagcatcatgtgcttgggagaacgcctagtaaaacaagaggatcccagtctctcccagcagagtgtgggcatcgttcactccctttggtacaatccattccctttctcgtcgggattcacacagcatggtcaaaggcaatactttaacatcacgaaatcaagctaggtttacaaatgtaaggtaagagataaagaaagaccatctatctggagttcttttctcccctttctttctatgtgtagaataaaaggacagagaagagacagaaatttaaagggaaacaaggcaagtgctgaaataaacctgccatctattttaagtgaaacaatttatttgggtttcaagaatacttttttctgtctctcgttcttcctaaatcccagattatcagtctaatcgaagatcataaaggagatgacaaaacaattatcagagagaaaactggattccacttagcagcggctaccaaaagtacagtttaatgtgttttcaatgaggtgggcccctgggggcctgaacacccacaggccaacggatgtttctatgtaagaagagcaacgtcatcagcaaaagcaatttcccacttttattaatccagtttattttaaggcatgattattcaagctttcgtctgctatagttagtcttgtattttcaggataataagactggtgaggctagttatcaagtgcctatgcacagaattcaaatggcctttgttctacctggcagtctcaagaactgttaaatgagcttaaactttattacaagaagaaacagaacatgctgagtgaaaggtctgcttagttgcttaccataaaaccacaactacttaggaaacttatgctctgcatattctaaacctgaaggagcctctaatggggcatttggggtcagttttaagatgattcctcaaaaatgcccccaaataagacctggaaggggattccacacttggctgtctctgcagagccacaggcaacaacacagaggtgccatgatttatttaatggaagcttggtagtgactcaatatcaagaactcaccttgagaagccacatttcaagtatctgaaaacaactggcaggcctttattcaaatactttaaatagatcaaagctgtttattctctaaactcctctccccttcttacacattttaaccaagtcaatgttttccttctatttctctcagaggtctaaacatctctaaactatatttggcctaaagttttgcttgaccacatgattttaagaactgttgaatttgagtgccattgccagggaagctgggaagatggctggataccagcatttacaaaggtctcatcactccatgagtgataaattcccatttctcacatggttcctatgggctgggagtaggagtcctcaattcattgtccttctgaaaggcccagatctatgaattgggagattacttgtattcagcagttacattttctactttttgtgggctttgaggagattagaaggggtaagagaaagatatttgacatacttctttctctacccctcaagactaaataaatactaactcaactatcttactacttcaagtttctaaataaatctcccattcagggtcaggctaatccccttaactctcctctccagtatcattctgatcccatccgacacctcccaaactgagcctcaatgcctttcccgcatggacccgcctctggctggtgaagccaaaggtcctgagagcatgcatgtggacagagctaggcaggtttccttggcgtctcctggggacgtcacatattatcctccattatgattgtcacagtacatggtatgagcagacaatagattttaaggcactttaaaaaaatgcttgtgtaaatgaaatggagcatttggattcaatttagtagccttatacaatatctgctttttatttcagagaagacttctgaggtagctgatgaacatgccggcagagaggttgaattccgaggtgaaccagtcattccaatccaagggagacagcgtttggaagctttaatgtaaacagaaaccctgcgggactcacttgtgcatacagctgtcaaaacaattcaatatccagagataaacagggtataagacacccactagtatattatactggaatgcaacatctttttaaaattatgttgccatattctgtactttatcgagtaccttccattttaatatttcatctaatagactgtaatttggcactttgggtagtaaatagtgaattaaatgctgatgtggcttattagggcaagtaaatttgaaatcaagtatagtgatagcattataatgtgacatgtcatcagtttacagaagagatttctcaaaggaacacagagttctgaatacatgggtgttggtatcatcatagagaacagcaagtattcattattcatttaggaaaggaaatgtgtacctggataatagtttaaagctatatatatatatatacacacatatatatatgtgtgtatatatatatatgtatatatacacacatatatatgtgtgtatatatatgtatatatacacacatatatatgtgtgtatatatatatatatgtatatatacatatatatatgtatcattaacatcaaggctgcatgaaccaatttgctttgcacaaagacacaggagaggtggtatcaagtagtggaaggagttgtggctttggagttaaagatactcattcagattctatcatttgctagatataagccttgagaaatatacttctgtgggcttcaatgctctctactgtttaaaaaaaaaccttgaaaaattccaccttgcagcattgttttcaaattgtcaatttcaactggcgctcagtgaatgggaggtgttggaaatgaagacattcagcacataaataaggaagtaaggtgtttaagagtctgtatcactggacctatgggcagtctttctgggccactgtcaagcctccctttttgagaagctacaacagccacatgggagagtccagcgaccagagtggccgccgtggtccagataaggaaaaccgccatggattcagccagacttagagcaggatccgcaggcgaaccgttcttcctcttccagctatttctggataagcccactgtgtcccttcctctgcagagcacacctgcatctttgattccccaccttgaagtccttgtcctttcctagcctgagtcattccactcagctcaaaagacagtgtctgggcatcgtctccattggaagacagttcctgatgtttcctaaagttctctttactcccccgtcacatcctcatagcatgcagcaataaatagaaattaccctgtttttcaattatatttctataactattgttgccctcctccctttcagtaatgtaaaaaattttcacagtatcttctgtatcctaattttccccactcaattcgatttttgagatgaactggcagctgcctattaccttttactttttcctctctaagtgatacttttagtaagcaatttacagctacctccaaggtgaatttgtgtgtaacttaattacattcacttataccctcattataattacagtagcttaaaatccccatctgtggaacaaaagatgtttccatttatcatgtttctattgtgtataagctgtccttaatattaaacaccacaatactctcaaaagatgagactatctctggtaaatgctatacctgtcccccccactatctctttataaatgcctcagttaaaaatgatatgtttttaccattacgcacttttttctgatttttttttattagtccaaagaaataaagtgctaacaaatagctgggtggatgaagtgagtgaggccattaatattctatactgatagttaatatacattctcttttccacattacgtccttagacttcaggcataactccaagtaaaaattcaacagaataaggaaaactgcattcattagtagaattgtttttctttttcccttataacacagcacaattgcagatcaggagacacacaagcagacctcccagactcgtgggtcacacttagggggttattggtcaaaaatttctggatatctgctttctgagaaagtagcaagattttgctggcatttactttttgataattaaaactagatttttattttatcctataatcggtagtattctcccccactcagagtcataaataaggttaaatagtacaagacgtatttagtcacctaatgatgctgatgatccatctcagccaaaacaaatccttaaaaccaggcaaataatattaatctcacaaaagaagcaactgttaactagaaatggaaatccaattaaatacatttcctgaataattaaataataatgaaaacttgaggaacatgtacaggcatacctcagagatactaagggttcagtttctgaccactgtgtaaagtgaatatagcaatacagggaggcatacaagttttgtggtttcctagtgaatagaaatgttacatttatacaatgctgtagtctattaagcgtataatagcattatgtatataaaaacagcatacaaactttaatttaaaaatacgttattgctaaaaaatgctaacaattacccgagccttcaacaactgtaatctttttgctcatggaaggtcttgctttgatattgatgactgctgactgactaggatggtggttgctagaagttgggatgactgtggcaatttcttataaaaagacaacagtgaagtttgctgcactgattggctctttctttcatgaaagatttctccatagcatatgatgctgatagcattttacccagagtagaatgtattttcaaatttggagttaatcctctcaaaccctctcaaagccactgctttatcagctaagttatgcagtatctaaatccttggatgtcatttcaacaacgttcacagcatcttcaccaggagcacattccatctcaataaactgctttctttgttcatccgtaagaagcaactcctcacctgttcatgttttattatgagattgcagcaatttggtcacatcttcaggctccaatttaattctagatctcttgctattttcaccacatctgcgatgacttcctgtgctgaagtcttgaagacctcaaagtcatccatgaggactggaatccacttcttccaaactcatgttaatgttaatattttgacctcttcccatgaatcacaaattttcttaatgacatctagaatggtgaattatttccaattaacttttcccagttccattagaggcatccctacctatggcagttatagcctaatgaaatgtatttcttgaataataagacttgaaaattagaattactccttgattcatgggctacagaatgaccgttatgttagcaagcatgaaaacaacattcacctccttgaacatctccatcagagctcttgggtaaccagctgcatcatgaatgagtggtaatgttctgaagagtcatttttttctgagcattagggcacagtaaggctcaacagtggacttaaaatattcactcgagtatgccctaaacacaggtaccatcatccaggctgtgttgttgcatttacaaagcaaggtcagagtagattcagcataatccttaagggccctaggactatcagaatggtaaatgagcattagcttcaacttaaagtcaccaggtacatttgcccttcacaaaagggcaggctgttcttggaagctttgaagccatgcattgattttttctctttagctatgaaagtcctggatagcatcttccaatagaaggctgtttcatctacactgaagatctgttgtttactgttgtcaccttcatcgatgatcataaccagaacttctgggtgacttgctgcagcttctacatcagcacttgctgcttcaccttacatgtctatgcagtggagatggcttctctccttcaacttcatcaaccaacctctactaccttcaaatgtttcttgtgcatcttcctcacctctctcagccttcatgatattaaaaagagttagacccttgtctgaatcaggtcttggctcaatggaatgttgtaactggcttgaacttctattcagaccactaaaatgttctccacatcagcaatgagactgtctcacattcatattatttatgtgttcactggagtagcacttccctcaagaatttttcctttgcattcacaaattggctatttggcacaagaggcctagttttcaacctgtctcagttttggacatggcttcctcattgagctaaattattcctagcttttgatttaaagtgagagatttgcaactcctcctttcacttgaatgctcagaggccactgtaggattattagctggcctgatttcaatattattttgtctccgagaatagggaagcccaaggagaggaagagaggtgggggaactgctggtcagtggagcagtcagaagacacacattaagtttgccaccttgtaagggagcagttcatcgcactccaaaacaataagatcaaagatcaccgctcacagatcaccaaagcagataaagtgataaactttaaaatattgcaagaattaccaaatgatagagatagagtgagcacatgttgttggaaagatggtgctgctaatagacttgcttgatacagggttgccacaaagcttcaatttgtaaaaaaaaaaaaaaacaaaaaaaaaaaacactcattatctgcaaagcatgctaaagggaagcatggtaaaatgagctgtgcctgtgataccagcaaatatttattacacgctgcatttctttaaattgtcttatatggcgggtattactttttcctatttcacaggtcagaaagctgcaatgcagagaggagaaatgatttgtttaaggaagtagagtaagtaggcatcagaggcagcattacattagcttcgaagtctttattttcactaaaataccctgccttcccctcccttttgttgctctgtgtcccactttagtatgaaggggcctatgtttatatcacagtaaagtcatgacttaagtagttttagacatagtatttcccccctcatgaaatttaactcctgcagcctattctatttctttaacaaagacatacagaatcatattaattatctttttaaaaaacctgaaaataccatcaagatacttatggaactcacatgaaagtgaaatagggagtatgtccccattccctcaaggaattgagtaataaactaagttttaaccaccaatggtagcaggtttgcatgccacttcacccagataacataaacacaccagttatctgcaacccctgtacgcccaacatggtataaagcaaaaagagaaccatttaacagcttttatattagctagtcattccagtaataaaacaggaagacaatcatacataaatgtcaccacacaaaaactttctctattacttattaataaccaacctgataatatcattaacggcttgtagagctaattgcggtggctttttactgctccctttgatatgtgcactatcctgaggaggataacatctgttagatctaactcatcccaaacatcaaatgtgacaccgtggtgtttaaataacttgactgcgcgctatttcagcaggtcctttcccgctctcctttctcatcttcacaaggctgaccacaggcagaggccttcctgtgctcattactgagtttcatgcagacacgatggagtgggagggaaagtttattaccttcattctgcttgaatccatccctgactttttggtccttcacagatttctttgggaaaataaaaatgatatattgttttctgaacaaaaggaaattaatttcaatcttttaaaaaccaacttgaatgttattcagttcggttttttccctaaaaaaaaaagtttcagattccaaagtttttcaaaaagtaacttcaaatttcatctatgtcaaaataagtaaaataggtcctcttgtcctattgagaatgacaagctcagtataatcttggaaaaatcaatttctataaatgactaacccgccaattgtattttgattttttttaaaaaaagaggtgcctatgcagatgcaggatacatataaatatagagtcaaccatctcctagtgactcaatcattaaatatttagctgacttaaattacactgcatgcatggggactacagttaatgacgatgtattgtggaaaatgctgagagactggatggtgtgttctcccagcaaaatgctaactaagtgaggtaatacatttgataatttgctaaatttaaccgtgccacagtgtctgtctacttcaaaacagcacgtggtatataataaaaacatataattttatgtcaagtttaaaagtatatttatactaaaaattaaactcatttttaaccctatagtttatgtgaaactatatgttatgtaactgaaatattttcacctaatgtgaaatcttgtctctgctcctgccacaaaacagaaacatgagaaagtccactcgtacttgtcagaggtgggttctcttcatcttgctgattcctctggtgggtctggtaaggctgagcttggtgttccctggactcccagaatggtttgggtccagcactgggctggccctcaggaggctgccctgcacatccccgtgcctgtgctgggttccgccccagcctgtctgtgaaatatgcgtgtacgtacgtgtgcacatatgtgcgtgtatgcatgtgtgtgcgcaggtataagggacagagacagacagatgaacacagatggagaaagaaaaattggtaggttgtattgagattccaatcaaaatctaaaatatgattttatagtttcaaactcaatctaaaccttttttgcagggtaatgttttatgactaagcagacgcagaagtcactctcaaataaatatagactacgtcaataaggtaacattgcattcaattatctccccaaggcagaatccctgtcttttctaaatgatgtaaataccttgttctctgtgtccacaatttaaaatggaagttaattaaaaagtcgacttgagcagggaccccaaatatagattcatttatttatttatttttaagttacacaaaagtattactatactagggtgcacactacaaaatatgctaatagaatttttgaagcaatgatgtgaataaaatgaatgaaacattttagaaggttcataaaggcaacaagaattgaaaatccagtaattacacactaagaaaaaataagcaaaaaaaaaaaaaaaaaaaaatttctccaaccaaatgtttactggaaggctgtgataatttttatactaaaggttattattctcaacaaaagcttatttttttccttagtaatagttcttaagctcaatttacaagcacaaattctctaatcttattgtgagaaggctgttacgaataatttttgttgttcatacagagaaattgagaaacaacgataataattgctcaaattattgaagttaagaagaaaataaaaattaatggtctagtgtttattcttataaaccctcctcacaacacacacacacacacacacacacagagagagagagagagagagagagagagagagagagagagagagagagagagaaattttccacttgtctgcaaatagtccctaaggttcttagccaaggtgtgtacctcaaagtctaaagtatgaagacttaaaagtggaatcaacagagcattttatcatgaaagccacacaagtgtggtatctgaaatggtgttctaaacatccttcgaatgctgccttttcttcaccttattgccaggaaaagcacagaagaatgcgtcaggtggaaatctgcatgggaggacaagcaatgaaacaaggtggcctctggctgagtagatgcactcactcattcctccaaccagcgctgtctgtgctaactccatggcggaattcctctgagtgctggggaacacaacagtgaacgtgacagacaaggtccttgtaaaacacacggtctcgtggggaaggcagagccaacaacacaaaaatattctctgcaaagcagagaactgaggtaaactcgtgtggttgtcagtgactggggtgttattttaggagaaggctgaattcatgcaattcttgagttaattatgttcttcgggctggccctggggactgcagtggcaatggaccaggtttcattgcaggaggagggtgttggcagcgactctgggcagtgtggggctaggccgaggaaggcgcctgaggagacagacacccttcctctctgacctctagggcccaggtccagcttcccaagacacccagcacaaggaaagctccaatcgtcatctttcatttctatcaagagtgacacttacggatctctaacaacgtttctatccaattttgggtctctaactatgtttctatcctgatgaaaaaagccagagggtttaataagaaaatgaaaattaaatgcactacttcctcacttagcacacagcaaggttgaggggcagcttttctgagcctgaccctaggaatttcctaactcaggtcaaaaggtgactgactcccaagccaaaggtctctaaggacaggtgtgttaataacaccactgccatgggtggagctttcagaggtctccaaggacagatgtcttaacaacactgctgccatgggtggagcctctctgtgccacgtactgtgctcggggagggacatgaaccacctcaccctggacccctctctcttctccagtatctgcattacatgtgcccagggggcccttctctactctgctgggatgccagcatctggcccagcatctggcacagaacagactcagcccaaatgtagaatataaagtcgggtatgggggtctgatgccctggcaaaggaactgaaagacttacccactgtccagtccaaagtccctaaaagaaagtcacagaggccaagaccccagacactttttgtccccaacacccaaagcttcattttaaaatcctttcagttcctccagaaaaaaaaaaaaaaaaacaaaaaaacctgaccctcaattcttagacattttatgtaaatgaggagaaagtaaggtgctagcccttcccgatcacttcttgttttgaatggatgtgtgagtcctgccaaagtgcaggctagtttgtgttctccaaatgcctcctagctcagtgagggtggtgtgcgcagggctgggatgggccacacaacatataggagcccaaatagcaagaaggcagttggagcacagcttaatcctgttgaaagaagccaccaagaagagctggggcaccggtgggtgcaggtgatgagcaaagctaccttcttccctaggtaatgattgcccatggggaaataatcagtaattcttcatctaggaaaatactagttgctgttcagagcctctgactggaagtgaggcatttccaagtatcaaacaatgattaaaagaaataaaaaacctttgcatcttggcatgctcatttaagaaagaaaacaaaatagacgtacacacagcccatttgcattccctctacccagtctaaaaggtgtccgatgattcattttaatcatttaccaatttcttggtaaccagtgtgtattgcagcagatacttggcaaaagcatgttaatttgctactaatatctgtataaaccagacattaatattctcaatttacaaataagcaaccagaacttcagcgaagataagtaacttagccaagattatccttctaataagtggtaaagctggaattcaaacacaggcctagtggagtccaaagctttccccactcctcagtaaaaagctaaacaaacttcctaattttctgagcttcctacatactctttgcactagggtaacaaccccatggctggctttattgcagagtttctctgcactggcatttggcctttgcctgtctaattttggctagttgcataagattctcacttagtgcaggctcaaggtgagacagtatttttgttttttcttaggtttatctctggagattgccaatgcttgcaagaatagcaatgctatcattaacctaataatgttggattaacttcaagagctgggtaatagcgccaatgttcatttcccgtaaatgttggaaactcctttaacctcatgagatcctacataacgtgggaaagagtccagttctgactccaaaatcttaataattcactctttcgttaactgctttttaaaaattaaatgtataacaccaaatagtgaaaaataataataatcagtttgtacctaaatttctttaaagaaatttttagttttttaaagaaatctttccaatgattctgactttttggaggggaatgccacatggtgattatactgctaaggtatatatatatatatatatatacacacacacacacacacacacacacacacaccttatatatatatatatatttggatttttttgagacagagtctcgttctgtcacccagtctggagtgcactggcacaatctcagctcactgcaaccttcgcctcccgggttcaagtgattctcctgcctcagcctcctgagtagctaggactatagatgcccccaccacgcctggctaatatttgtatttttttagtacagtcggggttttgccatgttggccaggctgatctcgaactcctgacctcaactgatccacccacctcggccttccaaagtgctgggattacaggcatgaaccacaatgcccagccctgctaaggtatattaacggtcagtttagtattatttgactatttgttaacataataggagtaaaacttaacactttttagggtagagatggtacaaaaaattaaagtgtaataaatataaatctataaaaacagaagttaaataagaagaaatcttctggggaagaagaaataatagagtatagattattcttaacgtaagtcaaatatttgataaggaccacaggcaccttcttttaattcagatgctgaattttctttagtcctagaaagaagtgttgttagaattccaaggatatttggatgaaacttcgctgtaaactcacgtggaaactattttagctggccacagatgtgaaactaaaaatgttgaaatacttatttcaagtgcatctcgaaaatctgcaatgacttcctcctggaagataattttcttactacgcatgcttgacatggatttcgaacatctgcaatgacttcatccaggaagataattttcttactgcgcatgcttgacgtggatttcgaaaatctgcaatgacttcctcctggaagataatcttcttactgcgcatgcttgacgtggatttcgaaaatctgcaatgacttcctcctggaagataattttcttactgcgcatgcttgacgtggatttcgaacatctgcaatgacttcctcctggaagataattttcttactgcgcatgcttgacgtggatttcgaaaatctgcaatgacttcctcctggaagataattttcttactgcgcatgcttgacgtggatttcgaaaatctgcaatgacttccttctggaagataattttcttactgcgcatgcttgacgtggatttcgaacatctgcaatgacttcatcctggaagataattttcttactgcacatgcttgacgtggatttcgaacatctgcaatgacttcatcttggaagataattttcttactgctcatgcttgacagctgggtctccacactgcatcacttccaggctcctttcacacagccctcctggcattctgcctggaaatatgtcatatagcaagtttcacacttttttaacatacttgcaaaaaatcttaggttagtgctaacctaagattagtgcattgtttctaaaaggccaacgcattacatttttcctgagaataaatattgacaactccaggatttaaatagtgcacttggctaagattatggattttaggtagtctgtatatctttatgatattgtcctatgtattttaacattcttcacttttcttagtactgccatttcatgatttttttttccttttggatgctattgattagtacataaattccttggttgtacaccctgttttcattgctaatccagtagaagaaaagcaatatgcccaaaatcttttacaaaaaaaaaagctttcttgcatctgctgcttgcattctttgtgtgatacagtattttctctcattattgttggtcttcaaaggcaacaacagcataaggtctgctcaggccagagggcctcctgatatagtcctcatggagaccacacagagcctttccaagaggtcaaaggaggccagaagtttttggttctttttctcctaacttttatgttcatcccaggtaagcctccatctccaatctctgtctactagaatctatacacaagctggtgcaccagcttgcctgctctcacttgccttcctttgatgataccataatgtctctgattctacaacttaatttttctttcactcaagtctagtccagtagatacacattcctgttatggcaaaagatcatgtactgctatttatggaactgtaatttattctgtacttataggtgaattaggcaaaccaataatgccagcaaagcatatagattgaggccaacatttgcagtcattagacaaagtggactcagccactatttctaagtctttagtttggcctaatacctaatgttacattgatgccatactgtaagctccttgaagtaattttctacatttttaaaactcagcctatcattgctaaaataataaaaattctaatgcaagttgctctttatttctattacctgtaaggacacttgtatttgagaatacacacttgaaatgagttaaatataccaacatggatgtttggcttcaaagaccaggagcatgtcggatccgggctcactgctaagctttctctgactaggcatataaatcaacatcttcagtgcttttagggccaccatgcagcaattccatgatgcttggctcaagctctgcgcatctcacattagtcctcctttcacccaagctggctccagtaattgggtgactgttctggcagaatcatgtgctaccatttaaagtgaactagacaaccagttgatactgggtgaggataggagattcttttttttttttttttttttttgagacagagtctcgctctgttgcccaggctggagtgcaatggtgcactctcagctcactgcaacctccacctccagggttcaaacgattctcctttctcagtcccctgagtggctgggattacaagtgcctgccaccacgcccagctaatttttgtatttttagtagagacggggtttcaccatgctggctaggagttggtctcaaactcctgacctcgtgatccacctgtcttggcctcccaaagtgctgggattacaggcctgagccaccatacccggccgaggctaggagattcatagaggacagagaagacattctaggcttcatattgaaattgtaaatgtgaacccataaacaagtcaatagagatcaacttttgcatgcacgatcttatttactcttacataataccaccaactaccacttaactggaatgtcataatgtagaatctagacaatctttattaaattattaaattagctagaatcactcaacatggtattgtggtaagagtaaataataaattttatctagcaaatttatttttggatatacattacttcaaatagttgtgtgaccacaggagcatcataactctcaccggttttttcttctgggagacagctaataaacaactttactacaatttagaaaataatcctttagatttagttaaaattaaaaacatttcatatactggtagctcaaataaaattttggttgctcactaaaccatattatttctcagacatgattatatggtcattttgattacaaaagaaatacaaagcaaagtttatttggaaaccttttcaaatgtttctacattgttagcaaagcattatatattttcaaaagtatccaaaattttttttgttacactgtagtaacttataatctagcttgtatttcctattttcccataatattaacaaacatttacgtatttgagaaagaattccttgaagcataatgagaatatacttgttcaaaaatctcgctttcatgttttcattttaggactataaacattaggtagttcagaagaggaggtgcaatgcaaaaggtcctctgcaatgctagggagctctgggcaaagtgagagcgttctgctttcccttagagaggtcctggcctaaaatgaacacgtacttccacgagcttcgggtgtgatacagaaatatgtatgactctatgtaatccttatcatggcgttcctaccaactcaaacatttttaaggttaactgagtactcgatgtaattgtaatacatccacctagtcactactacaagatagtctgtgtggctgcaggctatgaaggatagctttttattttttccttatcaaggtaatatttggaacacttcaaaaaagccatcacagtgccattatagatgaaaggcttcccggtagaaatttcatttcctatacctgtaacaggctttcctgcagaaatgatagcatatgtgatacatccaaaaggcttatctcatgaagtcccagtgaaatgtattaattttgcttttggaaaataaaaacatcactaatttactgagaactctgcaatgcagtgtaaattctgtacccaagaagtagagctcatcacttaagtgaatagaaaagtagcctatagatgttactgtggttatgataaaacacttttaaatcctgtatatgtttaaagtttaaagaaaagcatttgcatctcgttttcctagtgtaattaattggaccttgaatgttgtatgtttccctgtgatatttgaatgaaagccaggggttgtcttattatttgccttaatatctatttgcagtaaaaagctaacaaagaagtgtccaaatttgcaggtagtgaacccccatttaaaagatatactatctcaatcaactcacctatgtaactttattaatataaaaagagatatcctggctgagggcagccagaagttactctgggataactagccttcaagacgtacctcttggtagtcatactctagcataataccttcccacaatgaattatggctgccctgtgtgatcaatacaatataacagcagtaacaatatgtgctagattatataaaggaatgcagctgccacttgaacatttggattgctcatccaggggaagccagctgtcctgccatgggaacacagacactgtcctgcagaaaggtccaaacagagaagaactgaaggcccttggccaacagccagcatcaatttgccacatgcacttcagtttgccacagtgccaaccacattggaagtgaatcttctatcatcagttaagtcttcagatgaatgtagctcactgacatctaactgccattgcatgagatacccaaatcaagaatcgcccagcagtctctccacaattccagacctacgcaaaccatgaaagataatgcatgactattgtcctaggccatacgttttgaagtaactcattatgcagccatagacactgatacaaacgccaaagttacaagaaattctcctttgtttgcaaaaaaaaaaagaaagttcttactccagatgcccactgtcacctggggttgttgtgtggtttagcagtttgaatttcaaggtgcatatgctttaaaataaagggctggctctcaggcctagtctgtctagctgagcatacatataggactattattatctgagttattaacatttcttcaaacacagcattatccagtttaaattctgtcttcctcagtagacactaagttgtagaactcaggcactgtgctgtacccaatgcaccaggcaccttttctggtatacagtaaaagctcagtaaatgttggagacaggaatatgtcattcatatgtgaataattaaatgtagacaaagcgaatcgaatcatttcttgaagcctaatgagttctgggcaaggccttaagctgagttaagagttactattgcagagcttttgttttcacttccaggcagtccttggaatgctgctgggccattttgtttgtatatgtactaaaccagctgggattgtaggagttttagaatgttttgaaagaataaatttctctgaaatgagaagtggattgtcattttaggattcggagtagttgaggatgtgttcctcgtgtttgaacaggagtgcagtcagcattagtgttgtccagccctccttgctgccccaccacatagaatatcgagccagctagtccctttgtttttaggtgggacgtgtcactagttctggctaacaaggtggaacgatgggtatcacttcccagccagagcataagacgccaactcttccctgcctttgtgactgtggcaacttgtcatggtggagcctcgtgacaaggaccttgtctgtcgcgttcactgttgtcactcagtcagcctggagcccgaggtcccacatcgagcagacccactctggacccgtcgcttgtgttagaaaacattttttgttgttgtgtaaagccactggaactattggcacatttgttacagaaacataattttctgtgctgataaaggccagtgtaagatcgatataaattaatcaccctcccatatgcacatgcacacacacacacatttatacaaaagaagcaatcatatttactgtgtttttacctgcccagaattcttctccttttttggtaagaacaacttcactgacttctgagaaaccacaagtctgatgcatttaggttcaaggtgggctaacttatcccctaaacacacaggcatgaacacacacacacaatatacacacaggcatagggtttgactagggtgggcctatccacctgtttagttcccatggccatagtggtgttggagatagtatgcaaccgaggacagcgcaataagggtcactcctatgacttttgctggaactattaagaaagaggccttctcttcccactaggcttgctaactgatagaatgtaagcctgaagcttatggtgcctttctgtcaccaagaggacacagctgacttaatgaagtaaattccagaaaatttgcttaattattgttaaatgattctgtgaactctcttcatttagcaactgttcaggaaggtaagaaaaagaagcaaactcgggaatatcaacagatttgagatgtctgaattaacttcgagcacctggattaagtcatgtctaggccaacattaatgccaggaactcaaatatttaatccaacaatctctctttttttcttacgccagtctggctggatttctgcttcttgtaattgaaagagtcctagctaatacatcttctatatgcacacggctgtactagatatttggaggtagatggaaatgcagaagccgaagacaagcaaatataacatggtccttgcttcagaaatttaaaatttgtttacagggacaactataataaatgaaaagctaaacgctccaatccatgagctcttccagcagcgttaaggaggtctagaaaagctacttatttcctgcactgtcaccgctgacattgagtgttagggaactccttacccatttttattgaggcagaagagcacactcggcagtagaaatgtaagattttggccggtcacagtggctcatgcctgtaatcctagcactttgggaggccaaggtgggtggatcacttgaggtcaggagttcaagaacagcctggccaatgtagtgaaaccccatctctagtaaaaatacaaaaattatctgggcatggtgactcccacctgtaagccaagctacttgggaggctgaggcctgagaaccacttgagcctagtacctggacgttgcagtgagctgggatctcaccactgcactccaccctgggtgacagagcaggattctgactcaaaaaaaaaaaaaaaaaagaaagattttctcaaatttgtggaaaagaaactaaacaaaaattcactatgaatcaatttactataaaagttctatttaacacttgcaacataaagcaaatactttaaaattaaaaatcccagagtgctatgtaatacaaacatgaaaaacatataaaaggcttctagtatcatttcctaactaacatctggcttactgaataaagctttataacatcaacttcatttttccacagttattatcataggtagttataatgtttttcttaaaaaaatgaatatcaacacaaatttgctgttataaagagtaagacaacttcagccagatctttctctttttgttttttttttttgagacagagttttgctcttatcacccaggctggagtgcaatggcacaatctcggctcactgaaacctctgcctcctgggtgcaagcgattctcctgcctcagcctcccaagtagctgggattacaggcacccagcaccacacccagctaatttttgtatttttagtaaagactgggtttcaccagttggccaggctggttttgaattcctgacctcaggtgatccacccgcctcagcctcccaaagtgctgggattacaggcgtgaggcactccacctgggccagccagatcttttaacttcatcaggatcttcactttattttcagggaaacaaatatgcaaatctccttttctctacagtaatctgtgtgtatattacatgatgtggcaaatgatacattcctgcttgccacaactaattttcactaatttctccagatattctatttaagagggctattttctaatgggcaatctttaatattgatccagtaatttaccatacagactcaagaaaaagaaactgaagatgtaaatttttacttcagcaaaataccttcttcacatgacttaaaacataaacatgattatcaggaagtattatgaaaaatgggactatgaaaaatgggacaataaaaattctcctagggaaacttccatcaacaagaggggacggaaaaacagcattttctctcaccaaggaacaatcccctccccattttttttcatcttgttggtgaaactctaaaatgaatgtgaaagccacataagcaacagcaattgggtaggaactgtggaaggaagccagagatattgtcatggagagacatcttcctgaaagtgaggggaacactgaggggtcaaaatcagaatggggtaaaccaatgggtggatagctccactagaccaaatttggtttagagtaacagaggaggcaggtgaaaattaataatcacacagcaaggccacggttggaagaagcagtctgtatccatgaggcagagagtaagaaagtgagcaatactagaatagcaggtggactactgctctacgccccaccacatacaggacacccctccacaatacatgtccatgaaacccaagtattcaatgttgaataacacatacacacacacacatgcatgtatgcatgcatgcacacaatctatacaaacatactacaagaaaaagtctatttatagactaagaaatctcatcagaaaaatgttgttactcaacagaactctctggcaacctattctagtaagaaatgaaaaccaaacaatgaatcaaccaagcagttgtgtccatgaaacaagacaacagagcagaaatacaagagctggagacataacagagaaacttaaggaacaactgaaaaaaaaataaaaataagatgtgaagtgacacaaaggtacaaactcactgcaaaaagcactacaaggaaaaagatagaaaaaagaacaatgagctaaacggcctgtatgatttggaaaaaaaagaaatcaaagaagaggctgggcacagtggctcacgcttgtaattgcggcactttgggaggccaaagtgggcggatcaccttaggtgaggagtttgagaccagcctggtccaccatggtgaaaccccatctgtactgaaaatacaaaaattagctgggcatggtggcaggtgcctgtaatcccagctacttgggaggctgaggcaggagaattgcttgaacctgggaggtggaagttgcagtgacctgagattgtgccactgcactccagcctgggtgacagagcaagactctgtctcaagaaaaaaacaaacaaacaacaacaaaaaaaaaaaacaaagaagatttgaatctacatatggaaataacactttgtaataaaaggaaaatgacctgtagacaacaccagattataacttattaaaatgatcagtttgtggtttgtggagcaaaagaatcttctggacagccaagcagaaagatcaattcacttatgtggagaaataaatcagacttgcctctgactttcccacagcaacatgtaaatatcaaaaaaaaaaaaaaaaaaaaaagctaaaatgacaccagtaaaaaacacaaggaaagagtgttccaagaaaagtaatacagcatgttgaatattgttctcaaaattttttggaaaaaaccgaactatcattagcttaataatagaactaagactgaaatcattgtggattttagggtaatggaaaacagtttagtgcactttgtcctgactgtaaaacaacagcatttctttaaaatgggaggtgaaccagaaaaggtagatgggtgggaagcagaggaagtacatttcttaaaacagaggatacatcttttctcaaatgcttatggaacagtcatttccttgaagagactgcatatcaggccccaataaaatatgaattaatttgaatgagggaactactatatacatcatactctgagtacaatgtaatatacacttagaaattaataaagcaaaaataacgtgttattaatttaaaataattattttaagcaattcttgaataaaataggaaatccaaatgagaatcacagaatatagtaaaaacattgatgataatggaaacgcaacacaaggcaacccacgctgtgcatctgaactgatgctcagagaaaaattcatagttgcaaaagcaagtgtttttaaaaacaaggaataaaaagtatgttttcatgccaaaatgtggcaaatggagacagaactacgattaaatatatataaacaacataaccataaaagtcagaaaaaaagaatattaagaaaaaaatagaaattgctgaatcagaaaatgggcaaaaagagcagaaacatcaaataaactaaaaagctagttcttcactgggaaaaaaaaaaacctatgcagatactccttgacttacaataggtttatatcaccataaattcattgtaagttgaaaataccataatctgaaaatgcatttaatacatttaactatggcatatcatagcttactgtagcctactttaaatgtgttcagaacacttacattagcctacagctgggcaaaatcatctaagaaaaagcctatttttataataaagtgttaaatatctcatgtaatttattgaatactgaaagtgaaaagcagaatggctgtgtgggtagttcaattacggttcctactgaatgcctatcacttttccactattgaaaactcaaaaaatcatgtcaaaccatcataagttgagcatcatctttaagcaataaacttcaaactaatataaggaaagagaaagaaaatatacaaaattaaaataaggagaatggtaaatatgagggaaagaactttgcacaattctttgtaaatttattaacttgaagtaaatgaacaactttataagaaaatagaatttatcaaaattgagtcaagacaggaaatctcatcagaccaatttccacagaagcaaacagttattttggactcgataactttttaaccagctttaagcaacttctagagattattctgagtatttcaaaccacagtgttgccgggtgaagtggctcatcccagtaatcccagcactttgagaggccaaggcaggaggatcacctaaggccaggaattcaagaccagcctggccgacatggcaaaacccagtctctaccaaaaaacaaaaattacccaggtgtggtggcacacacctgtaattccagctactcgagaggctaaggcactagaatcgcttgaacccagaaagcagaggttgcagtgagctgagattgcaccactgcactccagcctgggtgacagagtgagactctgtctcaaaaaaaaaaaaaaaaagtttcaaaccatagtgtcattccgataagcagtattattccagcgtttgccaaccatgctcaggcatggagagttaaggaaattaatagccatatgtacttttctccaaaaggaatctatcggaacacaaggccgttcccacactttccacttcccactcacagttgcccccctactccctcacggtaaaacaaatgcagaagtctcactcttgagggctcttagcttaattcattgtctcggggtataagactttaggctgacccccaaaaaaggaaaagttaaaatatgtgtgtccactcagcctcctttaactaaagcactatacaataaatcataaatagtaggggtttgtgtctttccttgtcatatatatatatatttcttttatttcctttttttttttttaagacaaggtctttctctgttgcacaagctggagtacagtggtgtgatcacagctcaccgaagcctgaagcctcaaactcttggcctcaagtgatcttcctgcctcagcctccttagtagctagaatgccatcatatctgagtgattgttttttagctttcttagagacaaggtcctgctgtattgcccgggctggtttcacactcctaggctcaagtctcgggctcccaaagtgctggggttacaggcatgagccactctgcctggccctgtcatgcatatatttctgttaagggtatagggatatctggccagtgttgggatggtctggactcagatacccatgaagatctcatctagtctcaaggctttaaacaccgtctggattctcactcccagatttatatcttttccgccttgctttgttctcaacataactggccaacttcttctcaacattggtttacagcatgtccatgaacgtgaaattctttcaactcacaaggcccaacaccatctggcgcctttcgtcacttgtagctcgcctccagctctcctcactcactctggcctccagcctctcctgccagcgaatgcttgcccccttggagctttgggcttgctgctcctttaatctcattcttccccatgcagccctgtgcctcactccctcacccgggctgcgtctttactcaaatgccttcttgtcaaagaggtcgaccactccgccttatttagaactgcactctctgcttcctatccccagcgagttttatttttatctacagcatatatcaccatctgaaataccactgtgcatatctgatggatttatcttgtctgtcgtcagccttttctctttaaaaggaggctccaagagggcaccggtgattcctttccattgtgtgaagctgtaacccccacacctaaaacacagcctgacacaggtgtcagaaatagttactgaatccctggaatcatcaccgtattcctggattcaggaatggggaaaaaagtgttccatctgaggacagaactggatcaagttccaaagcagcctcaaagtttggatgggattggagtggggagtgacacaagtcgttgtaattacatgggcggggaaatcatggagttttgtgggaggaaggccaatgtcagaagaacgtttcagggaaatgggtccaggtggctcacttatcatcattaaaaagctatgcaagtttttacttctctttctcctctatccataaagtcctggtggtgaaggcttacctgtttttttcatggcattaaaccgaaccattcacttcatgattttgcctggtatcccagtaggtcttccctatcctaatacataaaatagaggttggttggcaatttgctgcttcatctgtcagtttagaaataatcctttttggccgggtgcagtggctcatgcctgtaatcccagcactttgggaggctgaggcaggcggatcacgaggtcaggagttcgagaccagcctgaccaacctggtgaaacccccatctctactaaaaatacaaaaattagccgatgtggtggcatgtgcctgtaatcccagctactcaggaggctgaggcaggagaatcatttaaacacaggaggtggaggttgcagtgagccgagatcgcacgattgcactccagcctgggcgacagagtgagactctgtcagaaaaaaaaaaaaagaaagaaagaaagaaagaaaatccttttttcttttcctcattagcaaagagctcagtgcttcctccaaaaggatattgggtctagaaatttgccaaatacctgtgagcatgtcctttaggattccaaatagtacactcatattttgaaatttggcaaaggcttgaaaccaacacttatgggtttttggtttgtttgtttcactcttgttgcccaggctagagtgcagtggtacaatcttggctcactgcaacctccacctcccaggttcaagcgattctcctacctcagcctcccgagtagctcggactacaggcgtgcaccaccacacccagctaattttgtattttgagtagagacggggttttgccatgttgggcaggctggtctcgaactcctgacctcaggtgatctgcccgcctcggcctcccaaagtgctgggattacaggcgtgagctactgcgaccggccacttctgattttttaaaaagtgaacatagagccacacaccaagtaaggaaatacttttagcagcatagaatccaacgcttgccttccttcatagatctctatatacacaaaatagaaatgaaaccaagcactaggcctatattattaatgcaagaagtgtttgcttgggattggatgagcaaaaatgtcataaaaacaaaacaccatgaatgtttcacaatatgccccgctcagaggtcagcccctccatgtgtcctgcagagctcctgaagcctttaagagacaactcaaaaaaggagtgaggcagcctgttctgacacttggacgtcttccaacgcagactttcagtattatttttctaaacatcctaaatctctagtgagaacatggaatagactatttctgtaatggcagatcttacaaaagagaaacaacttcccgaaaacatgcctatgtccagtcacagagaccaagcatcaaaatcacctgcaggggtttctctaagtcgccctcacacatgcttggacatctgtatgaattcaatgcacagtaaatactcctttgagggtctcttatggacaagacttcgagagaagaataagatacattctgcctccaaggaactcatcatctagtccacggtgtgtggtgatgggaatgcagatgccaggtgctatgaagtgaaccgtgtcacccccaacatttacatgctaaagctctaaactcagatacctcagaatgttttgggggacacggcctttaaagaggtgatcaagttaaaatgaacccattagggtggacccgaatctaatctgaatggtgtccttataggaaggcaagattaggacaggagagatactggcgttgcaggagcccagaagaaacgctacgcgggggtgtagtgagaatgtgccatccgcaagccaaggagacaggcctcaggaaaaaccacctgctggcactgtgcactcagagtaaaccccgagtgatctcagagttctagactccagacctgggagaacatataaaccacgcagtctgtggtatggcggccctagcaaactaactcacctgaatgtaaatatacaactacaaagcaacaaataaaaagatggcaacaacaagcaagcaatggaatggaccctcctgctgggctgaacatcaagacagggatttagaaccagctttacacaaggagcatcatttttccctaggtatgatttttatccaattcactttgattaatgacagctaccatttagcaagggctttttatgtgccaggcaccaaactcaacacttttcatgcattcacttactcaaccttcactgcaaccatgtaagatcgttgccattgttattccaaatggacagatgtggacactaaaacagagaggtaaattttgacctttgctgaagtcagatggctgcaagagttggaactagagttcaagtccaaagagtccaactctagaatccttagaaccactgtgcatactgcatgaacagtactcttaccttctctagtcaagagttcaatgtgaactttattccagaaaaacacaccattcaacatcttcatcaaatattataaagaatgcagtacttagatatagactctctatgcagcatttcctagctacatttgacctctctgtttcaatgtatctgtgtagcaaatattctatgaaacacaatttcttaattattgacctcgttgtgtctttaccagcactgtgactataccatgtggtgtgagagtcactccagtgaataaacacagactgaggtcaagagtctaatcattaccaaggccctgggaaccctccttgaagagaagagataggagcgcactatccaccatgaaaagttgaggtaggtagcaaagtcagtgtctacaccacccgccagcttctcctcccctcttccacacgggtgcatggctgccaccacttcctgatgggaagcttttcagaatacagataacatcctcactctcctgcctccctccccaccccagtatttttatttagtagatctggtatggctctaggaagctattcttgaaagtttaataatgattccaactttctgccaggtttaagagccataataatgttgaccaaaattgtagattttccaggatactctaagctttgataattttgtgcggacagttactagatcatgtgatctaaacgagggttggaaatacccccatttatattcccaggcagactttcccttgcccacttccaaagcaacctagactttgggactactctattccctcactgctcttgccctcactcacttaaaatacttttatctaatacaaaggtgctagatgttgacctgattgaagtagagctgttaagaggtaactgaagcttcagctaaataatgccagggggtaacattgtccagggaaactgttcaccagcagacctctgttgctcctgatgtactccaagttattttcagtttagcctttcataacgttgtacaaagaggctttattcataaaacagtagctttggttggcctcccacatcgtgaaaacaaatgtaatatagtaattaagtgtgctgatatgttatcattgcaaatgtcaagttcattgtagcagatgtgtcaactgaagatcactacccattaaaatcaaacaaccagtaggccccaaactcaccatctgatttcatgcgtcaacttcaatgcttaagacagtcaatcacaactgtcttccatgtaattgtcttaaaattattacataacaaagaatcagatctcaattcttatcacctgctagtcataattaaaatgtgaatgaagggctaatgactgacacagttacagggtataaaatactttcacaattttacttccccaaatagatggcattattattaagaaaaattactcaaaatgtgaaataaggaaaaaaacgactgatgtgttaatgtcttgctagagcaaagctcactaaatctccttgaactctctagagaaatgtaacttggttaaacttactacattttctattcatttgggcccaggtattttacacattttaaagtttgggttcctaatttaaaaaaaaaaagtgataaaatcagatgactaatatttttatcaagttaaaaagttttattatccagtaggataataaattagccactatgatatctacatcttttcaattttatttcagcatttctttttcatctgactatataaaattcctactctcatatcttcttttgaaccagttttgtcatcctgctgattccctcattagtagtcacatggatcttatgaaaataaatataatatcccattagaaacatatctgctactagtcggggtacttacataaagttgcagcaattatcagaaaaaggtaatatgcaagtctcctctaaaatttcccaactatattcagaaaaaaaaaacaaaacaaaagcttaagtgactgcttaggtgaaaataagacttccagaagaatgtctgtcaaagttgtaccaagaacattttgaaaatacaggttaattcaaagaagcactcacaaaatgccctcaatatgattttgagaggaattattacaagtggtatgtattcttgaaagccaggtttagggtacatctctaaagcagaataggttgttttcaaattgctaggtcattcaaggcctttaaaccactatattctatccataatttgcaaacgtaccactaacttacactaaagagatagtgagaaataagttcttgtggaagcaatttacacatacagagttgactataaagtcctaggcactttggcaaacatgcttaggggtggaaagtttcttttttggtaaagatcccatagattactatttacattttagcatcatctaaacaatctggaagctcctgaagctcatgtctcatcttcaccatggacacaatcacatattcttactctaagcatctctcatttttattctagttgattctcattcttcattcttcgtaaatgattataatgaatcctctgcctcttccttcccctcttcttcacctcactttcccctcccctcccagctttccctctgccttctcctcccctccccgctccttgtcttccatccctgcctctcccactccccctgtctctctgacactgttgtctccaaccacacacaggctccctgggtttctttcacaaataaaggaacgatttgcatagatggggtaatgtgcatctgcttttgtggtgtaccttccattcttcctttcttctgggaatagtaactccctcccttttcttttcttttgtattttttttttatagacagtgtctcactctattgcccaggctggagtgcagtggcacaatcataactcatgacagcctcaaactcctgggcttctgcgatcctcctgcctcaacctcctgagtagttggaactacaggtgtgctctaccatgcctgccatatttttttttgagagggggtctcactatgttgcccaggctggtctcaagcttctggcttaaagtgatcatccagccttggcctccccaaatgctggcattacaggtgtgcaccaccacgcccagacccctctcccttttctgtagcacaccccaccctcaccccatgcacttttgcatgattatcaatatgggttgaaccacatgaaattgccaattttgtagatcaaacatgatagaatattagcaaatagaatcatgagattgaacatatccttttaataacactaacgtattcagtattttatcaagcatataatttaaagttgtattactagttataaatttaatatttacctctttcaagcccaagcacaaaatatttggtttgtttaaactacatcatgtaggatgaaattaatacctcaagtgggattctcaacacactaactagaaacagctctcagagaagataattcaaagacgaatttaaaatcaatcccacagcaagtaaaaccaacttttttaccaagtagttcagtcacatgggagcagcggaatcagtgtgacattttcttttcacgggatatgtgcaaccatgctgtttaaaagggaagaaataagataagctgattttatttccaccagtgaaaaaagttttcaatacagcagctttcatcgactcagcatggctaacaaaataacattatcaatgaaaataaaataatagatcagctgcacaatctaggcatttttgtttttagaggccttctctaacatttctctgtagagatctgtgaatgcctggttcctgtgaatgaaaaccaccctgctgttttttctgctcctgctgagagacttgcaaagaataaaatctttttttttttccagctggagatcaattggtttgaggactgctctggcccccaggaagtattctttgcccccatggggggaagagatcctcagttccccaccctgaccagagtttgcccccattggatagttttcaaagctgaatccagaaacagacctaaaagcatatccaaaaaatgtgccactgaaaaacagctaacgattcacatggaaagtccacaccctccatctagccgggtctcctcctgcctcccttggggaagaagggggagaatgccctttccaatttcgctcgactgaaagcaagggctgtgtctgtcccccttgctgaaaagcctccttttgtttttcttttctactgtcaggaagcctgcctcagaggagtggacaatgcataccaatgaggaaaggagagcagaggtgattgaaagtgaagataatttttccctgtcatttacaggctgcttctcaaaccatgccccttttgtgattccacttcaaaacacattcttgccaactctcatccaggaggcttttccttagtgatctgctccactatcttggagtttggcttctgttatcacctgaggagctgaaaagcgttcagattcaaggaagcctctcctctgcccaaatcagcagaatttaaggctcatgaggatgaggactgtgacagggaagaaggaggtgacagggaaaggaaatgatactttagcttatttcattgttgaatggagcaaagttgaaaatgattcttctggtgtctctccttaaatcttggggtattgatacagactcatacaaaaatgaaaaggagagaaatgaacatattcatatagtcctttggggtttcacagtgatctacctacagcgacatgttattttaaattacaataatctatttaaagagaaatatggtggaatttacttttaaaaaggttacgttgcagggatgttttaaaagataaaaattaaatggcaactcaaaaaatatctgtcaggcatttaaaaatggatttcaagacaagcatttgaatcctactttacaagaagtgactaggttaattaggaaaataaggtatcttctgataacagtaaaccttgagatacatgtgtagctcttataccggaatgaccatgaatcactaacaaatttactttctagacaaaagatggaccacttagacagcacagtataagaaacaaggaatgttaaatgaagcttaacatcatgtaacagatgttaggttttctcctctcccccaaggaggactgtaatactgttggagatgacacttgtcaactgtgcaatgtgtgtgataaattacagaagcaaaaacataatattattatttaataatccattttaaatatcactgtcatttaaataccacctgtaagaaaagttgtataaatttggcaatgaaaaatacacaatccagaaaaaattacaattaaggatcaggtttttctttgaatatagttataatttttaaaaatcccttatcacttttattaactataattattaggagactggagacaaatataaccattgaagcaaactgagtacctttcaagggccaccgtctttttcctctaacctcctcaggctcacatccccacctcaccccaccacatttaaattactttaaaaacactaaaaaatgtttcctatattagaaatttgaatctatcaaccctgatacttctttagatcctggaactccctttgctttaaacacaatgtccaactattgagaaagaaatttcccataaagaaaaccatagtatttctttggtcacagctgagaggcatttttttttttctgatctggaaaacaacaatcacagaaagcaggttgtttgcaaaatgagatcttaatttacttaaaaacagaatagtaagatgaacctactaaaagtaacaccatagcactgctacaaatgatttacagttgttcacattactgccataatattggaacgataaatgacatgccaaggggctcaaagtaaatttctggagttgaactgcacaaagcaaattgctgagtttgtgtcatatcctaccgtgaggatggcatatctagagcaaggctcaatctagaaggtgtctggactgaggattctagggtacgatgaataacaaatggaacaaagatgtcacccacaggaagtggggactacgggactcactgtggacacctaagccaccgcctccctatgcgatgaaaatctgttcttcatagcaatccagtatacattcaaacaagcagaagaacaacacggggtaagggctacttaactaacttatattatcctattttccatggaattccagcaatcataagaaaaagttccatcttcttggttttgaatgttttaaattaaaagaatttcccttcccaacactacaaatatgtacaatgacacattaaatacaactgtgctttctaaaacctgatacttgacagagagctcttcttcaaagctcaactgcaagttaaattttactgcttatcttttgtttatcaccaacaagaaaaaaattgagcttgagaactgtaagcttataactgggtaaattatgttttgtataagaaatacaagtatccatatttggattacttttgtatagatgggatatacaaaggtgccgacattacaggactgaaaaaaagagccaacttgttttgcattaaaacatttttttaaactttcaaaacaataagagactagtggtctcttaaacacagtttaatgaatttatctctggcaatgtattgtgatatgtttgtgtgataaacctgataccatgaaaacatgaaaataatttctggaatgtttcatttcttaagcaaaaatttcttaaatatgaaaattgggggcttcttctgtgcagtaataggtaagaccagtctggtctgaagcccatatcaaatatttcaacatttcatgcctatataattggctttaaaagactaaaaactctctgtacagtctgttttttttattgttgtttttctcagtccttaatatcctggagtcagaacaaatgaagaagccccatcagcttcagaccacgacacacagcttgcaagagtaaatgatttatggagctacaagcatgagttatgagggagcggtctacatatttgcgttgtgtagctatgcagggggaaagagacaaatgagattcttgaaacatttgtgaaatatagaaaggaagaaaatagaaaaaagttaataagctgcctcagatagtaactaattagatagcaaggtattactgacaaaatgaaacaagaacaaaaggcaacaaaagttggtttagggccaaacattatctgtattttcacttttggatctctactcatttcctttttttccatttcattcaaaaaactattgtgcaaatcaccattctattgtcttctaacattgccgctattttcactggattttattcaatttaggaattaaattaaaagtttcaacatttccagtcatgttattctttcatgttttttgccttaaggagtagaccatagacatcacctattttaatagtttcatctagtccagaatcggcacttggagcttcaagctgggggttagggagaaagcacagacacaggcaggctgctatgctgggccctaagggcaatgtcaaactcaagattgcagatacaggctgggcgcggtggctcacgcctgtagtcccagcactttgggaggctgaggcaggtggatcacttgaggtcaagaattcaagaccagcctggccaacatggggaaatcctgtctctactaaaaatacaaaaaatcagccaggtgtagtggcaggcacctataatgccagctactcgggaggctgaagcaggagaattgcccgaacctgggaggtggagactgcagtgagctgaaatcatgccactgcactccagcctgggccacagggtgagactctgtctcaacaataacaacaaaaaagatttcagatacagagctgttggctttaggaaatgcacagaacttactgctccataatacaaacaaaactttaaaagggtgatgactgattccagattactcttgcttttatcttaagctaatctctgtgttaggtaaggacaagcaggtttgaacggctgttaggacaaggcatcattgtctacaggtgttatgatgaccatgaagattagaaagtagtgaatctgccgggcgtggtggctcacacctgtaatcccagcactttgggaggccaaggcggctggatcacgaggtcaggagatcaagaccatcctggctaacatggtgaaacccctatctctactaaaatacaaaaaaaaaattagccgcgcatggttggtggtgcctgtagtcccagctactcgggaggctgaagcaggagaatggcataagcccaggaggcggaggttgcagtgaaccaagatcgcaccactgcactccagcctggtcaactgagcaagactccgtctcaaaaaaaaaaaaaaaaagtgaatctttgaagttttaaaataatgctatctatggatagaataaaataatcagaatggaaagtgtaaagatgacatatatatagtgagcattcttaaaactgattatcattgatgtccatctattaattaggctgccttacaaaggaacggattttctatcactggaggcactgtatatttttataacttgttcccaaacttatgattttacagaccagtaaaatttctgttcttttatttaagaaaattaagatatctgatgctaaggaacagttaaaattttcactgatttctgagagatggcaaaatgctagtaaacaacacctcttcaaaaacaataggattctacttccttcacttctgaatgtttctgaaatcgaagatgcggcagaaccatcaattccaggttcaccttgccggcaaccctgcgtaatagacttagcgtagctacaattggttgtgcctacgcaaaaatagccaactggggaaagttatttggactggtaacactagaaactatttaaattttaacacgagtgtcacaccactttgtttaaatgtgttcaaacagaagacacaatgtggcaccgaaatgcagcaattgtgtggaggcaatcaagtatcacagggcagataatgaattcaataaaggcagctgaaattgccaaatcttcaaaaggtagaaacagatcgtgtgaagagtatcactcatgtatctaaatatctttatggtgaaagcttcctactttaagagtagctgttcaacacttagtgatatgtgattaagaggtaattaagaagttaagaaggccaggctcatggctcacacctgtaatcccagcactttgggagggtgaagcgggtaggtcacaaggtcaacagatcatgaccatcctggccaacatgatgaaacccgtctgtactaaaaatacaaaaattagctggacctggtgacacccatctgtagtcccagctacttgggaggctgaggcaagggaatcgcttgaacccgggaggcagaggatgcagtgagcccaaattgcgccactgcactccagcctggtgacagagtgagactgtctcaaaaaaagttaagacaacctcaaatttaaataaagaaatgtatttttagaatatattattcagactattctgactaatgggagatcttcataggtaatactcagcaacactcgttaataggcatctctccatttgaaagactgcaaaacgctgaattctgttgtttagtgcactgaattttaatcatttaaaaattgtgatgtctttaaatcaggcatgccatctccagttctcagtggctccactactttccaatatttgacctccagtatcatgctttaaaataccggcctggcacttgtggacatttgtgctaatggcccttggtttccatttataccactgccataacaatgacaaaattgtcgagggtgagtatttgtttgcacattctgtcctattttcctaaataatatattttttaaatcctcatttaagtgctttccatattttcccaccatttgaatcccccagaccccacctctacctggtgacattcaagataatcgtagcagagcagctttagctgtcaagaagtctgtcctttgctaagaggtggtaaggatggttaattattctgatcaagtctattcggtctgtgccaagaagaaaactatgtttctggaggtaggatggaagcaaagtcactagatttccttccttctccttttcatattccttacaagttgctgagtaagtatattttatttggaagcattttgataaattcaattaaacctgctgccaggctgtaagaatttttctgtgtgtagtttgtgggcagaacatcatcaatcagttttctccaccatttttggtttctagactattcctgtagttaaataaaaagtatatttactatattctcaaattattttctttctgctctttttcttaataacttacctacttactgacacgtgattggggacagacaatattttacatttctacaaagcattttatctcatttttctatttctaaaatgaaaatttgagtaaagatgtacatccttaaattctgtacacagaaaatatactaaaatgaatcaacttaataatcaattaaagaaattttttatttaaaaatggataagaatgtgtttgaaatatatggttcagtcttaaactaaacacaaagcagttctcctaactaaacagctgttttaaatctatagctcttctgctccagcatcctaacagctggaggaaattagagtccagagagacatgtgcataatttgaattaaacagatgcgggctgtgaagacaatcaaacaacacagggtaagagatgcaaacaatattactgaaactccaaggagtttttattttttattttcataatgatggcaaatgtggccatagttgtgatacaaactacctacccatcctagtaaaaagtcgtgactttttttcaaaagtgcaaaaggaaacatgccaaattctaaatcaaagccaggacagggccatctctgtatttttccatttatagcactcttgatgccacgcgttgactgtgagctaggggtcgctgcctttcctgcccccggcagccgggcatcccctgaggggatctgcatcctgcaaaacatgccaggccactcacaccatcacatgctggcagctgtgggggcagaagactgaggaagagtgagagatgaccagaagctgaagggagacatatgtaaagtagaaaaggagtaacttaaatgtcattttctgattcaaaatatgagtgacctgctttaatgagcaaaaccctgcatttaaagccacaagtagttcaagcactgagggccagatggtaccctttgaaattaaagcgctctcaaatggaacatagcagggaacctccctgtgcccgactgtgtaacaacacttctcccagataatgtccgttaacgtttatggctttcggtttctagctcagttcatgaacgtgtttacgggtcttctgttgagaaatcaagagttagtgtccacgtggcaggttttccaagacctaagtgtgaacgtgatcatcacatttcttccacctcttcaccttcatagtagacttttcaatactccatgaactcttgattactgatatgaagcacaataaatatagacaagcatttggaaaacagcctgagggttctgtaaatagctaaacattttaccacatgacccggcaattctactctaggtatacgcccaagagcagtaaaaacataggcctatacaaaagcctgcacacaaatattcatggtagcatcattcacgatactcaacaagtagaaacaacccaaatgtccatcaactcattagtggataaataaaatatggtacatacatacaatggaatattatttggcaataaaaatgaagtgcagattcatgctatgacatagatgaaacttgaaaacattgtactaagtgaaagaaggcaatcacaaaaagatatatattgtgtaattccatttatatgaaatgtccacaatagacaaatccacagaaagtaaattaatggttgccaggaactgagaaaagggaatgactgctactgagtatgaggttttcttttggggttgatgaaagtgttctgaaattgattgtggtggtggagtgaaaacgctcccaagatactaaaaaccatagaatggtatgcttaaatgggtgaagtgcatagcatgtggactgcatatcaacaaagttgaggccagcactcaaagagattgcagaacaagaattggagtgttcctggagcttcagatgtaggctccacgaaaaagtgatgaagagagagggacagacagtgtgtgtgtgtgtgtgtgtgtgtgtgtgtgtgtgtatgcgtgtgtgttgaggggggggatggctggaacctgtggaaaacacccattaggagggcagatggacccagtggctgatggtgtgcacggttcctgcacactcatgaaggaatccaagcacacccagggcactcctgcctgcaccaggggagctgcagggagggctcctgtcagcagaccactgcagcccccaaaagccccttctcaggaggaggggagggagaagccagctagaatcatctgcgagggtgtggggcaccaggacaaggacccaccctgtacccagtcccaccccccaaccctggaggtgtcacaaactgggaagcaggcacaagggaacatacaggtaggcaaggcaaagaaccagagacaaagcccattccttccttaggctccaggaaaagcaggtgcaagcaggggcggcaggggtgggaggggtgttggtaagaagatccaacatcaaattaacttcgacgttcgtattattgtcttggcttggatgttctaattacatccttaagactatgtctgtgacttctagtacctgtaaggaagtttgttaaagagtgaataaaaatgtcaggggaccttctgatttcccatccagggacagggaaaaattgctcttcctcaacaaaaggctggtgagagatgaaaatagttttgttttgattatattgcaaagtgttcaactttattataagatgtgtgattaataataatagctaaaatcaactgagcttaagaagacgtttacatgcatgtggtcagtcctcacaaaaacactatgaggtgtataaataaataaatgtacaagaataagacatttactattctcattgctcagatgaagaaactgaggcacactaaggttgagccagcaggtgcagggtcaacaagctggaacccaggaagttggttctgcagcccagtcctagccctggaactccacagtgcccacaacgctcccaagtgaaatatatgatggagcatctatgggaggtgaggttagggggattttactttttgaaaaatgctttttggtatttgaaatattctcatataaacatccatgacctataatgacagagagagagagacagacacagagatagagacagagccagagacagggacagggacagggacagggacagagaaagagaaagagagagagagaaccattttagaaagttgctggaccagggaatattttgcacaacatgaaatgattacttactatcctccctcctgatttgggaaaattttagaaaattacagtggaaagcagcagcccccaacctttttggcatcagggactggtttcgtgggagacagtttctccacagactggagcagggagatggtttcaggatgattcaagcgcattacatttattgtgcaccttatttctattatttgtactttgtaatatataatggaataattatacagctcaccataatgtagagtcagtgggagctgtgagcttgttttcctgcaactagatggtctcattgggagtgatgggcaacagtgacagatcatcaggcattagattctcataaggagcgtgcaacctagattcttcacatgtacatttcacaatggcggggaggggggactcctggtgtaaagcattatgtttaaaataccatagcctgagatcaaaattttaggcacaaatttaatcacattgaatcctttgtcttctattagttaaaaggttgtcctgctgccatcttggaatgagtgcaagttggaaaatctagatccgagggtttcacatctgagcatgcataacagtgccctggagagctgctaacagtgcagattgcctgcatccagccagcagagtcagggagatttcaggggagcccctgcccagtggaactcttaaaactgcatttataacaaccttcccatctcctttctaggagattcggatacagacagcccatggcaaatgttctgaggagtaatatggtattatttttaaaagctaacacccataaatactacattaaattaaaattcagggatgaatgaaggacttgtagctatgactctgtagctcagagacataaaaagtgtaagaagcaaaattattactcactaagagataagcaggaaaaagatggggacacttacagttttaacggcttacctcttttgtagagccagaaaagtcagcagcggttggaactctggtaacaatacagttttggtcttctacttatgtactctcttctctattactaaattttaaaaaccagaacagcaaacctaaatcaagcgatacagtcgagctcaaagaaagactgagctcaaatgccttacgtctgccccaagagaagctagcattgaactcacacatcctccctgtgagcacaggcttgccagccacagctcaccaccgctttcttatgacccaaactcatgtccagagatctctgattctccttaacagaactccaggtaatcattaataattgagaggaaacaggcttacttggaaatcttattatgcacgatgtttatcaataaccctccatcaggaaggaagcaacaggcagcacctgcgtggctgttttgtgccaggcactctctggatacttgcctaacattattaccctcacagcgccctgaagatcagatgttatcctgatttttattatccctgtcttctcaagtaaagaatctaggctgttaagaacaataactaatttacctgccatcccatgagacacagttgatggagctaagacccagggtggttccttgtgactttcaactttccctttgatattttggcctctcttaatttagctacatgaaatgttaacctattatgtactcttagttcaattttttggtttatttgtaatcagaaatgatacaatatggcaccttctcaatgagtccatcaattcatatcattgtctattaactcaggatggctagctactcattaacaaatgtctaccaaattcctccatggccttgctagatagtataaataaacaggagaagaacaacgcattacaggaaaacagcaacagtctactgcaaacaaggagaatcaagtaagtaaggcaaagacactaaaggactcaggaacatcattacataatgttgaccagtaactattaatataatgcaatataaaataggaatgcaaaggtattgactgaaggagctacaaaattaagagatattctactaaactattaaagtatgtattctatttataaaataaaaataatttatctaaataagttaaataggaagtaatatctaatttcagcaaggaaagcttatcttcaagtttagatgaagtccttaattacaagtaactatcacatatggctgctctgggacccacaatttgagctgagcagcagatcatggtttgccactgggaattctttagtcttgtccaggaaagattcttagaatctgcataatggaaacagttactaagacaccatgtatgtatgctttacttgctaacttcaaagagttctagagttctgttttcatattttctgagttattttgttttagcatgaaagtatatttagaaagaagggctacttaataatatttctttaatcaaattcttcatataaaaacttctggtccaaataccatttctgctagaaaaatttacctgcccctagtatacaacagtaacattgctgtcaagccagtgatgcatcattgatagaaatgcattggccacagcatgaaacagtatcacatggtagtttttatgccactgcacatgagctgacagccttacttgggtcttgcatgtagagctctcacagggcagggaaggtccagaatacagcaggtttgactgcacatcccaatattagtggtacttttaaaaaatgactttgggtcacagagttctttacgagtaagaactggggataattgagagggctcaggtatctgctacttttaaaaatggcttataggacattaagagtcataagaaggaggctgggtgcagtggctcacgcctgtaataatagcactctgggaggctgaggcgggcggattgcctgagctcaggagttcgagaccagcccaggcaacatggtgaaaccctgtctctactaaaatacaaaaaaattagctggacatgatggcgtgcaccagtagtcccagctacttgggaggctgaggcaagaaaatttcttgaacccgggaggcagaggttgcagtgagccgagatcgcgccactgcgctccagcctgggcgacagagcaagactccatctccaagagaccaaaaaaaaaaaaaaaaaaaaaaagcatcataagaaggaaagtaaaaatgattattcttctagtcgctttctggattctttgcctttcattgcttctatagtacatattaatattacaaagaaatctgaattggaatagacaatcatttcccttacatataaaaatgtaactgaataaagacattaccctaaccatcctggggttacattcctagatactcttggattccatctacaccttctcaactaagcacttacagatgtctggctttatatatgtacacatcagtaactagaactaagtgttgaggtaatgaacaacaaggagatgacagagtgactaactctggccatgatgaaaatggcagatctaagatggaaattatactaggaaattccccaatcctagaaatacagttggccttcctccctcccttccaccttccctccttccttcccttttcctctttcattttttatttcctttgtaagacatctagacaaagtttaggtgctatataactcagggacaatcttcagcttcattgtgtgagattttattcatgattgccttatcacacacaatgacagggagtaggagaaacctcatttgagtatataatctgctgagtgtgatgcaaatgtcagtatctgtggtatctttgcagttacaacccactggtttcctctattctcttaccacttagaggtgaatttctaattctaggaactggtcgtcatcagaaattgatgaagacttcaagacgttaaatcaattcagccactgctacatggtaccttatagaagagaccattaattatactaaataatgtctattcatttattcaacaaatatttatccagtgcctacccactggataaaaataaccaccctgagtgtttagatgaatgcctaatgacaagggtgatgcttatgccattctaaaagtgatgaattgaactgaacatttatttccacacaaaaacctacacacagatgtttatagtagctttgttcataattgccaaagtttggaagcaaccagcgtgtcctcatagggtgaacagataaataaactgtggtacattccattcagacaaggaaacgccattcaatgcaaaaaaagatatatgtgaccaagccatgaaaggtacaaaagaaacttaaatgaagattatcaagtgaaagaaggcgatatgaagaggcgactttatgattctatctataggacatcctggaaaaggcacagctataaaaagggtaaacagatcagcggttgctcagggtagagggaagaaatgggtgatgaggtagagcacagaaaatctctaaagcagtgaaaagactgcacaatcctacagtgttggatccatgtcactaaacatttgtccaggccctagaatgtacaacaccaagagtgaaccctaatgtagaggactggctctgagtgacaatgatgtgtcaatgaccagttgtaagaaacgtaccactgggggtgtgccgggcgtggtggctcacgcttgtaatcccagcactttgggaggccgaggcaggtggatcactaagtcaggagttcaagaccagcctggccaagatggtgaaatcccgtctctactaaaaatacaaaaaaattagccgggtgtggtcatgggggcctgtaatcccagttactcaggaggctgaggcagagaattgcttgaacccgggaggtggaggttgcagtgagccgagatcacgccactgtatcccagcctgggtgacagagcaagactctgtctcaaagaaaaaaaaaaaaaagaaaagaaaagaaatgtaccactggcggatgggggtgggaatgttgatagtggggaggttgtgtgtaagtaagggaatgaggttgagaattttccacaatttccacacaattttgctgtgaacccagaactgctgctctaaaaaacaagtttcattaattaaaaatcaaattgctgctttcaaggttcatggttcacagccacataggagatgggtgtcttagcctcatgtaaggtggagaattagaactaaaatccttatgtagaatggagtcctagaaaaccaatgactttcgttaaaggattgactagaaaaaaaaaaaatctacccatcagaacaggtagaagaaaacttattgacctgatactagaccttacatttgatggtttgtaatcagagatctgctcttccttcgacaaaaggtttaaccttatactatttatatagtccatttttcacaacgctgaaaaataaacataaaaaagtagttacacactgcatgccagagacaagcttaaaactatggtgaagagacacactgccagcctgccacgaagcagccccacaaagcccaagaactcacattctaacacagaaaccttgtgaaaatataatcttccaagggagagaagcaatacacccagtcaccatcaggattagttacctaagaaccacagacacagaattttgtacagatatcattaaattactatttttcaaatgattaaagacttaatggaagaacattgaaatataaaacaagagcaggattccatcagaaaaggcagtgacattggaaaaagaatcacatagaaaacccatcaatgaaatatccattctttgaatgccactgggaatgcaaaatggcccaaaaatggtacaactatgaatatacaactaagggcaaaagaaaggtatgattaaattacctggaatgcagcacaaagagataaagtgatgaagaacttagagaggaagtgagaggtactgaaaaaggaataaaaagtccaacatataatgaacttatattctagaattagaggaaaatgcaaaaggaagagaagcaatatttgatgacactggtgtatatttttctagaaccgatacgaatgttctcatacaggaatcacagtgaatacggaaagaaagccaaagctgaacgcatggatgtgatagcgactaaccacaaagatttgaaatgatttctaaagctgcaagagagaaacagattacctccaaaaatactgcaagtagactcatagcatacttaccagtagcaaagataaaagctatacgctatgtcttcaaaggactgcaaaagaataatctcaatatagaattatctttcctgtaattcagaaaataagacaagttattcctaaagaacaacaaggtgggtgatgtgaaatgccttgtcagataccgcaaattataataaaactatagtaatataacaacgtagtattggtgcagggaaagacaaatagacaaacagaacagagtagacggttcaaaatagatccaggtatacatagaaactatatatatgtcaaaggtgtccttatgaggcatgactgttcaatcatgggaatacacaacaggtgatccctgtgaagaaaataaaataaaactggatcttgcgtggacagcacatgtacacaaagataaagtccagttgttaaagacctatatttaaaaactaattttcttttttctgagacaaggtctggctctgtcacccacgctgtaatgcagtggcacaatctcggctcactacaacctctgcctcctgggctcaagccatcctcccacctcatccccaagtggctgggactacaggtgcaccagcttgcctggctaattttcatatttttttgtagagacgggtttcaccatgttgcccaggctggtgttaaactcctgagctcaagggatccgcccacctgggcctcccaaagtgctgggattacaggcatgagccaccatacccagccaaaaaccaaaactttaaaatgtatacaaaaatattctttaaaaatattcaaggccacaacatatgaaaactttcacattagacacagaagatacaaatcataaacaaagatgaagtaagttttccacattaatgtgggaaatcttatacatccaataacagcatcaaagttaaggagacaaaccagaggttgacaggttatttgtttcctacgttagccccaaaatactaatatacattgtgcattaaaataattcacattttaaaaccatcacaggcccatgagaaagtttggccaaagtatactaaatgctcagaagacaaaatgcaaatgaatagtaaatgtgaaaagatgcttaattgagaagtaattagagaaatgcaagttaaatctacaatgacagaaaagtttacaccagtcaggctcaaaatttaaaagtctgaaaatattaaacgttggcgaggatgtgaataattgggagttaaattgttatgatcacctagcagagcaattatttagtatctattaatagtaaagctgaagttattggtgcacaaataccacacccaggaattggtctagagaaagtcttatacctgtgcacaagacttgtataagaatgttcagtgcagcactatttgtgaagcaaaaaaattagaaacaccttaaattcccaatagcatgagaataaatccattgtgatgtcacacatggtatgctattcattagtgaacacaggtgacctactgctatatccactaacacgcattaatctcaaaatatgattgaacaaatatgttcagttgcatacaataggtaacatcatatcatttatttaaagtttaaaagcatgcaaattagcagtattccatattacttataggctggtaaataaatgtttttttttctttttttttttgatggagtctcgctctgtcgcccaggctggactgcagtggcgcaatctcggctcactgcaagctccacttcgcgggttcacaccattctcctgcctcagcctcccgggtagctgggactacaggcgccccagaccacgcccagctaatgttttgcattttttttagttgagacggggtaataaatgtattttttaaagtataaaaacatagttgataatgacaaatcccaagttcaggataatagttacctctgtagagaaggaagaaatggaacacaatcagagagcagtacatccatcgcttcagttttagttgtaatatttttcttaagttgaatggtgggcccactagtatttgtcatataattcccatattgttttccatccctggggttttgcaataacaattacaaatatgtatctccctacaaagtttatacaatggtttatatataattcattcatctttgacttgtaatggaaatctgacttgcacaggaagtcaagattgctaatgtcagacttgcaaaagaacaagcatgctaatcaaattcaaagtcactaatgtaatttccatgtatttctattatagttctcgatttagattctacatctaacctcatcttgactgagaatgtatgtatagattctcaaataagctttatctgaagaatgtcttactatatattatttggtagcactaggtatcaaacactgaggctcaaatttatatttctgttctgttctaacctcaacaacagacagataaacaaacttcctactggagatcgccacctaaaatttatttgaaaccttaaacctctcaaataaagtttatttgaactgcccctcccacaataacccattcctctttttcttccactctcctctgtgcctggtggcatcaacatctaacatgagttctatatctcacatagccaagtatcaatgtgtcatacttcaattttctctttcccttgcatctcacaatgcgtacatctgctagtcccattgacacaacctctaaaacatcacaaagctacatgtgtccctccattacaacgtctagtaccctagcgaagccccatgctccgtcccccaaacacctagactagcctcccaattagcctccttgcttccaccaacttccagccacacttacctcccttatggccttggcatgtgcttacctaatgcccactctaggtcctttgctccctctctctggaatgattttctgcagatattcccagggctggctcctttagctttcagctcaaacttcaccttccaagagaagcttttcctaaatttccaatataaggtagtgtcaccagtcctcagcctattttaattctttccaagcacttatcactaactgaaatttaccatttttattgctttacttgctttaaacctgaagattgtatttggttgcatgtaccggaatactgactacagaagtataaccaattggggtttatttttcgcatgttacaagaagtctaaacaaaagccatctagaactggctgggggctccctgatgccctcagcaacccaagtttcttctatccttctgccctgtccttttagcacgtggcttttatcttcatggcactctgactaaaagcattaataaccttcttgcacatggaatgcaggctccacaagaaaagggaccttgtctgtcttacccatcaccggaagaatgacaggtgctgtgttaacagcttgatcagctagagcagtgaaagaggaactcaagagtcctcaacctcagcatcattcctgcatcctgggagtcctgcaccacagcctccattcattggccctggagattctacccggatttctcttctcatgaagccctggccttcatggccttctttattggccctgccttagtccagggcttagtctcacgctacagtctcctaagtggcccgccacctgccccatttcgcctgccaccctgtcacacccacgacacaaactgatcatattcatctctagaactcttatgttttcttaaagtctgcactcaaatagaaagctccacaaaagtggggacgcaccggtcctgcttaccactgctctccaggcctaggaaccaggagtgcttgctgtggaggagacacttggcaagtatttattaacagaatccaaggaagcatctaaattcccgaagattatgtgcaaagcccctctgcgtttgacccggctcatcctcttcccggtatcaccttcctcattctcacttttgccatttgtttagtcacagcaaataattgtaattctaaagtagtgccagacctttgcatcttttattttataatatctgcataaaatattccttccttttaaaatcagaaatcttctgttcatcacttaattcccagcttatgattctcctcagcttagaggccttactgactcagcctaggggagcagacagtgcctcctggatgcagcactttgatgatgatgacgatgacgacgacgacgacgatgatgatgatgatgttaaaatcacaatgccagcaactgacatcatggggtgttacaacgtacaaggcactcttgtaagtatttctgtttggtgactcatttaacccttgtagcaaccccatgaggtagataacacaatttttctcattttaggagaggaactgaggcacagagacattaactaatgcaccaaaggtcaaaatggcataagctacattccaacccatgtggcccacctcctaatccatgcactatgacttgtggacatatttgtacactgtgacctgaaagattgttgggagcagggctcataccttatgatacataatgggtgcccaataaaagaccgttgagtgaacagattttaaaacaatcagttgtataaatacagaatggggaaactggcttacatatatatatatatatcttgtaaaaacagagttggggtttaaatggactgtatggctctctaagtcatatcattgatcctaaaaataaattacaggccacattaataggcagattataccaaggggcatgtagtaactccagcatagatcaggccactttgagaatctagtacagtcctctctctttagaaaagaccaaatggagttcgtccaaagtaggtaaaacatatggctgctaaaataggaagagaaataactgaagggcatatggattatcgtcaagtatctgagaaagtgttatgtacaaaaatttcttctgatttaaaagggcagaacaaatctaagggtggaagaacaatgtgctcagataaggaagcaaattccagttgtgtgtgctgggcccactcaggctgcctcctaagaatggacagggaacacctcttcccaacgccgccttcagtgttattatgttggtcccttaaaaaaaacagggctggcaggttttgcagggaaactccaaagtgacaatcagagctttgtatttatagagagtcagtttacctgcttatcactgcatttatcccatttagttgctaaaaaaaaaaagaaaaaaatggacttggttgccttgtggagaatggatagtagttgagccttgtggtgaatggatagtaattgagaatgcggcagagagagatgacttcgtaaccaacagatacatatcatcaatgcgcacagaaacttaaggaggggccaatgtgatacgcgaactgttgtcagtcctttacatttagttatttttaaatttatttttcaggaagtatctataaaaacactatatgtaaaactatttataggtcaggaggctgaggcaggagaattgcttgaactgagacccaggaggcagaggttgcagtgagccaagatcgcgccactgcactccagcctgggctacagagcaagactctgtctcaaaaaaaacaaaacaaaacaaaaacaaaactatttataggttaaacactctttataagtaaaactcatttatttaaagaaacagactgatatttttatagttctctcatcaatctcttctattaaaaacaaacaaaatactaaaagaaaactgccaatcattttgaataagagatggtccactacattcctccaccagaggcaagaattaaaaatttaccaagtcaagcaggaaaccctaaaagattatcaacaaatgtattatatttttcaaattcgtaatgcaaaatctataggtatgttttctaatcagtccaagactccaaagtaattagtgaatttattgccattttcaaaaagtaataccccttgatatttaagtttcaatagtatggttttaataaactgaaatgaatcattagaagaatttcccccctttatcataactgattaagtctattttaaagcttatatgccctcttcagggaaatctttaaaaatttccaattgtttatatcagtgaacagggctgaataaccaatgtataattggttaaatcagatacattatttccccctcaaaacaatgccattgagttgaaggcaaaggatagaaatgaactcaccagctatatacaatattatatgacataagcaatattaaagattggtatataagaaaccaagcttggctgggcgccgtggctcatgcctgtaatctcagcactttgggaggccgaggcagacggatcatgaggtcaggagttcaaaaccatcctggccaacatggtaacactccaactctattaaaaatacaaaaattagctgggtgtgttggcacgcagctgtaatcccagctactagcagggctgaggcaggagaatcgcttgaatccaagaggtggagactgcagtgagctgagttcacaccactgcaccccaacctggcaacaaagcgagacaccgtctaaaacaaacaaacaaacaaacaaacagaaaccgacctttaaaataaatacaaacacaaaaagattagtatgtatttaatctgcaaggctaaagccacacaactggatttcagtgtactacaaaatgacagatcatataaattcaaaatcttcattctgcttatcaattacagaggcaaaaatataactatttaagtgggtcttagaatgtattttctcttcagagtgcttcctgatcctcttgccctctattttacattcaagcgactcatgaattcttaggagaaatctgaaattacttcatgccccttgttaaacagattttgaatggtaagtactcctgcaaaattgctcccccaaataaaatttcacatacagatacattcagtgcattaaaaaagtaaactccattagaatagaatatagtattttcttaagataactgtttagacttaactcaaaggagttcccacaaatatattctgttctcagttagttcaagtgtggaataggcaatttggcatggggtaaatctgtccccttttgcaatgttttaaaacagaataaatcgtgggatgaatttactgcgcattacaaataaaatgtttatattttctttgtgaattattcatcaaattaaactaataacatgttaaaatttgcttatgtgtcagtcctttgtaggtaaaatttcatataacactcaaaacaaacatataaaatataggcattattactatctacacttcatatagatcagaaaaataaagactggagagcttaaatgacttgtccttcccagagagtctgactttagagtgattcatatctactgtacttcattataacagtgtatttgaaagtctagttgaactcttaagtgatttcatctagtgtatgacattcttgaagttttgacttctcatttatatatagcaataagcacatgtgtaggatggcatcataaaactcccttggaatgaaaaaaacatataaaaagttttaggctcctacaagaacagcatgtatctcaatgttcctcaaaatgagaattgactccaaggtacaaaacaggtaaactgaggaagcagatgttaattaaccactttagcaggttctgaagttcttagtgtccaaggtttaaataacactagaactatcttaaacaaatgtttgtgtttatttcctgttttctgaacaatgtttttgatgaattacgcatagatggaatgcaaacacacagacccaattccctttgaaatatgtaagcctataaaaatgagcagaaaatatccttggcaaaacctgcactgagctttcaaaagcccacatatttgaaattgagtttgtgatgtactcaaaacacaaacatcagtgggttctcgcattcctcatttctccctctaatgtcagaatattctattaatttaaaaagcagagttctgtgccataattagtctacatattaaatcttatctgagtgacacctctgaatgcaaagtatccagaacaaataataagacaagaaacattccatgcaaaataaaattcaatgacagaataaaatcttcaatccaatgcagtttacacaagtacacccacaaaaattataatttttcccaggaaatgcattccccaaatgaatgtatgcttctctgtgtgaagacatatatgtacaaaaggctaaaacattttttaaaaatccaaaaacaattgatactagaacactatactgacaccaactttataaatcatgggcttgcccaacaattcagtaaatacttgatgttctgcctccattcaaatgagtctgtgcatcctctgatttagcacatggccaaagaaagatctttcagcccatccttctgtgctttacaaaggctactatggcaatcttcacttgtccaatgtgaatttcagttaatttaacttctgctgctaaattgtttatgataattttatttttatcaatattaaacctaatatttgaaaaaaaaagttaacacaacatattaggccagactctcccattcccatttaattgtgttttctgtgtcttatgggcatcactaaagttatactttaacataaactattataacataaaggatcacatcccacacatttaacttcatctgccatttaacttatatctaaggaagatcaatgctggaataaatatttactaatggtaacttattaattaaagctatgacccaagcccatatataaatagaaaatgaaggagcacacatactcccatatgtattcatcataagtgagtttggtatataagcttcaaagaagtttctcatatacaatcttattgttccttgacagtcatctcaggcttgttacaatgacttagtaaaaagggaaaaaagtaaagatggaatttcagtgaatcatctttgggttcagagcttttgggtgtatagacacaacctctcatttcttaaattcttccctaaaggatgatgactgtattaagcaaaatctcagataacatcaggtcaattggatgatggaatcttagtccaataatggagacaacagaatatctgaaactaggacttcagtgaacagtaacacagtttcagtatggcatctcttctctgtcatttatcaggtttcctgtaccctaataagatgcatcctatgttaagagtttggagattggattgctgcagagtttcaccctctcacacattgcttgccttggaatgtgagtgtaatcacaatggaaacatctatgagatgagagcctattaaatgaatccacagactatatatcttcagcatcttataagctataagaatcttagctttttttttttcttcaagtctatgcttattgatggcaatcctcagagatgttttgtaagtccacatgggcacagaaatgtcaaggcttcctttcaaagaaaaataacatttctgagagttctgaattatgcaaagaggtaagtcattcagggatactttctgacatgtagaggcaaccagacacaaatagatgaaataacggtcttcccaaagtgagcatttgccctgtacagatgatcattctttgattctagactcggacacgtagcaacacttactagttcgtataataatgtacctgttctttggaggaactcaagaggatatgtacatttgcctaaataaaggaggccagcagtaagttccatttgcaaggcaaaccttcagagagaagatgcttgtatcagtcctgtagtgaatgagcatctcatttacatgaccaatctcttacacagaaataaatcactgcgtgactgtgctctgggtataatggtattgagcctggcctccttttatcttataatcagttaaaataggaactatattggtcatttgcagaattcttttatatacaaacaaaaaatcatggtggaaatgtattcagtgctctaaattgatactagcctctttctgttttatagtcaatagaaaaagcaatctctactaaaaatacaaaaattagctgggtgtggtggtacatgcctgaaatcccagcgacttgagaggctgaggcaggagaatcacttgaacctgggaggcagaggttgcagtgagccaagatcatgctattgcactccagcctaggcgacagagtaagactccatctccaaaaaaaaaaaaaaaaaaaaaaaaaaaatttgaataaattaccaaaaaaaaccatgaaatttcaataaatttagttcagaaatgaagccattacatccctaaattctattacataaatatgttactaatgtttactctataaccacagcagatcatctgtttccttttttttttttgaaacagagtctctttgtggcccaggctggagtgcaatggcgcaatcttggctcactgccacctccgcctcccaggttcaagagattctccgcctcagccttccacgtagctgggattacaggtgatttttgtatttttagtagagacggggtttcaccatgttggtcaagctggtgtcgaactcctgacctcgtgatctgcctgtcttggcctcccaaagtgctgggattacgggcatgagccactgtgcccgatctggctcatttatttcctaaaattataatgtatgactaacaaatcaatttaaaaactatgtacaactggagtacacaattgtcaagaactatttacttttgcttagtttaaatatttggtaaagagtttgcaaataaatactcatcatgtctattcagatctataatgtgctaaaaattctgtttaagacttcaagaaagaggccaggagtggtggctcatgcctgtaatctcagcactttgggaggacaagatgagtggatcacctgaggtcaggagttcaagaccagcctggccaacatggtgaaaccccgtctctactaaaaacacaaaaatgagccaggcgtggtagcgggcgcctgtaatcccagctactcgggaggctgaggcaggagaatcgcttgaacccgggaggcggagcttgcagtgagcagggattgtgccattgcactccagcctgggcgacagagcgagactctgtctcaaaaaaaataaataaataaataaaaaaaggcttcaagaaagaggcattaatgtctctataagttttactcaccctgtactcttagtatgaacaagtctttaaatgtgtctgctaatcaattaaattatttttctcatttcttatgttaaatatcactcattgaatacatactctccctttaaaagagagacaaatagcaagcttattttctaagaaagtgatagtttcaattcctctgtgaaagtggacagatatcctaggttttttttaaattcaactttatattaaaatgcttacacattctaacgcagttgtaagagatagcagagaaagatgccagctaccttttccccagcttccgccagtggtaacatcttgccaagctagacgttataattgtactataagcattgttacagtcagcacagaggacggccgtcaccaaagggtcccttctgttaccctttcacagtcgtaccctcctctcacctgcttccacccccttcagaactgctgggaagcatgaatctgccctccatttctatcattttgtcgttttgagaatgttatataaataaaattattcagtgtacgatctttggggatgggctttttccacacagcacatttcccctgagatccatccaagatattttgtatatcaacagtcggctccttttttactgctgagtaatattctagggtgtggaggtaccagtttgttgaaccacagatccactgaaagacatcagagttgtttccgtgttctgctaatgtgaataaaactgctataaacattcatatacagatttgtgtgtgtacctacgtcttcatttctctaggataaataactaagagtataactctgtcatctggtaaatacatatgtcattttttatgaaactgctatattcttttccagagtggttctaccattttatattcccagtagcaatttgcgagtaatccaatttctccacatcctcaccagcatttggtgttgtctttattttgtattttaatttacctactttacctattactctagatatttctttatacattcttaacttgtcatgctctactgcagttgctattttgtaggtcaagtttagaaatcttacctttccttgcatctgtgtttatgtttgcctgaaatgtttcttctacatgtagaactacattagacaatgctataacttttgctgcaaccctctaacataatttagaaaactcaagaggagaaaaacagtgcattgtatttaaccatatttttgcttactatgtttttccctccttcctagtgttccaaaattcctttttttgttgtttcatttgtttagaaaatttctttagccattcttttagggtaggtctgctggtgacaaattcgcttagtttttctttatctaaaaaaaaaagtattgatttgttctttcttcctgaacgacattttcactgggtataatattacaggttggcagttcttttctttcagcatttgaaaaacattgtgccacttccttctagccttcatggtttctgatgagaaatccactgtaattagaacaatgttagccctatagggaaggtgtgatatttctctggcttctttcaagatctaaaatttgtctttagttttaagaagttgaattacgttgtgtgttggtgtgggtttctttgggtttttcctgttttagattcactcagctttataaatccatctataactttatgtctcttgcaaactttggaagtttccaacacttatttctttgagcatttgcccaccattatcttctccttccaggaatcccctgacacaaactttaaatgctctgttggagaaccacaggtctctgaggctctattccttttttctttttccagcctaccttttctttgccatttggaccgtgtcatttctatgttccaacttccagttcactgactcttttctctgttccttccattcttatgtcaaacccatcagtgagtgttttatttcagaaatttcaaacaagaggctctccactcagcctttactagtgttggtggggacaaggatagggccgcagtttttctgttgcatttggctggagtagactggttattgtctaaatgttttctatgttgctaggcagcccctttctgagtcctctggataaaaaacaggccattgttggggatttcttccttccttcctttcttccttttcccttcccttcccccttcctttacccctcccttctctctctctctctctctctctctgcccctcccttcctctctgcttcttttttcttctcttttctttttgtctatatatgttgacatttcctggttgccagcttcttcagttccacatctgaggtaacgtagcaaaaagaaaactcaagaaattcacctctggattcttccttgggttctaaaatccctactctgtccacattcttctcactactttcagaatcttcctaagcttgtacagcggacccttgaataacatgggttgaaactgcatgggtccatttatatgcagattttcttctgcctctgccacccctgagacagtgagactaactccccctcttcctcttcctctttagcctactcaacatgaagacaaagacaatgaaaatcttgatgatccacttctacttaatgaatagtaagtatcctctctcctttttgtaatgctgttaatgttttctctagtttttttattataagcatacagtacatattacatatgaaaaatatgtattaatcaactgttcatggtatcagtaaggcttcccgtcaatagcagactactggtaaagtgtgaggggagataaaagtatacatgagttttgtctacatagcggttggcacccctaactccatgactccacgagtcaactgtacaatatgcaatgtctaggctttttagtgtagttgctgggaggaagagggaaaagtatgcctactccagcttcccagaagcaaaatctgtgccagatcattcgttttcaatgtctatattttttccattttcctttaattttttaaagttcttaaagtcttgccaataacaaaactgaacagatgagtgtgtaatgaaaataactatactctaacagtgcttctctaagtggcctgtggatatgctctcccagaactgaaaattctatgaaaattttttagatgtgacatcaattctattataatcttacaaataccctttgccagttaaatagacaaactcgctttttaaaattatgacatttcataagactgtggtctcaagctatagttccccaaagtacctgaggtgaggcactaaaactaatttcctcctcaaagaaggtgaaactaagtgtgagagatactgctcagtatgtggggtgaccattgcctcagttttcctaggacactcccaacatataattttgtcctggaataattattgacagggtcttcttttatactcacaatatctcattttgcatgataagctaatatatatgttcatatcacctatgataaagaatacgaaaccaggaggaagacacccagcaagcatagacaccaccccagccatctcttcttctcttcaggacaccaaggtgtatatttaacattcattaatggaagcattaagtagctcatatggaaggtccatcttctttttctcagcagcaacttattattagatattttgtgcttatactgtgaaatatagcacctgtaatgataatgggtaactaaatgatattgactaaatagttgtaaacatatgttctaagattatacaagaatatctaggatgctaaaattctgccagttgtacacttaaagaaaacatagccatcaatttgcaattacatgtgtaacttcctagtctttacagtgaaactcttctatgaacaaagtttgccaacttctcggcacctaaatcatttaactgtgatttaatagaagttccataagtatgaacctttctttttcagtgtcctcagacacaagttctcaacagccagctaggcatctccaaacacacgtactcagctggcatcaactcccatcatgttggaacaatgcagcatccttcccccaaccaaaccgggtcttcagacttcccatttccttctatggcatgacatttttctctagttccccaccaatgaaacttcaatgccaagttagtcaaggttatgtgaaatatagcccatattttattttttgtccaatcttcaacatctctcttcaggttctagaagaacaagaacccatcctttttggcaagcattctctatgctcattcccctattcctccatctacagaatcctacctcaactcaattcatccaagaagttcttcctggtgacttccaaccagatgtgttttctccacctttaaaacttcataatattttcaggtgcgatacggcagttatgtttcatattcttatattatagctattaggttgaacaacatgaaattgttgaacctgtaaaaatggcaatcccatatggttcaatctaatatttctctcggttttagggctcataaataaagagcagtctccatgaaaacaggggctgagttaggtctctcttttggatcccctgagaagcctaggacattggaagtgcttaagaagtgtttgtcaaaatagactcataaatcaacacatgtcttaggcatatatgtttgcaaagtcaatcatctgaagcaattagtctaactacatatgaaatcgctaattgttttatgaatcagcacaaatggcagtttagaacctgaaggttttggcaatataaaatgttttgattcaaggagctgttttaaaattatttatttgtgaaggaaacatccttggatttagaggttggcagatacagtgaaaatctttttagttgactgaaatagaaaaaaaaaaaatcaaaaccctttttagcacatgcacttcccttataaaaccaaattgcctgaaagcagaggccagcagtttgtgcacaacgagtatgtgcctcaacaccatcagcaggagatgcaatgcagaatgacaggaacaatttgcatttctgtagcttctttgtatacccaaattctgagagcattttacaaagccataaatatcgttacccacaagagacagggaaaggatgcagatacaaggacggactttgtgtactctgacccaggagcccccctgcgcggagcagtgatacccacacagctgtaaacctgagtgcaattaattgatgctggttaagaaaaggggaacatacatctgcagggtccttcacagtcacagggaccattcccagaaagcgtttcgtctttcttgcattcacaaagaatagcgtcaacaaatgttgagttgtatttgcgagtttccccaacaaaggacgggtctctagttctaggtgatggtggtattatcagtcacctcaccagtccccctaattcctacaaaaatcaccaatccgaatgacatgtgtgtagggctttcatggggctaggagcagtgggctgccagaagctctgctggggccaggagagaagagagcatcgttcacacttattacgttgcaggggcctatttccagggacaatgttactgaaccttggagaaattcatgcaaaggtatactgttgttgtgctccaggcttccttccccatcagctgcagaactgtgcgattctggtcctggccaaggagtgcccaaagctagttgccaatgggccccggagcccacacctcctctagcgcagcatagcagcagccctcactaacctccaggggtcacaattgggttacaaattcctcacagtgcagggactgagcagcctgattgggaacaatttattcgaatccttcttcgttaagattcaaatggaataagtaaggtagaaattgaacagacacagaaattgtgccttgctgctcctgtagtcagtagacatttattcactaagcctagctcgtgtgttctttctctctctctttctcactcgcagttgttcttccaatctttcctgcttgctgttttaatgcataattaagaaggtcagaattaatgaagcagtgtggagtaaagttcaaggaatccccaggcactatttattctattagatctcaggcatgaatgtcagattggcagcgcaggcggcatgagcaatggagctggcggcatcccaagaacggccgccaagggagactcacctgcacagtccagtcattcctcagctccttccctgcgaaaatcacacgcaactggtcagccggaaccccctgtcgcttagcaaccacctccttgagctggaagatgctggtgtcagaatcgacctccactgggaaaccatggctggagttgaacctgacaaacactgaccaaggaaattggaagggagaagagaaagtgagcatcactcgaagcccttaaatggtgatagcaacatttctcaaccgatttacccctcgcagcccttcagtgaatggtatatattttctttcacttacaacaaaaaacttaatgctatagagcaatatttgggaaaaacagagttagttacccacgagatttccctttcatatattcgtcagtgacctgcaaaccaaaattgcattctccctttgacatccatcctgggaaacagagagacttgagcaggacacttgcttgattggaattgaaagagtcccatgagtttattgaaaagactcagctctgacagcatgtacacactcacactccctccacagtgaccctcttaataaaaataggaggcgatgtgttagcactcaaggtatagcaatggaaaaaaatctaagctgctctatagaccagagtgaagacccactcggggctatggctcagagccctagacttgggtggtcctggccaaaatgctccactgggtctatgaagacaattatttgccctctttttggcagggagggggtggagacactagtgacaccatttgtcttattgaagccactgttccccgtgagacccaggctgcatcctctagtctgtctgtctgcatgccgtcttctcactgcacctgctgtcccacctcttcagcgtctctcactgccctttactttccattctttctctcactgcttgaagtcacgctctcatcacatcttttctagagtctcataatagcccccaactggagtcttgatccacgccatcacctccaaaaggccctacatagttctgcaaaatgagccttattaatacagagctatgtcacaccactcaaatcctttaagtctcacactgtcggctggtgaggaaagactccaagatccctttcatctagcacaaacctacattccagcattttcttcattaatctccatgtgtactcttttaaactaaatgctcccagaaaaaaaaaaatcacaaaaaactgctgcacacaacttcttgcttttattcatgacctccctccttctcctcttcctattgaaatcctgcctacctccatggcccacttcaaatgtgacctcccccaagaagcttctggctatcagctactgcaaaagcctgatcttccttattcagggcaccagtggcatttactatatatgtcttttaatattcaccacattcctcatggaagcaggatagcacacgggttaaaagaacatcctgaagcattaggaagacctatgaaaaatccccacagactcctttaattggcttaggatgctaggggtcaatctattaacctccctctttaggtctcagttcccttatcttgaaaacataaataaaccacagaccatattattcggttcattaaataatatttatagtatttaaaactatcgtcttgtaacatttaaaaataatggacatttagctgtttttgatatacattttgccttctttaaaagataacaaactcctcaagggcaagtgttattgtttatttactgctgtgtttcctttaaatgtagtactatagctaattatttctcaataccaatgtgagatgacccacctcatcataattataataatcattacaatgccaataataatcaggcacttactatgtgccagacattgtgctctcatatggtttttctaagcctcccagtgatctggtcaggtccctattattatccttattttacagaataataaacgaaggcacagggaatgggacccacttttctaaggacattaattactttctaatggaactgggtttcaaatttatttcaatctaactctaaagctcattccatttctactaaaataggcttcctgaaaccatctcagaagaaaagtccaggccaggcacaatggctcaagcctgtaatcctaacactttgggaggccaaggggcaaggatgacttgagcccagaagttcaagaccagcctgggcaacaaagtgagaccccatctctacaaaaaatttttttaaacaatcagcagggcgtggtggcgtgcacttgcagtcccagctactctggaggctgaggtgggatgactgtgtaagcccaggaattagaggtttcagtgagctatggttgtgccattgcactcagtcaccctgggtgacagagaccttgtctaaaaaaaaaaaaaaaaaaaaaaaaaaaaaaaaaaaaaagtccacatttctatccctcatgattaaaaagataacaataaaaaggctttatgacataaatcagatattccctatatgggtgtgcagtacaaataaataaaagctccagtgaggagctaagagcaaaggaccgtgaacaataaccatgaacaacatgggccccaaaacagacgtgacactccagtgagggcaggtggtccagatggcaccacaagaacaaaggcctgacatctctgaccagcacggaaagtgtttagaaaaaggaaggacgaccagtgacaaagtgctccaaataaagaaaattcatgaaaaatactaattacggaggaaaaggtgcttttgatacacttttaagtcaatttcatttgacgcctttgaaaatagaggggaagaaataaaaatgtattggaagccctgaggtatcttcacagcatcctcagatcagagaccataagacaaccaattcatcagaaaagacacatgacaagttaggggctatagggacaaaagatatgaccccagttctaaatttcattttctactagtgagaatagatttaaagtaaaacaccataggaaggaatgtgggaagaagtggctggaatttgtgccaaagctgctataaaaccagataaaaattccaggagatcctaagtttatgattttgctccaggggttcaaatcatggaactcctactgcaaggatgagagtttttttgtaaagggaaactgcaaaaaatattaaagatacctctgtccaactactgaaatcctaagtatatacaagttttttctataatagaaaagttacagatttaaagttacagtatttagataaatcataaatactacggatatgaatatttttaacagtaaatctaacatacaatataaatttaaaatggaaagataaaccaaatacataatatttgaccaactaaaacattcgcatgaataagaaaaaacatcttaagaaactcactgagttcataatcaagtgccattatgtgaaaaatggctagtgctgaatggcagtaatgtgatttgagtgggtctcaacctttttctgacatatgtgggaaacatgtcatgtcccatctgtaccagcccctgaactccagccatgatttccaaaacaggagtggaaggaagtacccagttctccccacctactacctctttaaagtcacagaaggcagaacgtctttagagctacataaagagaaatttgaatgctggttgtaacgcttgctaattttatgacaagttacctggccaccttgactgttagcttcctgatctaataaatcggtataagggatgcaacaccaatgtctgttacacaagatttattgagattatggatgtattagaaaatctcagaaagagactagtacagggcctatcctcctagtgctgggcaagtgtgtgctccaaaaatagttccctattctaggcacctagaggaggtagagctaatgaaagcagtgtcctttgcttgcatggtaactaagggagattagataggatgtgggtaaatactaaataaagtagccaatttttctggattctgctcctcttggtggacagaaaacttccagagaccaagagatatgatagagaatatggctcacctctactttctaaggtttaattacatatgaaaagcttggaaatgcattgttttaataattgttttgatgacgtataatatagtatcagaaacaaacaacataccagtaaacattatcaatcatgtgtattatcaatcaacatcataatgcactgataacaaaaaacataatgagatatatccagattccttttttatgatatccctaaccagggttgagaagtcccagagagtaaggaagtgaatgggtgggaagaggggaaagggttattggtggatgggcccttatatttcttttaagacaattttatttaccaagtctgaccagggtataaacttcataaatatagtagtcaatatcaataattaatgattcttaaatgattctggctgctcctcaagcagccattccgcctcctgcactgagaagagcaatgtcattcatcagcacagccccatcctccttgtcattggtcaaatgattggttcagggatgatgcaagccaatctgtgcctggcactccccttgttccagtgattgattctgcagaatacaggtgacataaggtggactaatcaaagtcatatccagaactgtcaaaggttcggtgaagtccttttagatggcaaataacatcatgtgatgcctcagacagttttgctgagagacccaaagaaaatcacagcccaagatagaccattaacatgagcacaaaaatggactcagtgcactgaaggcaggcaattcttcctcatgagagggtttcctaagctccgtgggatgttcggctccacctgcagcccagtaagtatcagaggcacgccccggttaattgcggcaacacaaaagtaactccacatgtttccaaatgtcccttgcctgggaagtttcttctgcacctttgagaactatcactaaatctagtattccctaactttagcaaaccaaccaacctgtcctcacaccctcctgcgattactaccccatttttctatatagaaattttcattgagaatttcttatcaccctggtctccatttctttattttatactcttccgtgagccaacacttgaagactgctcttggtaaagcaatgagctctacacttcaatcctgtcatcacatttcagttcttatcaggttgaccttccagggacattcaatatagttggcttctgttctcatcatcctttcttctcttggcacccgccagagaaacccttctggtttcccctacaaaagaggacatacttttgtagcttcctcttctggattctctccctttattggccctgcagattttggagcatcccaggagtctgaatctgtgtattctcccaggtgacctcctctaatcccgtggctgtaatgcaatggatatgtcatcaactcccaaatccttatttccagacttgccatctccctggacctttctttctctttctctttctttctcttcctccctccctccctccttcccttcctccctccctcctttatttctttcttttcctctctctctctctcccttcctctctctctctctctctcatctcactctgtctcccactatagagtgcagtggcacgatctcagctcactgcaacctccgcctcgcaggttcaagcaattctcctgcctcagcctcccgagtacctgcgattacagatgcccaccaccacacccagcaatttttgtatttttagtagagaaggggtttcctcatgttggccaggctggtctcgaactcctgacctcaggtgatcaattcgcctcagcctccctaagtgctggtattacaggcatgagccaccacacctggccctcactggaacttcagataattgcatctactagcatttgatatctacacggatgtccagtagataaataaaataaacattctcttcctacacctgtcttagtgctttgccttattcctaccctctttgatccatcaataaattttgttaacggtagtccttcatttctaacctaatctcatctacagcaatctatttccctacccaataatttgtggtggaacacaaatctctagaactgcatctttggactcatagctcaatgttaagtgaccttgcatgtgcaatttcatcttcattgggttgttataaggatctgcattattactagctacaagcatttttatagctcgttttttattttttaattgctatttttatgttttatattttattatttatttttatttttataactattacctgcatactcatttagcacttgagtatatgctgtatgataccatcctctagtagcttgtttcataattctttatttctgtctttgaagatctttgtgacaggaagcctcatttcatctccccacttatacatagaggccaggatttttgccttttataatgaattattaaatgctatcggatcaaccctcctgcaaaaaaactactataaaattgggacttcactaaagaaagcagattcttgaaaagccatagaagagtgaacaaaaaaaatgaagatttctagttagggggtccacatcaggagaagtacagttacgtaaagggagtgcccattctcacagctttaggcttgaagccaggtgcagtccgtgcacatggcatgtgggccagcaggcactttggttgcaaagccacagtttttctggctgaagaagcaaaacaccaagactgggacacctgcctccgaggagacacagaagaaaatgagtcagaaagagaaacccaaatttctatctatccacgtctctggctaacccctgaatgatgaaggtgcgttatcagactcaaagttgctcagctaaaggaaggatgtgctcaaggaggtgaagtataatgcccctgtgacagtaaatcccctgtgaatgtaaacgcccctatgactgtaaatgcccctttgagtgtaacacccctgtgaatatgaacgcccgtgaatgtaaacgcccctgtgattgtaatccccctgtgaatgtaaacgcccctgtgattgtaatccccctgtgaatgtaaacgcccctatgattgtaacacccctgtgattgtcttcctcctgaagaatacagcatggaaaggggaacaaaaacaacctcacagtggagaaacctgacaggcgctaccgcagccaggtgatcaaggtcaacatcaacagtggtaagtcatcttgatcatgtttacccttgacacagtgtgatgcaatgggcaatttatctctgtgggctttctctcaaaaacacataagcccagtctaatcttcacgaaaacatcgcacaaaacgcaattgagggacgttgtaaaaaacacctggccagcactgcgcaaacctttcaaggtcatccaaaacaagaacagtctttagaaactgttagagtctaagggcctaaggagatgagtaaatgcaatgtggtagcctggatggaatcctggaaaagaaaagagacattcggtaaaactaagaatatccaaatacagtttgaattttagttaataagaatgtatcagcattctttcattaatgataacagatgtagtataacaatgtaagaagtttaaaatagggaaactgggtgtggggtacatgggaactccctgtactatttttgcatctttttctgtaaaactaaaactgttgtaaaataaatgttcatatatattaaagaaaaagatctagatggagatcagacttgcacacaaagaacagattttcttttcaagatcaaccaaaataaatgtcttccaaaacaaacaaacaaagaaccaagggtcactggagaaaaaattacagaattcagtgtctccagtaattacgtttataatgtctgcgatataattttaaaagtatctaacatttcaaagaaccatgaaagtaaaccattctcggagaaaagaaaatcaagtgagacaaaaccctgaaatgactctaattttgaaactaggaaacaaaattttaaaggagctagtagtattactgtccttaaaggagtaaaaaaaaaaaaaaaaaaattgcaatgagtggaaagatatgacagataatcagagaaatagaaattataaaaaggaatcaggccgggcatggtggctcactcctagcaattttttgggaggcccacacgggcagatcacttgagcccaggagtttgagatcaacctgagcaatacagtgagaccttagctctattttaaaaaaaagaaaaaaagagagagagagagaatcaaatagaaattctagaactaaaactacaattgcctggaataaaaatctgttaaataaatttaatacccaaatggagattaaagaggaaagcattagtgaagaataaagaattgtttttaaatgaatagatgttagggacatattagataatatcaaatgatctaatatatatgttgttggagtcacaaagaaaaaatgaaagaatggggcagaaaaatttttcaaaaaataatgccctcaaattttaatatgtgatgaaataaataaatttacatattcaagatgttcaacaaatgtcaagcaggataaatatgaacgtgcttgtgtcaaggcaaatcatagcatagtcaaactatggaaagccaaagacaaggaacaagctttgaaaacaacaagaaaagtttgtctgtcacatacagggttaaaatgatgtaattaagggttaacttctggtcagaaacaatggagtccagaagtgacggcacaatattacagttcaggaagaaaacaaaaagcaaaaaatgcttgtcaatgcagaagtttatatccagtgaaaatatcttttaaaaatgagaataaaataaagatattttaagattaaataaaattaagataatttatcacaagcagactcatatcacaagaaatatcaaataaactcttcaggctgaagtgaaatggtacaagacagagattcaaatccacaagaaacagtaaaagcatcataagtgctaaatacagaagataattaggtaggaatttttttgctttattcaacataatttatttaatgcagatgactgggtaaagcagaaattctattccatggggagtttagaacatataatatgtatgccaagtatggcataataggtgcggggtaaatatgggtcttttatttattttatgaagtggagcaatattaacaatgaagaaactaagaagttaaggacagacattatatttcttatagtaaaaatcaaaatgaataaaaatattgacccaaaaagcaagcaaaaatcataatggaattccaaaaaatattgaaataatccttccaaaaagggcaggagataatgaagaatggaagaaaaatagagaggtagatagaaaaatacaataaactggtgaccagaactcaccacatcaataattacattaaattttaatgaagtaaacactccaattaaaaggcagggactacgtggacagagggaagtgggtccagctatactctgtctacagggctgcattttagatataaagacacaaatggtttcaaaataaatgaataaaaaatacgccaagtaaaatgtaatcataagaaggcagggatgacaatattattaatatcacaaaaaatagattcaaaggcaaaactattttgaaaaaacaaaaagagagaaacttaagactatgctgccaccacttgaaaaggtggatcgcaaggctcaagaatcatagcccaagccttcccactccttccctccttgaggtggaagaggtgcccggtactgcatcgggccagactgggaatgtcaaggtctcctgccacttccaggttccccggctggaaacagaatgaggacttcctaccctcctcagggagtaagagaccctggtcttagaacatagcaactgatgaggacatcgcgcatagcctcaaggaaacagctttggttctttgacgagggtgtatctccagtagaattccctcctctctctctttttccttctctctctccccaacatactctttttttattctttgattaattcttccacttttaaaattatttagtagaaaccacattaagggagatggagaatgagaggtaggaaaaaggcaactgaaaatctatataataagacgtgtatactgtggctaagaccatggatgttagaaccctctgtgtgggttcacagactagctctgtcccatcctaaccaactatgtaagcatgtcacacagtttctctctctcaatttattaccaacaaaataggcaataataatagtatctggccagacacggtggctcacacctgtaatcccagaagtttgggaggctgaagtgggcagatcacctgaggtcaggagttcgagaccagcctggccaacatggtgaaaccccatctctactaaaaatatcaaaattagctgggcgtggtggcgcacacctgtaatcccagctactcaggaggctgagacaggagaatcacatgaacccaggaggtggaggttgcagtgaactgagatcgcgccatggcactccagcctgggcgacaagagtgagactgtgtctccaaaaaaaaacgatgagaaagtggacataataataagggcaaaactctttggggaaggagatgacaaagaaaggagaagaaagactggatgataactagagagggtttgtgtcttataaggtatacgttctcagtatactttgtacctcatcaaaaataataatcatagtatctacctcctaaagttgttgtgagaatttaataaatcaatataagaaaggtatttagaagagtgcctaggcacattttaagtttcagcaattattgactcttaacttcaggtccaacatatagtgtaaaaattattgtaattatcacgtcagttgtgccatattaatgtttggttttaaaaatgtaccatttattttctttaaataagaaaagtgttcccaatggagctctattccactacactttatagtaaattgtaattggtctaaagtgtcgttagtatactgatagtgatatcttctgtttaaatagagctctcaattttcaaagtgcttttacagacattatctcagttaatcttcacaatagcactgaaagataattgggagaccatttactattcctatttttaaaataaagaaacagatgcacaaagaataaaagtggcttgcccaaacttcacaaggaaagaagcaggaaaaagaatcttgggtcctaaactccctcctctgtgtcagtggctttcacactggactgtatgttaccctgagggtatatgggacgtgccaatggaaagttctcctattcctcacacaccgttccttcaaacagatatgtctggaaacacatttatggctgtttcatgatggatcattttgtcccagcttcccttcgaaatcaacattctcccacttcacaaaacaaaggaatacactcaatctcccccacggtggctctggtgcaccaccacagggtgttaaaggagcatgccttgaacaactgggaacggggagcctcttttaacccaacccgttaactcacagtagagctttatttctttcagagtaaggtaaaggttggcattaggaacgatgatgtattttttagccatttcggactgtgttttcagcacgtgggttgagttaggctggtatgaatacagatacacagtaaagagggacaagagagatggtgatgttcatttaactctcatagctcttctaccccttggtattgccaaagaagtaattcctcctcagggaagttctcagaagatcagagctaagattgttgtctataatactgaagatgacggtatcttatatcacccaggagacaaactgctggcaaagttccatctcttacctaaccatccatctgtccatctgcccattcatccacacatccacatagccagccatccacccatccatccacctactcctctgtagtatagttatgcgttttgagaaatgcatccttaggcaatttcatcattgtgcaaacatcatggagtgtatttatgcaaacctagattatatagcctattacacacctaggctatatgatatagtatattgccccaaggcaacgtgtacagcatgctactgcactgaatactgtaggcaattataatacagtagtgtttgtgtctctaagcatagcaaaggtacagtaaaaatatggtactataatcttaagggaccaccatcatatatgtggtccctcattgactgaaatgttactatgtggtgcttgacagatataagatggctatgggggcccatttttttctgaaaaattaactcctattggctgtctgatttgaaaaagattggttttacatcatgtcaaaaggcggtcactttccacaaatggaatatgcagctccaaggttttgatttaaaaaatgttaaataaaataattttattataaatattgtattgacaaaagtgtattaaactgaagaacatttcaatttttcccaatgtttcaaaatttgtcagattgaacaaaatacctctaaatgatagaatggcaagaaaaattaagtgagttaaaaaaaactttataaaatatatttgatacatttcctagaaattgaataggtgaatgtctctatataattttgtccaagtaattagcttcaaattctttattttcaacaaaattaaagatggattcaattgggttataaattgacagatcactggagtaattatgacaaatattactaataaatttttgttacaattttgaagacattaaaagaatgaagttgctataataaaatctcttctattccaataaacttattagttagaacacgggcttacacccataacaatgaaaaggaagaacaaaatgatgctgaatccatttcattccagcaataagtaagattcatccacagacaggttaccatgcataaaaataagcccattcatctaattaagggatttatttctaatatttttatgcttagtaattatttgtcaaaaataccaagaaaccattcacccaaatatatatttatatttttaagtgatttgtatactaaaaatagcatgacacatcatgattcactagaaattaatactaaggcttatggtacaagagaatttaaaaatatatcataaactttaattcttatacatgtttttgttgcaaagatatattttgagatgatgtgtaaagatatttaaaacaaaaaatagttgattcttgttattttctataggctatagttgtagtctgtaaagtcaccacgaacagtaaactgctgaatactaaagcattgttcctaggggaaaaatacagggttaggttcctttgagcctctggttacaacattttcatccaccagtcaatacataaccttgttttatgtgtgtttctgtttaaagacagcttgtttattacattttattgattcattaacattgcactcatagccaatatcactataactaatgccttaactaggtttctataatgtgtatttctccacaacggacatcaccacctacttaaactcaggaacactagccagtacttcagtactatgcttggggccatttcgaacaatgaaatcaccaataaaaagcaccaaaatatgaaaaacatgacactacatagacctcaaagagggcatttgtttgcagtacgaaagttgaaacaagaaagcagaacactcaacctcaactgagaacatgcttattgagcaactcaaatcttcacaactctgccatttctgtgaatgaccttaaaagcttccagtactgattttggggcaaggaataattttaccatgttggtgaatttgcaaatatggaacccgtgaaaaatgaagattaactatattacattgggataaagttatgcaggagagtagaatagaaatgaaaaagtttgtaaaaaagaaacaatatcaaatttcagactattaaaaatcatcttttacatgtattattagcaagatgatactgaagggtaaatcatcagttttaatatcccccaaaaacatttttaaaatgatgcaattgctgtataatttaaccttaatatttataatctgaccatactgcaactacttaaacctataataaaatttttatatcaacttaaaaatgtgcaaggaagtatatggtttctcaaggtgttttataatacatatgagcaaaataatttcaagattactaactttagaaatagaagctaaaatcacaatgaggctgattaatacaaacaaagaaataaaaactacacaaaatcccaaacttaagagtcaggcgttgaaaccaaatagccattcagtgatgcagacacaaactctggggctcacactgtaatgagtgtgttgtgtttgtcttattaataatgatgaagtatttttttataaatactgctttgctcatttttatatagacaattttcaaacaattttatatttctcagttgcttcaatcaaaaagaggtttgtggccgggcgtggtggctctcatctgtaatcccagcactttgggaggccgaggtgggcagatcacttgaggtgaggaattacagccagtctggccaacatgacaaaaccccgtctctaataaaaacacaaaaattaggctgggtgcagtggctcgtgcctgtaatccaagctctttgagaggctgaggtgggtggatcacgaggtcaggagtttgagaccagcctggccaacacggttaaacccagtctctactaaaattacaaaaattagccaggcgtggtggcacacacctgtaatccccagctacttaggaggctgagacagggagaattgcttgaacctgggaggtagaggttgcagtgagccaagatcgctccactgcactccagcctgggtgatagagtgagactctatctcaaaaaaaaaaaaaaaaaaaaattacctgggtgtggtggcacgtgcctgtaatcccagctactcaggagtctgagacaggagaatcacttgaacccaggaagcagaggttgcagtaagccaagatcgcaccactgcactccagtctgggtgataagagcgagactccatctcaaaaaaaaaaaaaaaaaattttttttaaattaatagaggtttgtaagaatatctaagaaaaatatttcctcagacaggagcattactttaaggaaaagatagtactatataaatatattccactgttaaatatttccagtacgtgtcttttcctcccagagatgggacagcttgctggctctgtgagtaaaattaattagtcctagctttttgttgcctttttttttttttttcccagtggcagcttgtaactttatctcttttttttaaatatccataaattttccatgcaacaataggataaatttatttcactaattttaggataaagaaaatgaataaaattaaatgacttatattgagtaaaataaaagaagaggaagaaataaatgtttttgttttgtttttaagacagggtctcactctgtcactaaggctggagtatagttgcatgacatcggctcactgcatgcaacctctgcctcccaggctcaagggattctcctgccccagcctcccgagtagctgggactacaggcatgcaccaccacacctggctaatttttgtttttttagtacagacgggattcgccttgttggccaggcaggacttcaactcctgaccccaggtgatccaccctccttggcctcccaaagtgctgggattacaggcatgagccaccgtgcctggccagaaataaacgtttttattgtgagccaacagaaattactgattcatgcattaaaaatattgaagcagatacagtccaaaggcagcatcatattactgtagagatactacatgcaatctgcttggaagactgtgcatagtaagcacttattaggtagataatggcactcccctgaactgaaaacagaagttataaataatatttaaaatccaaaaacatgatggtactaatattagtacaagaaattaccaccttatatcttatattaacttagcaaaaattattaattaatatttaatgaaattgtcagttagatggtcagtaaaaggaagtctttggcccacagatcaaaattcacaatacaattttatccttaatctttaaatacaaaattacatttacgagcgtatttttaacttcgcagcagagatttaagccagtggcaaatacagaggctctcaagccagactacctcagtttaaatgtctgcttctcaactttcttgctttaataccttcaaaagtaaaatactgttcacatgtatcttacagagttgttataagtatgaaatgtctgactacatgtaaaattcttagattaatgcatagtatacagtaagcactcagtaaatgttagcagctactaaataaaaagtagccgcattttcaaaaatgattcggaactttctagtaatcaccaacattactttcagaagctctagttggaaatatttgttaaaatcttctcttaaaatctcaacagatagggagaaggtggaatctcacacactgcaggtgggaatgtaaaatgctaccgccactttggaaaacagtccagcaatccctcaaatgctcaaacctagagttatcatatgatcctgcaattctactcctaggctatatacttgatagaaatgaaaaatatgtccaaataaaaacttgcacatgaatgtccctatcagcattattattaatagccaaaaggtggaaaccacccaaatgctcatcaattaaccaatgatatatgcatgtgtttgttgtatccatacattggaatattactcagcaatgaaaaaggatgaagtgctggttcataccacaacctgggtgaaccttgaaaacattgtactcagtgaaagaagccagtcataagatgttgtatgattccattgatattgaatgtctagagttggcaaatctatagacacagagagtgcattagtgattgcctaaggtggtggtggacagtgtttggggagaaacaggagttactgctaaagggaagtgggtttcttttgggagtgatgaaaatcaaaattgactgtggtgatggttacaaaactctgtgaatatactaacaaacaatgaattttagaatttaaatgggtgaattttatagtatgtgaattatatcttagtaaaactgtatctcctccgctgtccctccctaaaataaaaccaaccaaatctctgtatacccatcacttattaaagtacttggcaaaacactgtgacttagtacttttgggataagcggatgaatgaatgtgcattcacttcactttaaatgttttttcccctattttcatctattagagaaaactgtaatcatgagaagaaacttacaaaatttgtaaacatcatctttcacatttagagtttgtttttataatgtgacaaagtttttctgttaaatatctcacagttgctgtacctagaagtgctttaagaacctgaaatagtactaatggtatgaaaaaggtagacttatatttcaacctttaatatagaaaatataatttgctcaaattactcacactgttctaatttccatatgctctaaagtaagtatgaataagatttagacctaattgctggtgacattaaaattcattcaattcttactgtcaacaaatatttactgaataagtaactatttgctaggcacagtgctagaaagtgatattacaaaaatgaataacacagcctggtgacagagatattacaacagaattatgtacaagaatatgatacatgctatattagggcttgtgccatgcgtaccacaccaaatgttttaagaatgaagagaaaaaaaaggaggctgggtgtggtggctcacgcctgtaatcccagaactttaggaggccgaggcgggaggatcacttgaggtcaggagttggagaccagtctggccaacatggcaaaaccccatctctactaaaaatacaataattagctggacgtggtggcacacacctgtaataccagctactcaggaggctgaggcaagagaatcacttgaacctgggaggtggaggctgcagtgagctgagattgtgccactgcactccagcctggaggacagagttaaagtgtctcaaaaaaaaaaaaaaaaaaaaaaaaaaaaagaaagaaaaagaaaagaaaagaaaacaaaaaaagaagagaccagcactttgggaggccgaggtgggtggatcacttgaggtcaagagttcaagaccagcctggccaacatggtgaaatctcatctctattaaaaatacaaaaattagccaggtgtggtggtgcgttcctgtaaccccagctactcggggcggggggctgaggcaggagaatcgcttgaacttgggaggtggaggttgcagtgagccaagatcacgccactgcactgcagcctgggcgacaggctgagacttcgtctaaaaaaaaaaaaagagacaatgaagaagagtggctaaaagctggagtagttcaaaatatttcagagataagggaaaatataggaatgatagagaaaaataagtaggggatttccaggtagagatttgttttttattgctacaggttaaagacacagtttaggaattactcttttagacaacaacagtgtattttcattagccatgaggttgtcagtattataggatggaggtatttacagtagtgagcagagagcaggcagagtcttatataactgtgagaactctggagctgtcccatgaaacttttaacgagctaaattttctattttacaaaaggacaacgtaaataattcatctttcaatattaagacaacatgttaactaatcaaaaatatcctggctatcacaaaattcaaaaggaaaatgtcaaaatatctacatgtttatattttgaattgaaagatattctaaaagttgtttcatgattatgaactgcacaatggagaccaatgtttggttcacaaatgtgtgctgttaattagattgagagtgattgtatatggtttctcacaaaggcatcttgagttcaaccatgtaaattgatggaattatcaaaacatcagacctatttcatttcaacctggcttttataaccaaggtgtgtgtgtatgtgtatggtgtgtatacatgtgtggatgtgtgtggatgtgtgcgtacatgtatagtctcccccaatataaatgtgaggctacattttcaggttaagagggctaatgtgtatcttgccttctcatcacaaattgttctacaagtccatccataatgataattatatccttcaatagacggctgcttacttcccaaattttaaactgaacaaaaatattacggatccaccagataattttaaatctatctacttgaactgcaaaattaggagttgaatgaaaaccttacttagtgcagtatgtttaaaactcatctttggctaggtgcagtggctcacgtctgtaatcctaatagttttggaggccgaggtgggtgcatcacctgaggtcaggagttcgagaccagcctgggcaacatggcaacatcccatctctactaaaaatacaaaacttagctgggtgtggtagtgggcgactgaaagcccagctacttgggaggctgaggcgggaggttgcagtgagctgagatcgcaccattgcactcccacctgggtgacggagtgagactccgtctcaaaaaaaacaattaaaaattaaaaacgaaaaaaaaaccacgtcatctttgagcatgttagtacttgctttgatacaaagggtctgcttgagtttgtattaaatcatttaactctccttgtagtttcctctgttattaaatgatgagaatgttcctaacctattgcaaatgattacttaccatggaaatacaaccacaattatactcaagattattccaagcacaaagttttgcatggaatcactgtaacattaacactgtctaataagaaacaaaacccaaatctttctgttaggagattattctccatgggtctccggccttctgcaatcttacctcactacctctatgctggactagctttccaagggggtttgtataggaagcatccttataagacaaaggtagtgtcttcctctggatcaaagggcagaagtgcttcctgtctgtcataaaagattcgggttccctgagctccgggttcctctccttttaacacatcctgctgtgtgtgcaggtgtcacttcacattgccctgtggaaactggggcctggagatgttgacaatgtgactactgctatggggcaagtaataaactatccagctccctgacccaggaatctcatgtcttggggccaatgtttggttcacaagtgtgtgctgttaattagattgggcaccagctgagtgactgtatatgatttctcacaaaggcatctcgagttcaagattggcatccatgaaactgtgagcagcctgcaagagggataaagtctcagatacttcacagttcctgacactgtctatcatttccttgacttaggcattacattcttactctctgaagctgttattttgttgttgtttttggggacttaataagcacattttaaagataaaaataaagcttaaactgaaatcaaaataccagtctttattttattttaatcaaagactgccctgacctttttttgagatgagatcatgaggtgacgtttaagctttgtaaatgcttatacataacaagtactttcaacaaaaaattctaacaattcttgatgccttatatgccagcttagaagaaatcaatcattgtttactttttcacttaaatttgcagatgctgattaaaaggcgattactattttttttacacttaggtctttctttaatcaaaattgactatatctctataaatgggaatcagggatctgctattacacaaaaatagatgtcaacatatgaaaattaaataaatgaactttgccactgccctgtaattaagtgataaagatttcattcacttttctaaggttttaatcatttatgataacttttattttcttaaggaaaaattgaactttgattttaaaaattctaaagttttcctaaaatatagcactaatatgtaatggagcaaactttcaaagtcacattctatttcattagaaatttgtctacaaatggccgggcgcagtggctcatgcctgtaatcctagcactttgggaggccgaggcgtgtggatcacgaggtcaggagatcaagaccatcctggctaacacagtgataacccatctctactaaaaatacaaaaaaaaaaaaaaaaaaaattagccaggcgtggtggcgggcgcctgtagtcccagctattcaggaggctgaggcaggagaatggcgtgaacccagaaggcggagcttgcagtgagccgagatcgcgccactgcactccagcctgggcaacagagtgagattccgtctcaaaaaaaaaagaagaagaaaaaaagaaaaagaaagaaatttgtgtataaatacaagttttaagagccccccctcctccttcttaataaatattaatgcatttgctcctccactaaaaacactttaagaaaatcaacagccatggcgatctcatggctgtgatgtgctcagggcaagcatctatgtaacatatccctattctgcaacacctcacccagcagacagaatgtttacctaaaactccctgagcttatgaaaacttcaacaatcatgtcaacatttaagctcgttcccaattaaccagtcttaccaagcatcacttctatgaacattttaaagaaaaaccagtgaagtggtgaaatcaactctgtccaagcttgcatgcaactctaggaaggcggttagcttatctctcaactagttcttatattacaccactatatttaacatctgacttttgttgctgtttataatattaccctttattttccttcaattttagaacctcagtttgtggccacctacagaataaactttcagctttaccaaattttctcttcttatgagagatgcacaacacttaatagagagaacactatttttcaagctgcaatatactgtggtgttttcatgttagacataaatagtgtcagtgaaaatgttgatcaaagaaatgaaattctaataggatgtcagaagaagcagattaaacaaatgatctagctgttccaaagacatcaaaatgcaaaataattcttttctggaggtattacttagccaaatgtaatttctttagcaatttcaagaaagaataggaagtgttaatgttagtttaattatagaaataatgtcaagtgacaatggcagggaagaaactgaatgctgatttgatctacacacagtgacatggacatttagaaaatatattatatgataattatataatcctggctaaattctttgataggtttcagttgcccctgtaaatgttctaaaattaaattcaggagggtatattgtgatatttaagaatttaacaaagttatctcaagaacatctcacactctcatgctatctgcaatccttgaatatatggtgactaatatatcttaatgtatttttgtatatcaatattttatcatgttatttcttaagacgacaactccaaataacaaagtgttgaaagaaaatatcagaaccaccaatatttttctttccttgacatacttgcagatatatatttttatgtttataacagaagttaataaagaaacatgcccagcttattatttctggattgattgcagaaacagctactaccttttttgatgatgtggaagtttatgcatgtattgaggaggcaatagctgtgataaattacttcaagaaaataacactttccattgcctttctttttttccttacaacctgtgttatggagtgaaatgtacttggccttgtcttcaggaggcagaagcaatcatttgcagaataggctttgtgtgctaacatttaatattaatctattcccaggcattatattattaactttgaatagatgctgacaagtcttgtttttggagggaggtggggcagggtatcgctctgtcacccaggctgaagtgcagtgttgccatcatggctcactgcagccttgacctcccaggctcaagtaatcctcccacctcaccctcaagagtaagcaggacaataggcatgtgccactacacagggcaattttttttattcttgttttttttttagagacaggagtctcactatgttgcccaggctggtctcatatgcctgtgctcaaaggatcctcctgcatcggtctcccaaagtgctggaattacaggcatgagccaccacatccatttcacttttgctttttttttaatgtgccattgttgcatctgtttctactgaagaataaaacagataccactatgctctttgttttccttttttttttcttttaatcactacccatttattaaaggctaggtggatttgggtaattcatcactgctaagtaaggtaactaagagcacgtttatggatatattatatacactggttacctcgtttcaataaataagcagctggtaagtcatctcccagttttatccccaacttctaaaagaaaaataggtcgaaaaaattaacaaatctggttaggaaaaatacactgagcccaactattatgattccctggattctattattacgtttatttattagtattatgagtctttgctaaaatgttgacttcttatggaaggcctctcaacagtgctgtttaaaaatcacacgtaatcaatcctttcactcggcacaccctaacctttttcccttcttcctttttctccacagctttcatcaatatcaaacacaattcatcatgaaaatcaagatttattcgttttgttcactactctatccccaatgtctggcacatactagctgctcaataaataagaatgaatgtgtagtataccacatggatgaagtatgggaggtattcattcaagcacttatcatgcgctctcctaaattacttaacatcagtgactgcccccactccacccgctcctcatccagcctccactgaatgaggaaacagcaccatgaatgaatagctcatgataaaaatttagcgatcgtcatcagtgtatccctttatccctatcattgagcctttggttctatctccaaaatatttattagatttctctacctctctccatctgcattgtcgtgaccattatctgtcttttgaatcagagcaatactctcagaacaggactcccaaaggcagtcagaggaatcccttgacacaagaaaaaactcacgtcacttcctactttaaaggcctcaatggccttctattgttcacaggataaaatctacactccttactgcagcctacagggctgcacggcctggctcccacttgtcctccagcctcaaccccctgtcacgctcccgctacgccgcccaccgagctcccgctatgctgtgtctggaagaagccaaccccttgctggattttacaccttggtacttgttgttccctttgcctggagcactcttgcctcctatctttccatgactcattcacagcctctagagagtatctcaaatgccagctgcacaggtcttcctgtgaccaccctaattaagcagcctccctaactactctctcatcaccttgtttactgctaccgtggttcttatcaccactttgttaacttactctttgttaaatgtaagccccgacaggacagggactttgcctctgtatattcacagggactaataaaatacgtggaacatggaaattgctccatatataacaaccgaatcaataaatagaacattctccctcacttgggtggcatccctcgtctcactaattagaatgcctgacacagaagagacatgctacaaatgttgaagtgaatgagaaaactgaaatcttttattgtatcctgagtggcacccagaaagatctttgttcattaatatttgcatataataactggactgagagaaaaatgaattcatttgattgacatttactcagtgtctgtccagtgctggaaagagcatatggcaatttggcttgcaagcacagaacagaggatatcatttctaaactgttcggtaatcccataaatataggacacacacatttcaccaaggcatttggcaaagtttctcattatatcttgtctttaacatgcaggaatgcagattggatggtagcccagctgatgggtttggtactagagagtggttagatgaagacagcttaagcatgttcaacagctctttcaatgcagcaaatatttcttgagcagctccggccagccaagtactgagcttgaggctagagtaataaaataattaagtgtggtctcttacctagaagggtgcataagtcttcccgtaaaacatttcagatctctgccctgtaccattgacattatttttaaattaatatattggatggatatatacagaatgtacttctatcaaaatcatatgagaattttaggggaaaaaacagaagaaataataaatcaggatccaagagatgataggtatctcaaaggctggaatgaattctttaaattaaatttagtgcagatatgaggtcctaccaatgaatccaaaataccaactacatatttacaaaatgggggaaatatggaatgtatccactcataaacattccttagggattttaatttacagtactctataaaaatctattgtgatatagtgatcacagaaactagtttcaccttctggtgtatttacaaggaagtaatcagcctgtgctcagaccacacttaagactactgtgtttgaaggcacgcaccacactataagaaaagttcagaggaggcggtcgagatggacacgaggatccttgctgcaacagccaatggtgttgctaaaacactgacactaatgaagaatttgtggaatgttaagaaagtgggggggttgcaggggggggtgggtgacagaggaagtcattctacaaaaaggtacttgcagatgcatgtttatagcagcacagttccaggttgcaaaaatgcggaaccagcccaaatgcccatcaatcaatgagtggatcaagaaactgtggtatgtgtgtgtgtgtgtatacacacacacacacacacacatacacatactactcagccattaaaaggaatgaattaatggcatttgcagcaacctggatgggaatggagatgattcttctaagtgaagtaactcaggaatggcaaaccaaatatcgtatgttctcactcataagtgggagctaagccatgaagatgcaaaggcctaagaatgacacagtggactctggggactcaacaggaaaggatgggaagggggtgagggataaaagactacaaattgggttcagtgtatactgcttggatgatgggttcaccaaaatctcacaaatcgctactaaagaacttacacatgtagccaaatatcacctgttccccaaaaacctatggaaataaaaaatttaaaaaaagaaagtgtgggtgaatggtagagaaggagggagctaactgtccataagtattcaaagagcaggtatgcagaagaaatagtaaacctgttttacacgatcctagggcacaggactaggaaactacatgaggacagattttgattcaccataaaaaggcctgactatcagtgctgtcctgcgaaagtgaagcatctcgtgaggaagtcagctctctatcaatgacaggtctcccacggccactgggacatcctctggacaaagacatcagactcaggacttaaacgctgcatagacagcagatttctagaccctatgtccttgacattttatgatataatgaaaagggaactaaaaaataaggaagtatacattttcattcactcaaccaatgcttgctatggctaggcgctgttttaggcaccgtggacacagcagctaacttaggcaaagtaatcccagcattttgggaggctgaggcaggcagatcacgaggtcaggagttcaagaccagcctggccaacacagtgaaaccccgcctccactactagtacaacaattagccaggcgtggtggcaggcgctacttgggaagctgaggcaggagaatcgcttgaacccgggaggcggaggttgcagtgagccaagattgcattactgcactccagcctaggcaacactgcgaaactctgtctcaaaaaaaagtatgcttgtgaagcatacattctagatggtttgggacaaaatgaaacacaagcataaaacaccaatctttgggtttgagaggatacttggtgctagtttgaggcaaagctacacctgaggcattcacactttaattttgtttatttatttttaaattttatttatttgtttttttgagatggagtctcattctgtggcccaggctggaatgcagtggtgcaatctcggctcactgcaaactccagctcccagtttcaagtcattctcctgcctcagtctcctgagtaactggtattacaggtgtgcgccaccatgcctaatttctgtatttttagtagagatggggtggggcggtttcaccatgttggccagaatggtctcaaactcctgaccttaggtgatcggccagcctcggctacccaaagtgctgggattacaggcatgacccaccacgcccagcccacactctattttttatttatttatttattttcatttttatttatttatttatttattgacagagttttgcttgtcacccaggctggagtgcagtggcacaatcttggctcaccgcaacatccacctcccgggttcaagcgattctcctgcctcagcctcctgagtagctgggattacagtcacctgccaccgctcccggctaatttttgtatttttagtagagatgggttttcaccatgttggccaggctggtctcgaactcctgacctcaggtgattcacctgcctcagccttccaaagtgctgggattacaggcgtgagccactgtacctcgcctccacactttatttttaagctggaagttatcatagatagagccatttgttacaataactgcagtagaccttttgcctttattcccgctatatgttctcctttcctttctaacctgtggcttccactcctcaccactgcaaaacaatttacaattaattgcttatactgcaattattaataaaatatattttgccatttactaaactattagatatgttttctgagtttttacacattaaaactttccacagtaaacattataagtgttcattattagaattcataaattatacagaagtgcaaaaactaaaggatgtatctacttctgttactttcacagaataatctatgcatatgtactaatacagatttagacatatgttatcccaaatctggtagtacttttgtagcttttcattttattctagtactaaaattattagaacactagtctttttggaattgatttttaaagtcccctaattggaattgcagccatctttttggtctgtcctccgattgaagaagatctaacagtgcaatcatcatatgacacttaataagcatccttgctgggcacctggtccataagaacattgagaataaatactttcctgacattcagtcagattgattgatgcacatcaagtcaatgacactggggaacgctttgtggatggaatgactacataataacaggaaaactctaggaagatacacttaatgaatccttattgatctaaatacacctaaaacttgtttgtaactttaacctctgccacattatagaggaagacattccaaactcaaactttttttttatatactttaagttctagggtacatgggcacaacatgcaggtttgttacatatgtatacatgtgccatgtgggtgtgctgcccccattaactcatcatttacattaggtatatctcctaatgctacccctccccccaccccccaccccaagacaggtgtgatgttccccactctgtgtccaagtgttctcattgttcaattcccacctatgagtgagaacatgcagtccaaactctaacttttattttattttattttattttattttattttattttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccacgcccggctaattttttttttgtatttttagtagagacggggtttcaccttgttagccaggatggtctcgatctcctgacctcatgatccacccgccttggcctcccaaagtgctgggattacaggtgtgagccaccgcgcccggccccaaacttttattttatatatatatatcttagtagaagttgaacaaatatttccgaagctgttcagaacaaggtagaattcaacatactggaaatgtgtgtgtggcctgaaaattatagccagctactccagaaacctatagttgtggtgttttggaatttggtgacttggccatggttattcaattaaggaaaatattctcatacttatttttatatcagtctttcctactcaggtccttcaaagaaaacatggttaaacctattctctccccttcatagttgcttaattttattttttccaacccaggaagtcctaacttgtacaagtgtatcctcataaaatactaatgccttggtcatgttatctactctgaagtcattttaagcctttccctttgctaggatgcttaccacaactggatatttcaagtatggaagcaccatgatgtgaagcaaagatgggaaagtagttttatttctgtttgcaaacaaatgatgtctccttcttcactggtattttaggtaaaggcattaggaaaaactactggcttcagagaagaggacttaatgacactaagttgtgtgatctggtgaacacactttgaatcagttttgtccaaatgcatttccctatgtttgccaacatcaagctccctattataacatagtttctagaacagtgctgcccaatagaaggactagtaaagccaccgatgtgggccacatataaaattttaaattttctggtggccatgataaaaaagtaaaaatatgcagatataattttaatattttatgtagatgcaaaatattatgatttcaacaaataatcaatataggaggtattaataagatagtggtcattctttttttgtaccaagtttttgaaattgggtgtatgttttgtaattacagcacaactcagttgggactgtccatatgtggctaacggctactatattggcagacaattctagaaccaagctgaaaaccataaactgatggcaagtgtggaaagagcacagtttgcactctcagactactagattacctagactctttactcttgaaacatcaaatatgaattcatctattaaaaatgtcaccataattatagatgtaggttagcctttcttttacaatgatggggtaaaaataactgatttcccaccagctttccggtgcaacatccattaccataataaagcaaatttaaatttaattagaatgtaattaaaggtaatgtgggtgattccaggatagctgatttgttttactagtaacagaaacgccctttgccacttatatgaagctggaacaatattaatcaaatgacttattatctgagagaacaaagtacagaaatatttacataacatagtaccataggcagaatatccacgttaaactaatgttaagaacgacaaagggaagatacgccagcataatacatcttacttcttttccaataatacaactgggacattgcaaatacccaacttctagaatctgtcaggaagagtaatctacatgtatttaattctctcctgcacatgttgaatgactaaattgtgaaaatatatttgaatgcttttttttagaaatcactatacttctttgttaggttacttaatttttagcataaacccaccaaatcccatgtcaattgttaaaaatggatctattcaagcctacagtataaatttatggtttcccaggaaatcacaggaaagttgttgtaaaaggtattaaaattattgccaataaatcccatgtttaaaaatattctattaaatgtaaatgttgaaagtagtattaataacagctatgttcaaagaaaactttaagggcaaacataaaacaatttacttggaaggccatattacaagattcaaagatttgctagattctttgaacaggtttcgatgggagatgatgatcttgtgatctgtagataagagactctgaatatcaagtgatcagaaaccaaagcagagataaggctactgaaaatagcctatttcctgtgctggtctggacctaggctttggggtataggcaggcctgataccagaagtccgatgtagcaaaaggaatgaaggaaaaagatgaagagacaaaaacatgctgacactgtcattatttctacaaatgtcaaaataaaattcaaaatgaaatcgattttttaattataaaaattcttctgagaattgtttattttcccctccagacataagtaaacttaaggcaaggaatcatatttaccttctgatatgcttcacatagaatttgccactttttatcagcaatattaaaaatgattatgtgatgaatagctttcagtctatacgccctgagagcaggcaagaaaaattattcaaaaaaacaaaatgcttctcactattaaccaaaaaacagcctatgaaaaggcacagtcaaatgatcttggtcaacaaggctaaggcacccattcattatttattgagggcttattgggtataaggacatctaagaattattcaacgtcaagtgttgtgggccaaaagccacaagagaaaaggattttcacttccaagtccagcctaatagttccaatcttggaaagaacgagagaaataacagaggaagagaaaagaaagagaaacttggaggaggaacaaataaacagcagacatgttgttactggagaagacaaaaaatgcagtgagaagatagagacgtaagaaccgcgcaggtacatgcatgtatgcatgtgtgtgcatgtgtatgcatgtgagtgtgtgtgtgcatgagtgtgtgtgtgtttgcatgagtgtgcatgtgagtgtacgtgtgcaaatcaagagacacaagcacagggctgcgtgtgcaatgcggctagctgcgtcatgcctccggaagtacaaaacaccactatttatttatttacgcctctggaagtacaaaacagcactatttatctatttatgtattttgagacggagtctcgctttgtcgcaatctcagctcactgcagtggcgcaatctcagctcactgcaacctccgcctcccgggctcaagtgattctcctgcctcagcctcccaagtagctgggattacaggcgcacaccaccatgcccagctaatttttgtatttttagtagagacagggtttcaccatgttggacaggatggtcttgttctcacctcgtgagccgcctgccttggcctcccaaagtgctgggattacaggcgtgagccaccgcacctggcctaacaccactctttttttttttttttttgagacggagtttcactcttgtttcccaggttggagtgcaatggcacgatctcagctcactgcaacctccgcctctcggtttcaaacgattctcctgcctcagcctcccgagtagctgggattacaggcatgtgccaccacgccctacttatttttatttatttatttatgtatttttagtagatacggggtttctccatgttggtcaggctgatctcaaactcccgacctcaggtgatccacccgcctcggcctcccaaagtgctgggattacaggtgtgagccaccgcgcccagcccactctttttgagggtagggttcacaactgtgtatatgtaaaatttttagtctcaagatttctttaaagtggtaaacagtcatgctgcagactcataaactgtgtaaattcatacaaaagtttagtaaatcttctcaatcccgtttgtataggctttcttaagtgaaacaaaggggcagaaataaacaataggtaatgataactgtggaaaagaaaacaggcagcacagcatgaggaaaggacgagcacagggaagcccaatgggtcagaatgatgtgcaagctcggtcttgcctggttcaacctcatgaacaagagaagatcagcaaacgtgataccccagccacaagagtaacactgataataataattacgattctatcgtcatcattcatgtggaggtgcatgccaggtgctttcgaattgttaaccacccacaagaagcctgaacacctagagttctcctcatcgtgtacataagcaaagggaagggagagagagtctttaattggccccagaatatacagcaataaatggaggagctgaggagtaaggccaactggttctgaaatcctgcctgtggtgtctggctgtaaaactctgactcttgcctaagctgaagtctagcctgggacctgaagtgcagcaactctgactgaagctggatggttactctacttccagtattgtgctcaatgaagaggtcagtttttgagcaaatacacttgactctttgagggagttaagaaaaatgaaattgaaataaagccagaatatacaccagagaaaattttggtgtctattttcctgaaatcacacaatctatcttaaaatttttacaatgctcaaaggtgtttcatcattgcccaccaacttctatcctggtaggtaccaggaaattatcatctctcaggtttcaaataaagcaggtataggccagctgttcttgctcacagtgatactacaggcagtcaaaaaataaattcgctgatgaatgttacctcctagaacttccacgcgtgggacttacacactgatgcacgagtttccattggcatttttgacagcatctatactcctcttatatcaacagaatatgtccagaactactggctttataagagtcgagttatgcagttgctacacagggtcattttgccagtcctttcattcaaaaccatctttggtgactcccttcattgagaacaagatgcaaagtcttcaggtgttcacagtcctttacgattccctttttccacctatttcttgctatactttcccctttcagtatccactcttttctcatcctcctcctctctgctgcggcctctcctacttcacaaacaccagccacagggagcttgtttctaggtcatgcttcatattctcctgcataactgcatgttctctgggataacctttcccctacagcatctctaactattcaggaagctaaccttgtggaaggtccattcaaattatacccgtcttacaaatcctgctctatctcttgctgttgtttggcaacactaggatcctttactgtttgtcagcctcatcctgtttcccggcttctgcaactgtttttctcagtacagtgcagagtcccagagtgcagggtcctaaagcgcagggtcctagagcacagggtcctagagcgcagagtcctagagcacagggcgaacatggttatccacggtgagatcttcttcccctagtacctaccacagtctcccatataggagacattcacatgtatttgtttaattttatgaacaactgtagagcttactctgagaaaagaggtttcatactgacctgtaattggatattctctttctggcctagtatataacctccctgattcaggctgcggctcagagttcttcaaagagtaagtacagttatcactgttgaaagtgactctggctgtaaacatcaaagacgtgatttctaatgttgttgtggctgaaactccgcttaaacactagggagaacaacaagtccacagaagtcacatgtctgttcattaaacgcacaggaagaccttgaactaaacccttcacaaaacatctaacacagagcttgcaatggtgaggagcctctctctcctgcacagccagtgaacaatctaggcttggagagacagagagaagagcaagagcattctaataagcaggtgtctgtgacctcctgagtaaccaaccgtgaaaccaagagataagtacagtcatgggtcactgaacaacgaggacacattttaagaattgcgttgttaggggattttgttttgggaacaccacggaagggacttacataaacccagatggtacaggcgactccacacctaggctctatggggcagcctgctgctcttggctacaaaccggcacaacatgtttactgaatgccttaggcaactgtaacacaacaagaaacatttgtatatataaacacaaaaaagtaaagtaaaaacacagtataaaaggtaaaaaatgggacactcgtctaggaaacatggagtttgcagaactggaagttgctctgggtgatcagggagcgagtggcgagtgaatgggaagacctaggacatgactgtccattaccacagacttcaccaacactgcacactcaggctacgctaaagttagaaaaaaacatttcctttcctctgtgataaattaactttagcttactgtaactttttttactttataaactttttaactttttgactcttttaataataccggtttaacacacaaatgtattgcacagctacacaaaagtattccttcttcatatccttactctatatgctgttttccaccttaaaaaaaaaaacaacctttaaaacttttttctttttttttgagacggtgtcatgctctgttgcccgggttggagtgcggtggtgtgatcttggctcactgaaacctctgtatcccaggttcaggagattctcctgcctcagtctcctgagtagctgggattacaggcgcatgccaacatccccagctaattttttttgtatttttagtagagatggggtttcaccatgttggccaggctggtcttgaactccgtatctcaggtgatttgcccacctaagcctcccaaactgctgggataacaggcttgagccaccatgcctggcctatctttaaaacatttttgttaaaaagcaagacataaacacacagtagcctgggcttagagagggtcaagatcatcaatatcactgtctcccacctccactcacatctggtcccactggagggtcttcagggacaataacaaacatagagctgtcatctcctgtgatcacaatgccttcttttggacacctgctgaaggacctgcctgaggctgttttacagttatctgtttttttttctcaaaaataattagtaggagccaggcgcagtggctcacgcctgtaatccagcactttgggaggtcgaggcaggcagatcacgaggtcaagagattgagaccatcctggccaacatagtgaaacctcgtctctactgaaaatacaaaaattcgctgggcgtggtggcgcatgcctgtaatctcagctacttgggaggctgaggcaggacaatcgcttaaacccgggaggtggaggttgcagtgggccaagattgtgccactgcactccagcctgggtgagagagcaagattttgtctcaaaaaaaaaaaaaatagtataagttctataaaataactataaatacacaaaccagtaatatggtcatttttctaatcacgtactatacataattgtatgtgctggacttttacacaattggtatcgtagtaggctcattgaccccagggtcaccacgcacacgaggaacgcattgtactaggatgttaccatggcgaagacatcactaggctataggagcttttcagctccatgacaatcttatgggaccacccttgcagatgtggtctgtcactaactgaaatgtcatggggcacatggctgtatacatttttttactgtatttgaatgatacggacaattactgacgaccaaaaatagggaggagaggaagaagatgacatggaagtaagtagaaactatttctgaaggagaaaaacttacatgggaaaaagactccttctttgtgccatggatttgccagttgacatgactgaaaagcagtcacccaaacaatgaccaggaggaccgagtgctgctggtgaagcccaccagagaccagcggacggggactgctgctgtgttagcgaggggaaaaacagcctaggacactgcccaccccatcttcaagggcttccctgactctagcaaatcataaaaaccaaaacccataaatgatgaggccaccaagtcataaagaagaagtcaaacccaatcattacccttttgttagatagtatggaaggagacagtgtattttaactgattctctttttttttaagacagagtcttgctctgtcacccagcctggagcgcagtggcacgatctcacctcactgcaccctccgcctcctgggttcaagtgattctcccgcctcagcctcctgagtacctggcactacaggtgtgcaccaccaagcccagctaatttttgtgtgtgtgtgtgtgtgtgtatttttagtaaagacagagttttgccatgttggccagcttgtcccaaactcctgacctcaagtgatctgcctacctcagcctctcaaagtgctgggattacaggcatgagccactgcgcctggcctaaactgattttcattctactagaattaatgttctcatataaagaattaagtagtcagctatatggaaaagtgaagctttcaaaaataacccattccctattgatctagccagcttcagatttataatagcaaacaggataccaaattataacgagaccacaaattcttatctgcagaatcctcatgtccatggagaggtaaacttaagtctcttcaaaatctgtaaatactattagctaattattctgaaactggttgctgatacattttaaggtttctcttaaagttaactcactttctaagattctaccactactggtgggggaaaaaaaagcagtttttttgttaacgtataatgtttccattaagtggaaattcaagggcaggcagatgctatctcttaagagttgagcattttgtattaaaattaaccagcatgatatttggcatctcactgggatgcaaaagggaacattatttgctgctgcgtgccattagtgccagaaacattttttcataaaatgaagagtgcagctccactaatctattagtcctaagccattttagatcataccattgattaactaaaatatttttttttcaaatgacggctgatgacagagcactaccttaaaagtcaaagaactataaattaaacatgaatccagttaccatgttctgtcaaaacaagaaatacatgcgtgtgtttgtgtcctttatatgggccaacataagcttttcctattatttctggaaatattcagatttattagcacacataaaatcctcagactgaaattattataacatttatttcaaactgaaaaaaataccaaaggagtaatctggggggcttggtgtctcatggtggactcctatttgcttttgccccttttcttctttgggtcttaccttccagcatgcttaaacttctagttatagaaacccatggcaacactcactgcccagaataactatgtttactcagataatgaaaagtggtgtgataaccttatctcctgggataattaggttatgtccaaaaagccaggctccttaaagatccttttcaatgatctccatgcttgatacagggcactgactttactacaaaaatatttaaaacactgtggcttttcatactttcacaactttttattttatgttcagctgctactcaaaaaactaactttgtgcagtattccaaccaatacatcatcacataaatacatcttttacacaagcaagtgcacttgaagaaattccagttgaaggcatacaagaacctccaaggttacccaggaaacctattctgacgagttatgtatatgtcaaaacacatgagtctacatcttcataaaactgtgtgactgagagtgcatcaggggttaagctacgtaaacaaacaaaaccagcaataatggcaacagaaatattcacaatattggaatcaaaagtaactatttgtgacatctaatgttgattggttatccataattttttaaagccttcatattaaaaacaacgaaagaaaaatacatgaaccaagtatactatgtaaaatggataaatgaaagcagagaaaagaaagcaagcaagaataaatatctactccaaaacccaactctaaaatgagatgcataggctctttaaatcacaaaatctgtgtggcttactaatggaaggatccttagagatcatcttgtccaatctaccttccaacgtggaaatttattatccatcatacctaataccaaactgacgcagtccagcagaaacactccggcctgagggtatgcactgattccattgttggacagctagctctatttgttacagcccaacttttgacggatgtgtaagacttgaagacattaagacccagaaatgactctatgattatactatgattataatgactatatgattatacctcattataattactacagcctccataaatatatgctactcaaagtgtaaaaagtcacatcaccagaagacaaacataatgtgaacccctatcccaaggataatttatctgccatatgcacaaaacccagtctcacgatattcgagtctgggtcctctctgagaaacagacatcaagatctgatgacatgtgcaagaaatttattgggtgagacacctgtgaaggaagcggggatggattctttggggagttgcgattgttttgtgtcttatgtgtggtggaggtaaaagaagttatgcctatgtaaaaacacatagaactgtgcaccaaaaaagttaatttaactatatgcaaatttttaaaattagaaaatatatatttaaaaatttggagggaggtgtaggaagctgagaagcatcagactgggatacagattcaactctgtgaaggaggcagtggcggcagtgggggcggggaaggaaggaaagaagggacgtagggaaggagggagagagggagagagggagacggggaaaggaaagaagattttaaatatgtgataacacatgatgttccaaaaggtgaagaaaaacaagccatctcacagattgctggaggcagtctacaatggtaaggctaccaagaaggacaagttggacagctctatcaaaattagaaaggcacaagccctctgatccagcaattctacttttaggtatttacatgacagaaatatgtagacatatgtaagatgatgtgtctataaaactactaattgcaagattgcttataacagctaaagctgaaaaaattcagctcagtgtcaataataggggacaagttaagttaaataccttgtgttccattcatttaagggaataccatacattcttgaaaaatactgatgctcatatgtactgatgtagagatatttccactgaatgaaacattgcaaaaatatgctatcatttgatcatctgtattaaaaagatatatatggttgtctatgcataaagtatgtctaaaaaagaagaaagcaacgatagcatcagatgcctcttaatataaaggaactggctgtttgggcaagagaagttggtgggaaatgtcccactgtaaatcctagtggaaaattttgaaatttgaatcatgtaaatatattacctgttttgaaaggtaagcagactctattttaatgaagatgaaaaagatcattctaaatgttaggtgaagaatacggttcattagggaataagtgtcaaggcaggaagacctcttcaggaatggtggtagcaaaacagggggtctccgtggggctgacagaccctgcatacatgctaaagatgcagccaacaggagttgatactgtaactagatataatggatcgggggaaggggactcaggctggactgacttttggcttgagtatccagataaacaatgttggcatctgttgagatgggtatgactgagttacaaacagcttagcaggtgtaagaagacaaaaacaagaattctgtttgggacacattaacgtagagatgtttgttagccttccgaatcaagagagtaacagtacatcggagtccataaacgtgcctactgagatcaacagtgcttttaatttgcggttcttcagctgcagtgagacggggcatgcttcttaggagtcctggtcattgtgatgtataacactgtgactatctgttcatcatgtttgctcatttgcctattgggcattttgttccttattatttgtaagtgctgttagcatattcaagaaaattggcccttttatcacttacattaaatggttttcttcagttcatcaattttacttttacattgtttatatcattttccctagaggaactctaaatttttatgtggtcatatttactagtttttctatggcctgtggcatatattcttttcataatcaggaaaaacaaagacaaatctcatcagtaattattaatgtgaatgtaaattctataacataaaaaatacattttatataatttcagaagttttgtagtacttacacaagtgttgagggcattcattcgtcacttttgtagttaacccactggaatatctttaataaagtaataggatttttctttattccttagaaaaattggatatttagggatattcttcaattcaaagctcatgatcaactaaggattctttagaggaatggtacgtattattttttacttacagcattaaaactcagctagagataacaattgtgtttgcatagcttatttttaaaacatgtgggcacagtgactttgtgcaattattttagaaaacaccaaagtagtatgagagacactgctattttttaaatgctactcagcacaactaatgacttataaaataggtaattatttcctttgaggtcagaagtagacttaaatgttacagcagaaagccaaaataaatgtgattggtttttctcaaaatagtaaattagcacttgactcccacctgcacactggtatttatcttcctctccacaactagtaactcaatttgatgcagtagcagggtactgggatgccacacgtggtttaactcaccaaggagacagctgctttgtactgacacccactacacttgtctttaccccaacaactgttcacattaatctgagttaactaccctttggagcaacctgttcaatctcagttagtcgcctactggagtgcacagacacaggtgattgagatttgagggaaccacagtcacactgacagaaatggaatctcacccactgcatcttcagtctggctggagaacctgaaggagctaaaggcttgttagaaaatcctaaagaaccataatcttctatcgcatatgcaaagcctgttttacgtcaaatgattgtcagtggctattaagttgcattcacacaaatcgctaacaaattaatatctgacattaagaggggtttatttcagtcttttgtttttcttaaattataaaatgaattgctcttttatttttgaaacgtgcatacactttaaaaatgaaagtgactcccctctccacccaaccccctcctaattccactctccaggggaaagtgctgttaatattttggtgtacaactttgcaggctcttaaagctgcattactactcatacatatgtatatgtacgtatgtatgaatatgtatgattgatatatatgatgcacatatcaatctagcctgctgtttaagcaaaaatggtatcatacaaaaagttctacaattccatttgtactcaataatgcacaaaactccttccgttaaaggaactacagttctaccacatttttttcttttggtgtcatggtgtaccacaccacgtgcatatcagaatttatgtaaacattctcccttggggggccattccagttgtctctgtttttcataattaacaataatgcatctgtgaatatgtaccaccatacacttgctcatctatttgtgagagaccgaatatgagaagtgaagtttctgggtcagagaacatgtccacttgcatttctgataggtattatcaaatgccttttcaaatggtggttgttttacttgacattctaccaacaagaaagactattttataaggctgcatattcaaaagttattttaaaagcctcattacatgtaagacaccatatggagcatgtcacaagataaacacatcagtactctcatataaaagtagattttggccaggcgtggtggctcatgcctgtaataccagcatattgggaggccgaggtgggtggatcacctgaggtcaggagttcaagaccagcctgaccaacatggtgaaatcccatctctactaaaaacacaaaaattagccgggcgtggtagtgcatacctgtaatcacagctactcgggaggctgaggcaggagaatcatttgaacctaggaggcagaggttgcagtgagccaagatcgcaccattgcactccagcctgggcaatagagtgagactctagtctcaaaaaaaaagaaaagaaaagtagattttaaggaaaaaaacgcataatcacctactaagaaggtctagaaagtgtgattaactctttaaaatctaataagatatgaactctacctccttgaccacccagtgtctaaagggttattcctggggtcagctttgcagaaagtgcttccttatggagtggttgttagttgactttgccagacagcctctgcgttttcattctctaacggaggctggcaagactttgtatagagatagaaacaccaattctagtttgttccttgagaaggaaggccaagtgactggttttctgaggctgtgtgtatctcccaggcacaagcctctgtccccaggagagcctgcacgcgtggcaggacacatttgtggtggggctttttacgctccctgtcatcactttttatgattttctcagtaattccttttctttactgaggaaatgaacacacataaaactggaaaaacgagcaaagaattacataaaatctacacaaggacttcctggcaaaaagcttcactaacataatagatttaagttcttacaatcagtggttcccaggcctttgaatttcatggaccagaattttttttttaagtgaagaattcaacatagaaacaactattatttgttctttaaaaacatttttgaaaacctcactcaaacaaataacctagcaaaactgttttataaaataacgcctggctgggtatgaggactcatgcctctaatcccaacactttgggaggccaaggtgggaggatcacttgaggccaagagttccagaccagcctgtgcaacaaagtgcgacccccatctctactttcaaaaaataataaaattaaattaaaataatgggtattttaacaccaaaaagaagagttttgcctagacagcctcccagacataagaacagacactacatccaccatttccctttttttttttttttttttttttttggcggagggttaaacactcactaatatttaggaattagtcctctgcaatttttcacttgtcctgataaaatccagattttacaaagtttaaacaccacaaaaatcacagggctgtctatagaaggaagaattcctgttactcttagctgaatattcccaataattctttgactttctttctttgtcttatcaaaccaatgagaatctccaggcatgcatgttttaggtcaaattaaggaaacgcccctatgcctgatcctatttggaatttccatttttactcatgtatgtcccacgacaataaaattattgaaaagcaagtgccaccagtgtggatgcatggtctccacaaatccactcttcactgaggagatttccccacatccactaaggtgtgggtcgcctccagctgcagcgccatacctcatgagatcagcagagctcaggctgaatagcattcctcctttcctcctctctactcacacttcctcagaggctatccagcatgataatgaagaacacaggtggtggggtcagacagccactgactacctctgtcactctggatgggtgaccgtcctctctgagtatcacttcctcctctgtaaatgagaacaatactgctcactgcatagggctgcttgtgtgagaacagcacgagcaggcccacatggtgttggaaaaggccccgacgcatagcaagggacaaatagtgctggtgattgacactagcccctgccaggctcttgggcattaggaatccatagtcaagcaatgaaagggtcctgccctcatggagtttacactctagcaggaaagacaaatatttaataatcatgcaaactgaaattagaactctgataggtgatactaagaagggggtaaaggtgttcctgaagcctggggtctgggtctgtctgtggagatccaggataagccaccactcctgaaactttaaagatgagtaggagttaacaatttggcacagggagaaaggagcaggggtccagggagaaggagctcacccttccttccttccttccttcctcttcctttttcctaaattgtaaatgtcacctactctaaataaggcagtgtcttaaagaacaacctaataatctatgtactggtataaaccttaaacaaagttcaaatttactccaatgcacaaaaattcagttaatctctatgaaacaatcaaggatggcattatattctagaattcttctgctggccctcctccaaagcgacatatgaaaagctgaagcagcatacatttagcttgtttcacagaagaatacttatcttctaagtgcacaaagtaaaacattagaaagggattcagtacagaatattaaaactctgtatttttcaactgcctgcactgaggaaagatagaaaatctatcccacaaaaaagtatgagtttggaccagtttgtttaaatttaacaaaacaaagttcatcatggctgatgaatcaatctttgttttgagtccctatttttacgcaaaaccgcactttgcccgacagcatgagctacttgtgaaataaacacttcaagcctcaaatttcaaaggagttataagtatgttgggggcagcaatgcaggaataactttcccaccccctggtcactatcaacttggagaaaaattatttccaatttgccttctactttgtacccttgtggtgtctcagatttcacagtccctgaaggatgtgctgtccgtgcactcacaaacaccccactctggccatctccactttgctacagatcacagtctctttgcttccagtaacttttctctatgttccagggtcacaacccctcctcattatccccaatttccttggggtaaatttctaagaagtgtctttataccttaaatccttgtttctttttaaagcaagaaaatgctggcatgaggtcagatgcaaatcactttgcatcctcaaagcaactaaatattgtcccattgtagagatgggatgtccttaccatagtgacagtgacagcatactctctcatggctccctgcagagtccttggaagcgatgtgacaggttttcataaagagggaagagaaaaggacttaaaacactgcctgcaggagcctctacacccttattactttctgggttattgcctcatgaggaaaaagaaattcaatcatttgtcggggggaaaaagtgtgctttttcttttcaaagtctacccttttatgaaatatttaagcaaacatttatttacttctaaaccaccaggaaaagaaagaaaagcaaccaacatttaacttcacagaagaaataaacatttcactaactgttatacctttaaatttgttttgatatacagaagatcatgaatacagtcatctatattttcctagtcagtgcaacaaaaaataacactcactaatagatcagaaaatggagatgacaacacttaattccagaatccaggaattttttcccatagtttcctgtaatccctttaagactctaaacaaagtattctaccttttttctttaagaaaacaaaacgaatttcatgcttatttgatatttctaataaatgattttaataatagactaagccaaaaaggaagctggtctatattcattaagaaaaatgcaaccataatcacatttcgtgaatggacaactttcacatatccacactctcaatgcctacaaagtttaaatggaaagatggatcgttcaggaaaagcgttgagagcagcatccagacctcagcactgccctcacactgagcccttcaaaaggacggcacgaggggccaggtgcagtggctcatgcctgtaatcccagcactttgggaagccaaggagggtggatcacttgaggccagaagctcgaggccaccctggccaacatggcaaaacctggtgtctactaaaaatacaaaaattagctgggcgtggaggctgaagcaggagaatcgcttgaacccaggaggcgggggttgtggtgatctcagatcgcagcactgcactccagcctgggtgacaagagtgaaactctgtctcagaaaaaaaaaaaaaaattagccaggtctggtgacacatgcctgtagtcccagctgctagggaggctgaggcacacgattcatttgaacccaggagatggaggctgcagtgagctgagattgcaccactgcactccagcctgggcaacagaatgagactctggctcaaaaaaaaaaaaaaaaaccaaccaaccaaggatggcaccagggaccactttgtagggtgtaaacaacaaattgctcagcataagaaccattttgaaaacacaatgaaggaaaacctgagatcaccatgcttcactgggtctccagggcccagacagaggtgacgcaccaggtgtgcgtgacgacgtcaccctacaacctttagtccaccttcatgctccagccactgcctgcagctgcgcccagacagcacctgactgcagttgccgtgcctcactcactttccgccttcatatgcctcatacactgccagctcgtgggacgcccatggagactgacttagccatccggctcatacacaagcctgggggagcaaggcagctggctcagggggtcaggcttgactagggagaaccagtcttttgggcagatgcctttgaggcccattcgtcacagctccttggaaggtctgcagcagggtccacaccgggtagcttgttgaggtgaccagccgcacaatcagggacttccgggcatggctccatgtcttgataacatgccagtggctagaacactcctgagcaaaagtatcctgtcagcagatcacgtgttccctgagaaataaactgctgctgagaagctactattaataacagatggcggacagtttgctgtgatacctggactgagtacctcggtgcctctgctgtctctgggccatctggatttctaggtgtgactgtggcagacgtgtctcgggtgcagaggaaatggaaacaagatggtcctgcttctgaactcggcctcatgccctcatgccccaagtctgaagttcttttggtctcctcttctgtacttctggaagcttccactagtctcttaccatgctcacatgaactaaaagccagatgcctaaatgactaacatgataaaagattggcctgtaaggccacagtgacaaatgtcacctgaaagacgaaggggaaataatttgcattgaagggtgcgcttgcttatcctcaccccttggctcatccaagtagcagaagagtttgggttgcatgaagcttccaaccattcaatgcaggctgagctccacagcagtgcctaggggagcacagctcagattgtgctgagagccacctctcttgtctcacaggtcccatccctgggctgaggctctttatcgaggaaagaaagaaatgtcctgtctggcctcacacacctgaaagtcgagaagcagaagaatggccgggtgcagtggctcacacttgtaattccagcactttgggaggccgaggcaggtggattgcctgaggtcaggaggtccagaccagcctggcatggccaacatggtgaaaccccctctctactaaaaaatacaaaaattagccaggtgtggggccgggcgcggtggctcacgcctgtaatcccagcactttgggaggccaaggtgggtggatcaggaggtcaggagatccagaccatactgactaacacagtgaaactctgtctctactaaaaaatacaaaaaaattagccaggtgtggtgacacatgcctgtagtcccagctacccaggaggctaaggcaggagaattgcttgaacccgggaggcggaggttgtagtgagctgagatcccgccactgcactccagcctgggcaacagagcgagactttgtctcaaacaaaaaaaaaaaaaaaaaaaaagaagcagaagaacatgtctcatgcacacttgtgcttcctgccccctcccacacccaagggaggaggatggtgctcatgcagaagacatgtaatctcttcttccagagttttttgttttataccagcctatctcttacttcccttgttcggccagcaggataaaaatcaatggacatttctatcgccaacctgctgcagctgcttctcagaaccaccatccctttatgtagaggaagagagaggcaatttaaaatggaaaagggagaactgcgaagaggaaggaccaaaggtgacttctccctttatccttcctgaaggccaaaggttggagacagtaaaaggaaactttgctgggtttgtagaggcaaagagggatattatggacttgaaagaacttttcagatgcggttggttacaagaatgaaaatcaggcagcaatgagccaaggacactcagcaatgccatcagcagtacttaattccacaaatagagttatcaggtgactataaggtactcagagaaaaggttcatattttagatataaaaagatttatctcttgggtctaagaaactacatatttcaaagagaagaataatcagcttataactaagaagacagactcaagaaatatgagcagtgaagaagataaatggggaatactgaaagttttttgaatttgcatatttaagctggtgataagaaaataagaattgtgttatttcatcctttgacgaaagcgtccatgcatgaccactccttccataaggaagccctggtacacacagagcctagattatccactgataaccccacaccatctcaacgaagctaaataaagatggagaagaaggggctttccacctctcaccagctggcctcatccagtgtcttcaggaaaaccagcctcctaggctttgactggacttccccatttgtgagatgagggagaaaactcaatgacctctatatcctcttcccactctgcaatgtggtgactgaatcgcatgatggatgattacatggcctttacccaatcccctccttactgttactgtccatctatttcgtctttcctgcctcattgtggagatgctgcaatgtgccactgtggctgtctggactacatttcccagaatcccattctctccatgtctcccattgtggtgcactataaataagagaggttcttaggtgggatctggaagatgggctgaagcagccacccttcattctgcagcttacacaggctgttgtcatctacagcctgggcgttggcatcaggcaacagctgggcctgcagctgtgctgtgtcccctggcctttcctcaacatctctgacccagggccaggtgtgcttgtttagcaccctggtggggaaccctggcttctgcaagaccccagtaagcccagaggcaacaacagtgacacaagttccagcatcagggttgagattttcttgctctcccccacttcatatcaaccttctcttctccagagcctgccatgtggacttcaagctccagcatccaatgtgagacaacagccttataaacactgcttgatcagccctcacaattgcagaaggtcaaatccctataacaaagctgcttgtatatatgatcagacatatgtgggttggaaccttgaataaacctcttaaatggggattgtaattgtgaagatctcataggatcactgggtggtttaagggagatagtgaatgtaaagttggcatggaatgcacagtaaatactgtgttattattaactaaaaatcccagttaccctgctgagaaaatctctctcattttttcatagctgtagaatcaagcgaagtaggcattttgcctatgtcgtaccagggactaagctaacagaaccctggctccactctaaacctaagagaatctaatcctatttttattagagaccagaacatagtagctaacaagtacttaacctctccctccaaggaaatgatggcgaagccaaaaagaacgataccaaactggaaaccattgatttcagtaagatatttcactgtcactgaaggaaaacatcattttaatggtggagtttgatatccacattaaaagacagttaatcgagagacatcatacaatagagctatttgggtagagtacttggtgaactgaaagcctaatacataaattttcctctttcagctcttactaatgaaaaaagttattcaaagaagtatttgagatggacttaaatatcaaaaccatacttcttacttttttaaactacttaatacatatcgtgttccaaaaagatctaagtatacaaaattagagtttttctcatcagagaattaaatttaagtccatcaagaaacctcaggctttctgatctgtacagcactttttggtctttttatttcagtctcaaatattttgaaatggtattaagttgtgtccaaatgacacagtgggccagtggctgggggagggaggtgagacctgaatgccaagagcttggggaaccattgtttcccactctattctgatgtccaagctgacacccacagcccactgactgtctcacctccagtgtgccgtgtgagccacctggcacacacacacttcaaagccagatctcagtgtgatacctaaagagcaaacgtcatcttggtcctcagagccatgagcccttgcagattctctgccagtgtcatctttctttctcactgtcactcaattttaaaacactgccgccaagtgttgttcatctttccctgatggcactcagcaccatcaccgacgtccacaggtgcttccagacacatctccactgtgcctccagcctcctcaccaggttctcaccatcccacacctggacagcctgtgacacagccggtccggggtcaccaactcctgccccctttccatacattcattcacatatgatctagtcccctcccacatacacttcactatactatctttcactatataaacctttaatgtggccaggtgcggtggctcacagcactttggaaggccaaggtgggtggatcacttgaggtcaggagtttgagaccagcctggccaacatggtgaaaccctgtctctattaaaaatacaaaaatagtcaggcatggtggcgagcacctgtaatcccagctactcaggaggctgaggcaggaaaacagcttgaaccccaaaggtggatgttgcagtgagccaagatcacataattgcattccaacctgggcaatagagcgagactcagtctcgggggaaaaaaaagaaagaaaaaaacagtatagattaaaatgattgattgtagagaattctgctggtagaaaagtaaatttatacttgcatgagtaacttctacattctttgtaatggattttacataataggagcaggtattttgtgacagtaataggcccactcaagcagctggatatacagctaactctttatcactgttagggctgaaatgaaacttggtttacttcttacatggaaaaaaagtccttttcccaaatatcaaatatataaacttagattcatttagaaaagttgactcctcagtagataataaatgtctcagatgaaacaaatctctctctctctccttaaacacatacagaataggaaaggcttatacacatgcgtgcaaattctggctcctcgcaatgatcctgagtgtgttattttccatttaagccttggtttttctccttctaaaaatggaagcaatgatatctatgtgacaaagctgtagagaagattaaattagacataataagtgcctagcagaaaagagacactttagacgcaattgataaattgtagccataattatgtatatgaaatacttgtaactataagcccattttccatgttgtttattccttcaaggctacacttgtatttgaatgtctatctgccactgtcctggtttacagcaaaatcaccttataatgaagaaagaggctgccatgtttcgaaacctcctttaggtggaatccaatgggaaataacttataaatacatatttttattgtatatgtaacagtatatttttagatttatcttagtgatgttgtaatggctaattgtataaattctgaatcagcctcacttttccttttaactcagttcatatatcaactcttcagccaatggaaatctcctttatagggtgtggcataaccattaacctccctttgtgccccatgtaatttgactataataaatttcactatactgtcactgctttgtgcatagtagatgctcagtgaatattcagtgaatttaaacttggcaagtagtcaaagagaaagaaattattttaagtaactaaacttaacaaaacacctaactacgcttccggaaataggtaaaagaactaaagattacataaagtatcaggtgttagaagtctagaaaaacataattctccaaattgtgattgtcaaaatgtgagcccagagataaattcccatgcctttgcatatgagcaaattggctctacaatttttacaaaagaactatggctctgcactgttggactcaaacgccctttgtgctgcattttcattaattcaaaacacttagaatcattttgcagagcagctcattttgtgcagcagagggaggccatgaattatctgttgtgcctgaataaagctctgcaatgttgagccgtgtctttgctgagtctaggcgcctccacttcttacatgccatgcgaatgacacagtttgaaaaacacaaccaaatgtacacagtattccatcttctacgaaaagcataaggggggaggaggaaaagaggttggttaatggaagtgagtatagatagaaggaatatgttctagttttcaatagcacagcagaattcctatagttaacaatcatttattgtatatttcaaaatagctagaagatttgaaatgttcccaacacaaagaaattataaatgtttgaagtggtggatattctaaatgccctgatttggtcattacatgttgtatgcatgtaacaaaatatcacatgtacccataaataagtacaattgttatatgtctatttaaaaaaggaaaaaaacaccatttaaatagaaaacaacataaaaagaatgtatacatcctttacattgatgagatctctaaaccagttgtgttcagttccacctttgaaccctcagaacaagggatttgtgcttattgctacttacttgactctacctggtgttcagtctattgtgtacaagtctcctgtacatcttatccttatacccaactctataaattgtaagctccctgaagaacggagctttgtcctgtccttcctgacacaggcaacactcaacatttgatgtctatctagtctacgtaactatctcttccagcagaatcattttttttctttctttccttttttttttttttttttttttgagatggagtttctttcctttttctttttttttttttttttttttttgagatggagtttcgctcttgttgcccaggctggagtgcaatggtgcgatctcggttgactgcaacctctgcctcctgggttcaagcgattgtcctgcctcagcctcctgagtagctgggattacaggtgtgcaccaccacgcctggctaattttgtatttttagtagagatggggtttctccatgttggtcaggcttctttttagaacagtccataaactgccgcctttaagtgactgaatcctggaaataagtgtcaaaaaacctaatgtgtatccatgaaagtattacagtaaataacatgtaataatgtgtatatgagaaagaaattgtattattctgtaaggtaaaatgaggtttatgagaattggacagtagccgttaactgctgttttattatttatccttcatgtataggcaagatgctactgaaaatgatcattgtctaggtatgactgaaaaaacaagcatgttcattcattcgtttgctcatccatttattaaacaaatattttaatcatttcagcaacatgtttgtgttgctgccaaagagaaattagattctaacatgttcaacttaaaaagacttcagtggctccctgttgtctctgggagtaagtccaggtcttctgcgggatacgtaagttctttcctgatctggcctctccctgtttccctgtcttatctctcatcacgcccctacttccaccctttattgttactgtcttgtttcacaccctccatgcctctgtaaatcttgtctctgcaaggaatagttttcttctctctcctaactcctatatgaccttaaagacttacctgaggcaactctgtgccctggtaaatctttcatattattcaaatctagagcagctgttcctcctctaggtacccacagcatcctgggctttcctttgtcatagcatttgtcacacctcttcaaatctgtttctttatctctcttgtccactagactcttgcaggccgtatgatactcttatctgcatgcccagtgcctagcatggtacccagcaaattgtaggcaaccaatacatatttactgacgactgaataaatgtggagactggggcaactatgacaaagagaacagacaattaactggaattcaggagacccggacactgtcttcaaaggttgaaagacttttggaaaattaatctttttgtgcaactcctggcattagctaaggtggttgtccaaagcattccttagctctgtggctacctgacattttctaaaagtgacaaagttctaatgtgtctctagccgagaggaacagttacagttggcacttaaaaacattatttgtttgcttagggagacattctgtatcttaatttcagactacttatgacaggtctctgatacaatgtatggagtgtcaaatatatcatcttttctaggttttaataaaaagaaaaccttaccaaaaaaaaggttgccttgacaatatatctatagacaatatctgaattaataaactgaccatttattttcttttctagttaaggatgccatctagaacaaggacttggtcatgacaattggaaagccatccaatggttcatggctcatggcactcatattagcaaaggtgggttcctgtcatccctaccctgcccttctcagctcaggtgcacatctcctcccatcacaccaaacagccacaaacagcctttctcttttcttctttttttttttttttttggtgacagagtttcactctgttacccaggctggagtgcagtgcatgatatcggctcactgcaacctccacctcctgggttcaagcgattcttgtgcctcagcctcctgagtagctgggatcacaggcgcccgccaccacgcccagctaattttttgtatttttagtagagacggtgttttacatgttggccaggctggtcttgaactcccgacctcaggtgatccacccgcctcagactcctaaagtgctgggattacaggcgtgagccactgcgcccggcccaaacagccattcttactgcacgtctatatggtggagttaactccatttctcaggaagacggacggaatgagtattctcaacagataacagattttcataggctgtgaaaccttagtaatttgaacaatagaagaatgacctaagtcagtagagtctcttttcttacaatggcttaagtgctttcagacacaaagaactaaataaggcatgctaacaaatagattggctggtgaatccttatctttttcttaatgaatacacaatatgtaattgatatgctatctgtatataacttgaatgtattgaaagaagggccttaaatgtacctcaaaaactatgtttctctaggtatatttaatattatttcttaaatactattaattttattacttacataataaagatgttttaggttgggtgcagtggttcatgcctgtaatcccaacactttgggaggctgaggcagaaggactgcttgaggccgggagtttgagaacagcttgggcaatatagccagaccccatccttacaaaaaatttgaaaaactagccaggcatggtgttgaatgcctgtagtaccaacaactcagggaggttgtggcgagacgattgcttgaatccaggagttcaaactatgatcacacctctgtagtccagcctgggcaacacggcaagactctatctctaataataatagtaataaaaggtgttttaatatccctcctcccccaagctccaaaagataaattctaaactagtggagtttggatcagtgagggttgatggggaaaaatgtaaatatagcagtcttttcacttcaggccaggcctcgtgaaatccatatctttaaacttcattatgtttctaaatcccttttttcctttttttttttttgagacacagtttaactctgtcacccaggctggagtgctgtggtgtaatctcggctcactgcagcctccacctccctggttcaagcaattctagtgcctcagcctcccgaatatctgggattacaggcatgtgccaccacgcctggttaattttttttttttttttttattagtagagacgaggtttcaccacattggccaggctggtttcaaactcctgacctcaagtgatccgccctccttggcctcccaaagtgctgggattacaggtgtgagccaccgcgcccggccatgctcctaaaactctaacctgtgactctggaatatgtttacaaggaagctcaagattgaggacactgcaggccatctcaaaatgatgtcagagggcagaaccaacgcttacattaatagaattgctggggcactagttgccttgccggagtggcacccttgaagataagaaacaaaatgacagctcgcaccaagtattcacccttaggccacacagataaatgtgcagcaaacctcttcaggctccacttgtctggagaaggagacacatgatatattgatgtaatgtgggaaaaagacgaattaagtaattttaaaaattattttaataggtcatctatctagaaagaatggcaaagaggaagaccagggtgggtgggcaaaatgcaccattttgtttgttaagcaacatcttaaaaggtgcagttaaaatatatgtacacttcctcaaattaagcaaacatcatcattaggatatttcagatactgaaactgatgagaggcatcccacgcccctcttttttgagacaaggtctcttctgttgcccaagctggagtccagtggtgcgatcatgtctcactgcaaccttgaccttttgggctcaagcgaccctcctgtctcaacctctgaagtagctgagaccagaggtgtgcaccaccacacacagctactttttacattttttgtaaagatgaggtctcactatcttgcccaggctggtctgaaactcctgggctcaggccatttccccaacgcctcccaaaatgctgggattacagctgtgagccaccttgcctggctgaacagtacctcctgagatgaagcaaggtgtgggcaggcttcactaaagggcagcattacaacagggaaatagtcatgcgatatgtctaaagcaaattatcatgcctaataatatttctttcagttgaataattacaattcattatggctcatttcttatcattaatattttcatttaaaattataaatgagatgatcacataaaatgaaaaactgactttaaagttaaaataacacacgcttttcctcaggaaaagcgtgatcccagcattttatagaattggaaaatatttgggtgatgatcaaatccaatatcctcatttcacaaatacataagatactcaagagtctaaatgatatttcaattttatccaactagtttggaataaatccagcagaaccagtgtctctggatccccaacccagtgtttccagaacaatattctgtgttacataattttatatttatttggcaaactacattttaaagttaaaggatctaaatatagaaatagtttcgtatattatctttcttaatattaaaataaaatagaatatcttgtattgtatttggtggactgtttttgaagcatcaaatttatgtattaataactatggatcatgtattattattcctcaatggcgaatttggcaccctacagaaaatagtcttcatttctttttttttttttttttttttttgttggccggggggtgtttttttagacagagtcttgctctgtcacccaggctggagtgcaatggcatgatctcggctcactgcaacctctgcctcccgggttcaagcaattctcccgcctcagcctcctgagtaggtgggattacaggcgcccaccactatgcctggctaatttttggtattttgagtagagacggggtttcgccatgttgggcaggctggtcatcaacccccgacctcaggagatcttcctgcctcagcctcccagagtgccgggattacaggcatgagccaccgtgcctggcctatgttccttcctttcaaagaaacattcatatttgaatgacttgactacatagaaaccttgaagaaaattccaaaatgtaggaaaattacaggccatgataacataatttaaaacataatctaataaaagtataaccaagcaataggaagatagtttagtatttaaaccatttgaatataaaagccttttaacctttggtcaacagagaaaatccaattatatttaccattatctaaacgtaaattaagtgggaaaatacctacaatgtgaatgttgatacagctgaactcggaggatccgaacagctttcagatattgaaaggagagaagacataacctaaacttacccaatgtgggtaaacaggagggtgatggggcaagtgaagaaggacaaggctggaacatcatgctaattctaagtcagattacaaagtgtttcaatgccgtgcaaaagaaatctgaattatttttagatgacaaaaagagcacatcagaattttttaagaagcagagaaggacttcttggcaacacagctgactgaattgagaagggctcttcttcctgctccaggcagaactactggaaagagagacagagaggacacagagagagagagagagatcacaaaggcagagaggaaggcaggctgacgggaaactccaggggttggaaaggcagagggaaggccaacccggagtggtgagaacaccagctgactccgcatcagcctagggtcctggtcccagaccctgctgtcaaggctgaaggatggagctgagcatacttgctaatacgagacacgtgttttagggcctgcaagaggcagaaagctagatctgagaatctgtgcataagccatgaccctggaagacacacttggaaaaggggtttacaaaacttcacccaaataagtggcaatgaagcccagggctctgggaggataaaaacacacaaaaaatgttataataaaagtagtaactaaaacagtgacatactggcatagggaacagataatagatcaatggactggaatagaagccctacatagatatgacatcttggtgtacgacagatacagcattctgtattagtagggaaggatagagtcctatataaatgagacctaaatgtgaaaagcaaagtgttaacatttaagagagaaatataggagaatgctttgtaacattagtataggaaggctttattttaaaagttcatgaaaaaaagaactgatacatttgtccccactctatttaaagcatctgcacgtttagacaaactataacccaagtgaagacaagccacaaactggaagaagacaccactgataaaagattagtatccaaaatgagtaagaaaactgtagaaatcaatatgaaaattcaaaaaaaggcccaagggaaaaattgaggaaagacagaactaggcagggcacagaggaggtaacctgaagaaccactggccgtaaggaagatgctccacctcagcatgaatcagggaacgctgaggaacatggcaaggctgccccatcttatagccattttattgtggaaaaatctaagattccgaagatactaagggagaggaaaatgcagagcaatgagcacttccataaactgccagtggccacgtaggagtttatttgtatgaccagatagagagaaatgtgtaaagagctactaaggtttagtattcacatttcactggacctagcaacttcgtacctatgttctaggggcactattttcatatgttcaagtaaacacgtacaaggatttttaatgcagccttatttgtaattgcaaaaaatttggcaacatacaaaatgtttatcaacaggacaatgattacatgcattgtggtagtgtcataaaaaggcatggcatgcccctattaaaataagcatactagagcaatttttctcaaaatgttgttcaggaatagcagaatcagcatcacctggaaacgtattaaaatgtaaattcgcagaccccactcaagagctactgaatccgaaatgctggcagtgggacgcagcaatccgtgttttaacaagctcccttcccccatgtcaggttgagagcagttatactggatttacctgtgtccacatggataagcttcaaaaccaaaatctgagccacaaaagcaactatacaatacaattaacataaatcttaagaccataagtaatatatggacagaaaggatatatgccaactttaggagggatgaaggggtaatagaaatagaagggagaggatttcaaatgtacccataatatgtgatttacttgacaaaatgatatgaagcagatctggaaaactgtgagtatttgtcacatcagcgtgataagtatagaggtgtctgctagattattctctgcatttttcagttagttttgaatatttcacaagcatactggcacagccaagtcagtgtttctgtaggataaccacattgtaagggaaggtgtaaggcaggagagatgggaggcaggggcaacaagttcctatattgcttcagttacccagcaaaggaagggagctttaactgaggtctcagttttctaggacttgatcctccatttggtgctgggagtgaagaaaaggggcagccaaagaagattccaaaatgtgcagctatatggaatgaaatctgaatctgagaagaaaatgtatgtcctcattcaatagttggtatttgataatagagacagcaaatggtggtaaggcaagatgaaaatatcactgacaacagaacccttgggaaaataaagaggaagcaaaaaaaaaaaaaaaaaaaaaaggaatgcctttagaggtaggaagaaaaaaggaagcaaaagaatttctactgaagtcaagagagttttacaatggaaaggatcatgtggtagagaaatgtctagcaagctaaagactgagaagagacatgtgatactaggaagagaatttgattattacagtcctccctccagccccctgaaatgcttattttataagagatcttggagaaagtctatttcattatttgaaagattaaatgtgcgatatggaattggcaacagcaaatatggacttaccttctaagatgttctgagacaaaacataaacacaggggcagtaactggtgattaaagtttaggaagaggtgggataaaaatggaatcatgatcccgggtgaaagggtcagctttgggaaagatgaggaattcttgcttcgggagaagaggtaaggaggagatatcaatacagtgggaagagatgacgagatgagtttaggaaagttcaaggagcaaatagctccatccagcaccagcttggaggcaagagcacatcacaggtgccttcatgcccttaagcgcatcacagtggacttaaggggccgaggagaagagacaaggttggcactggagaatggaaaatggggtttgctaagaaaaggtcaaagaatcaccatcccatattttgaggaaattagggacaaaaatattttatataatgagtgagcatagttatttcaagtagcctgatggcagaacaggagagggtaaaaaagacctgggttcttctgaaagtgaagaatgagaaggcaagcactccaatatttgcattatctcaacatacaatgatctggaagatatgctagagccacctccaaaatatactgaatttccatccattcctctttcccctctagttcttcatgctatgatttctcacccagaacaagacagtagcagtaactattctcatttccactatgctggctccctaagactcattctccctagaagccagagtaacttctttgaaacgcaaatcgtatgatttcactcctatgcttaaaaccatccaatggcttctcactgtcctagaatgaaatccaaagatggaccctgggaagcagaaaagatgacaatcaagagttcttcctgtctctcaaaaaaagaaaagaaaaaaaattatatatatatacgcatattccttaaggttaaaaatacccagttcgctccttttgccagcaccatattgacagcctcaaattctattcaatgattttgaagaataaatgtttttataaaacttaagtaacaaaaagatctactacacaaattaaatcactgttaagtgtgaactaggtaaattaactgataggaacacatttacaaggtatgtataggatttatgaaagcctatactctacttttcctctaaaagactgatttttaattatattatttgagtgatcatttgatctatgtctgtctcccctgttggagtgtgagcttcaacaagacgaagatcacctctatctactttattcacaggattatccttggcattctgcacagatccgacatgctgtaggggctcagtcaatactggatggattaccgaataaatgttagttaaattactgaatactcaacgaagtagaacagaaaaggcttgggcagagtcccaggcaggatgaaggactgcagtccaaactctatgattaagaaagtatgagacttgctatattagtcaattttcatgctgctgataaagatatacccaagactgggcaatttacaaaagaaagtggtttaattggacttaacagttccacatggctgggaaagcctcagaatcatggcaggaggcaaaaggcacttcttacatggcagcggcaagagaaaatgaggaagatgcaaaagcggaaatccctgataaacccattagacctcctgagacttactcactactgtgagaacagtatgggggaaactgcccccatgattcaaattatctcccaccaggtccctcccacaacacatgggaattacaggagtacaaatcaagatgagatttgggtgggcacacagagccaaacaatatcacttgcttatgtcacattatctttctaagccttatttatcttgtttagcaaatgacataacatgatctgcaaaagcaaatgaaaacgctgtagtgtcccattatcataagctgtgatgactaacaattacatggaacttagagtcaatttgttttctgacacactaaaagtcctcagggttgaagaaagcaacagcatctgccatttcattttctgagaggcatcccacataaagcaaacaatgtcagtcacctgccatctctctaaagacccagtgtttgtaagccatgaggccccagggttaggggctctctttaaggcctctcagactctttaaggactttcaagcctaagcatttttacccagcagcatctcagaagcctctatctaatactagaaataagacagaagctatataagcccgggaggttgaggctgcagtgagccgtgattgcaccacttcactccagcctgggtgacacagcaagaccctgtctcaaaaaacaaaaaacaaaaaacaaacaaaaaacaaacaaaataaaggaagataaagtttctttacaaaaagaggcagagaagacttcatagagatatttgctattcaagtgagaatgctcagatcttctcatgagcacaaatccattatcaaaataactaagaatctaagaatgaggaaacaccactgacctcagtgacaagtcattaaacttcaaataaatactcatgatgctttgcagatatcattgttgtggccaataacaaataaaatttaacccagcagctttaatgtcacagcccttctattttttaagtgggtatttctacaaacatatccattaaaccccgagtttgcctcaaaattttaaaacacaattttaaaacatttactaccatcactgagttgttcctttccaacctggtatccattagggacccttttgtttggtttggcacagacagcccattctatacatactgattaagattttactataagaacatttcttacaggcaatccagtatatatgaccaaatttgtatattttatgttgccatattccctgaatatttaaatgaaaagcctcaacaaaaagaggatttgaaaaaatgtcaatatgctaaatttagctgatcttaaaaacaagcctatcttagaacattctctcaggtaaatcatgcataattcatagatttttcccaaaacattatatacacatccatgcatctcaaatcattaaaaaataaattagtttgaaagtgacaatagtcaaataccatcctgggatagaaaagttacagagatagcaaatgtcttacattacaaaggatgtacctttgctatccccagagcagtattttacgcagacactgctgtataaaaaagtcattagttgttttattacatcgttctgtttatttatttttaataaaaatggtgtaaatcattaaattattctgaatttgaaaggcaattcccactcctgctggaagctagctgaggactggatggccctgctgttcctgcttgcgtgaactatccctcctggtgaattatacaactagttaatatacaaaagaaaataggcaactcccatttggcatgtcattcttttatgcccgagagctcacttcacatgcaacaaatctccacagcagtactgaaagggcctaatgaaggaacacagtgatttaggtcagcccagaaaggctttgctttcttcagtgaagagtgtcttgacagaaagcattttctccgatgtaacattacagcttggaatctgccaaaacaacagtcggcacccaacaccgacacctctacgttcactaaatagacgtttttatttacttaatccaaaaccagagtggtccaaagcagttagataaagttgagtattttcctcttttgcaattgtaattgaaattctgttggttgaataaaaactggaacttgcctttctgaggaatgaattcatgccacagaacttgttcagaatttggaatgcattttccatatgatgatggcaggtgctttctcacgtgtgagagggcgacactcctaggtaagtctggccacgatcaaatctctgtattttcttggcatgcagcccttgtttagtggcctccttggccagctgcaccgaggaagcagggactgctctctggggagcagggtgaagacatccagctctgagccctccagggcctatttataatagaaaaacagcctctgttcccttttcaatgcaaagtactttctcatatcaccttaaaacttatttatactgcaggtcatgcacaatggctcacacctgtaatcccagcactttgggaggccgggcgagcagatcacttgaggtcaagagttcaagaccagcctgtccaacgtagtgaaaccctgtatctactaaaaatgcaaaaaattagccaggtgtggtggtatgcgcctgtaattccagctactcgggaggctgaggcaggagaatcgcttgatcccagaaagcagaggttgcggtgagccgagattgtgccactgcactccaccctgggcaatagagcgagactcagtctcaaaaacaaacaaacaaataaaaaaacaaaacatatatacatatatatatatacccactgaacaataaaattttcctacatttgggaagaaaagtaggtttcataaaggaaattttaatgaaacaaccatttataaagaccaatagcatactgttttccactaatattttttcatgattgagatcttaaagtttttctatagaaaataacccagtaattttacattttaattatgtccccttttatatgttttctttgtgtctgcctaatttaatattacttttttttttcttatcaggcctggaagctaccactctttggtattacttactaattgtgtttgtagcacttactgagatacattagctcaaattgaaatggcaacatgaaatgcaattatgcctacttatagacattctagatgtacatgtaccatattgccttaaagtgcagtttgttttacctgctagaaaaactgtgaaacaggaacacagacatgtacacagaactgtacagaatacaaaaaaaaatgtctacagtgttttcctttctcacagttttcatgtgatttagacattaaatgtcttatatgtaaattctgcaactgtagaaaatgtagataattaaaagggaataggaaatcagaatctaagccatcatttaggttctctatattgttcatggactattaataatacatgtatacgactaaagagatcatactaataaagcccatggtctggggagagtaagggactagtactcaccccagaccactctaaagaccaccatctcattcttgtattaagactccaaattggcatccctgcacctgagtctaaccagccccccatgatacgtgatctacagctttgtatagaaaaaaggacacaattctagtgagcactgtttcttgaaaactgcacttcacataaagagattttaatttttaataatttaaaagtaatggagattacactgaaaatgatgatgtctcaatgaaaataagcctcagctaatacaactcacatggagttgtatacaatggagagttatttgaagcacaacaccttatatttatgctgtgttagtgaaatagcacagaaaggttgatgaaaagtgttcactgcatgccaataagccaaacatcacaggaagtgtgtaaatggattaggattcttagacgaatctatctagcacagcaatatgtaacaaattaaagtggaagaatgaaaatgttactatcatcactttccttacagcttctccttactaaaaatgggttgtgtcatttcttattacaacaaaagattttcttgatggggatctgctaatatggtcatgggaggggtggaaatcaagcattaactatggaatttagcacaaagtatacctttactcacaaaaggggggaaaacattttagcatgaagattgcttggtgcttatgttgcactgctaactgcatattctagaaataattaatgctagtctcaattaccagcatgcaactcacattttcagctaaatcaataactgaaataacaacaagggagaattccccttatattatgaataggttctcagccttatttaagcatcagaatacctgggagtcacaatgttctttgcagttattgttatacctagtgtccgtcataggtgttactaattttgtcatgcataagtggcaacaatgttattacaaaaatcaaaattatgagcatgcacatccacaaaagcagtaagcaactgatctaagtatgactggctgcctctatgctgtactgtgatattcgtgtgtgctatctgcttgcttgctaattcctagctacactttattaacaaaggtaggtttaaaaacaattataggataaaaactttaaatttggaatatattatccatttacttatttttcctgaaaaatgagaaaacattgcaattattcaattatagtgataaaagatcagtctagcatacggtgctatgcacaacagtactaactgttggtcagacgtaatctttgccttcgaggtatttccagtctgttagggctggcacaaatcctaaacttttaaatatgtttctcatatagagcacagtagcactgacatgggctacttggctcactaaccattgaagatgaagaatgcttctcagggaaaattatacctgaagcagttattaaaacgagagcctgaaaggaaaggtggaaattatatccttggcagaggaagcagcatgaccaaggcaaggagacaaaaaaaggcattccagctgggcgtggtagctcatgcctataagcccagcactttgggaggtcgaggcaggcagatcacttgaggtgaggagttctagaccagcctggccaacatggtaaaacttcacctctactaaaaatacaaaaactagccaggcatggtggtgggtgcatgtaatcccaggtactccggaggctgaggtgggagagtcacttgaacccaggagggagaggttgcagtgagctaacaccactgcactccagcctgggcaacagagtgagattctgaagaaaagaaaagaaaagaaaagagggaaagaaagagagaaagaaggaaagagagagagaaagagaaggaagagagagacagagaaagaaggaaggaaaaaggcataccatgggcgggaagccaagtgatagcttttcatgactggactgtcaaagttcaagacgagtgactggagaaggtaactggacataaaccagacttagaggatggaatagcaattatgaattgggagacaaggcaaatgttgacaattttaggcatcaggtagtaaaactgtcctcattcttttgaaaattaacctcgctgggcacagtggctcatgcctgtaatcccagcactttgggaggctgaggcaggtggaccacttgaagtcaggagctcgagaccagcctggctaacatggtgaaaccccatctctactaaaaatacaaaaaatatggtgatgcgtgcctgtagtcccagctacgtgggaggctgaggcaggagaatcccttgaacctgtgaggtggaggttgcagtaagccaagattgcaccactgcactctagcttgggcgacacagcgagactccatctcaaaaaaaaagaaaaagaaaaagaaaattaacctaaaaactaaaataccaggaagaacaattgtgtttataataattccccaaactaattataaattttgcagtagacaaaaaaatataaaatatgaaaatagtaagtaaaatagggaaacatttcttaagactaatttcttctctttcaaaccctcttggttggttagtttttaccttccatcttgttgaaattgactttttttttttctgaaaaagtaaactgaatcaaattcaggctaagcttaatgctaccaatttattttcaaagacagataataaggtcacgtagggcagttgtggggaaaggttagaaaaagtgagtcgccctgtatgataaatgacaggctcaatgcatccgttccttccagaaaccctcaacacaactggctagcttttaatgtaatcagaagatatccacatggtctttctctctgtcctcttctcctcacttggtgattttaagaagcaaaagtctggccgtgatggctcaagtttccttgaacacagcacaaaaagataaatgccagtattgcacaggaggagaatatacagaacaagagttctcagttctggccaggcatggtggttcatgcctataatcccagcactttgggaggccaagatgggaggatcacttaagcccaggagtatgagaccagcctgggcagcagagtgagacccatctctataaaagaaaaaacaaaaacttttcagtcctgatgactaaaaccatcaaaaatgagactatattttagactaaaattagactaaaactataatttttctttaattaaatctattcatgtagtataagtggttaatagaaagtatttctgatttgtaatattatattgcagacattagattgatgtttaaaattgcaaaattgcaagagtgatatacaaaaaaaaggaattattctagacaactagagactctcctatatttaaaatttaaaagcatggtattgaatatcctatttaggaggcctttgacaactatttttactttttttttttttttgagatggagtttcactcttgtcacccagactggagtgcaatggtgtaatctcggatcactgcaacctccacctcccaggttaaagtgattctcctgtctcagcctcctgagtacctgggattacaagcatgcactaccacgcccagctaatttttgtatttttagtagaaacgggatttcaccatgttggccaggctggtcttgaactcctgacctcaggtgatccgcctgcctcagccttccagagtggtgggattataggcatgagccaccgcacctggtgacaacttattgttacttctaatggtttgggagaattcaaattatattagtaagtattttagaaataaaaagccatatagtcatgttaatatgctcataaaatcagaagaaatataaagttgataatcaagaaagggtatataagtattggtagatgtaagtgttggtaatataagtattggcaaagtattggtaagtattggtaaaactaatttctaacttcaatgttaagaaaagcaacagtctttgaaatgagttggttatcgggtacattgtagattctggttttacttattcaaatttttttttttacttgaatcagctttctcttcctatcccccatctctaattatgtctaaatgttcttttctgttcatggagttattaaacaaataaacaaactctctgggagcccttgaccctaggggataaagaagactgagttcttctttcttcctgaaaagtactagaaagttcctaaaggagctatgtctgtactactaataggctagggccgcatgtgactgtcaaaaagggtctctataagaggagtcccaggaacgccctgaagtatcaattaaaatgcagctgtttggtaccacttgttcctgcggaaacttagcagtggagggtgtttcttaccccagtaagctgcttctttgcgctaatgcagcgattgctgtgcctgagggcagccctccctcccagtcgccagttccgtctttgcactgcatgttctctctgatccttctctgatccttccctccttcacagctgatgactgaattcatctttgacgtgtggtccctcaactcaatgtaatcttgcatgaaagttcaatatctgccatctggccaggtgtccacttatcccactacccttgaactcccagctccttctccctaactcctctgctgagtgccttgctgtggccccagatgttgcaccatacacatctgcacacctatccaatgaagcagattaagtcccacccacttccactggacagaacagtagtctcttacatcagacttagctagattcctgtatcactactcggttatattatattatttgaaaacatttctggccaggtgtggtggctcacgccagtaatcccagcactttgggaggccgaggtgggcggatcacttgaggtcaggagttcaagaccaggctggccaacatggtgaaacactgtctctactaaaaatacaaaaattagctgagcatggtggtgcagcctataatcccagctactcaggaggctactcaggaggttgtggcatgagaatcacttgagttcgggaggtggagcttgcagtgagccgagatggcgccactgcactccagccggggcaacagagcgagactctaccatgaaaaaaaaaaaaaagaaagaaaagaaaagaaaaaagaaacatttcttattgaaacattcctcacttgcattcagtgaatgacatttatttgatgcctactatatagctggaattctgctgagcatagtagttaaagaaattgctcagatatacacttgcccttgaggagtaagcaaggcagtgactatctaaaaagtgaggcagaagtgtaaataaatggataaaagagaatgtcctatggtggaaatgcagtgaaaacaggaggtaattcctccttaatggcaaggttaaggatggaggggatgccaaggaggctctcaagaatacagatatcttcctggcttacatcaacagtttatacaaattgctgcattttagactcttgtggggagctttaaaactcttgatgtccaagctgcatcccaaagcagttaaatcagaatctctcggggtggggtgggggagggctggggtagaacccaggcattttttttttttttttgagacggagtcccgctctgtcgcccaggctggagtgcagtgacacaatctcggctcactgcaaggtctgtctcccgggttcaagccattctcttgcctcagccgccggagtagctgggactacaggcacccgccaccaggcccgactaatttgtttttttttttgtatttttagtagagacggggtttcaccacgttagccaggatggtctcgatctcctgaccttgtgatctgcccacttcggcctcccaaagtgctgggattacaggcgtgagcgactgcgcccggccaatatatttttttaattccctaaattaaaaattattccatcgagcagcaaagcctgagaaccagtgaactagatcattgcgtccttgataaaataatcttacactaatcttagttcaagagcctggcaagcaccatgcctactacatgttcttatgtgattttggcattgaatttaaaaaactgaatgaaggaatcattctggtaaactaaaatggacaaaaaaactgggttttatgttatctcaaaaattgtctacatcatatattatattaaccaacaatcttttagactttaatagtagaagctgtagttatgaatagatttatgtataccatgaaaaaaatgtacggtagttattctttcctcaattgtcattttaaacagagccatttatttattaatacacttagctggatgctataagtgaatacaattagtaaaagtgataaaactaagtttatgcacaactgtgaaaaatgtgtggtagttgttttaaaaacttgttttcataggtcaagagcttacaatgcattctccatgaaacagactattcattagtttgagaagataaaacaacacatttatggaacactcacatggtgagctaatcagttaacagtcttactacataaaaattacaagaattttcattaacaaaataatagaaaattaaaatgtaacattaatataagcacttatcattacattaagtagttctatatacacacacagacatccacacttatgtacacacaaatgcatacatttacctcactgctatttataattatttaacagtaggttagcatatttattgatatattttttgagacagaatctcaactgctgcccaggttggagtgctgtggcgcaatctcggctcactgcaacctctgcctcccaggttcaagtgattctcgtgcctcagcctcctgagttagctggtattacgggcgggtgccaccacgtatggctaatttttgtttttgtagtagagacagggttttaccatgttggccaggctggtctcgaactcctgacctcaagtgatccgcccaccttgggataccaaactgctgagactgcaggagggagccacaatacccggccagcaaatttaaataatgagaagcaaatagtcctctaatagtaactattgcatttagcatgtttcattctaactctaaactcacaagacatagacatgtaagtttagtaccctagaaaacacagctacataatttgaattattcacaacacttcatcacaacaaagaaattactaaatttgccatgtatgtgtatactacacatggagtagtttcacaaagcaccattgttacttacgttatttcatgttttaaattctgccttcatagcatggactttcagctatgcctcatttaaaacttactggctcgggggctcatgcctttaatcctagcactttaggaaaatataaaaattaaccaggtgtggtgacgcatgcctgtagtcccagctacttgggaggctgaggcaggagaatcgcttgaacccgggaggcggaagttgcagtgaaccgagatcgcaccattgcactccagcctgggcaacaagagcgaaactccgtctcaaaaaacaaacaaacaaaaacctactggcaataagggagggtcagtatttacgaagtgactcatttaaaatacggaataacttaaactagtacaagagtaggcatgctgtcggagtacagatgccagcgaattaaggctctgtgctgccttccatgttccaaaggtagcttgagcgctagtgtgtcaaatcaattgagcattcagggctctgggccagttactagtattagcctatgagggctcttggatagctttattttgggctttgtgtggtcaggaggtgccccagccacaaacactttgagaaacaggccctattcttaggtgatgcttagatgaagtgataatgtattattaatagttttgatattaacatatgtgagattttgtatgtgtgtgtatgcataaacatagttcagactgatataatactgacttctttctgaggccatggaattataaataaagaggcccacatgaaacaaacccatctcatttattctatttcccactgaataaatggcacttagtccaaatgcatttatttttaatatatctgatgcttaacccatgaccaaatggactcaggaaataaactgtcttccttgggtaagaagaagagatcctatgttttaaaggattttacattgtttttgctgtaatttcatatatgaaggaaatctaaaaactattcatgatttagattcattcatgattcacaaattgcattctgtgaatcaataaaataattgaagatatcaaaatatattcactcatgttaaaaaatacggctgatggttgagcacagtggctcatgcctgtaatcccaatgctttggaaggccaaggcaggaggactgcttgagaccaggagtttgagaccagcctggacaacatagtgagaccctcatctctacaaaaatatatatatatttttaaatatggcttagtgtggaagaacacatttttggatttgcaaatcagttaatgaaagccactgatcatttaccttccaaagaagaatcagacatttctaagacatctacactatggtacacttcactggctactattttagtttaaaaaattaacataaatttcattttattagctgatgtttttagtataagaaccagttgcactaaaaatcagtagcacttataatgaactctaagcattgtaaatggtgacttgacataatttagcattgagatgaattcagggaaacatttttcttttgctgtttgtttgtagcatctcagatctcccctcccaactcctctctgtccaccagttccctcttgcccaagtgctgctattctcttggtcactcataatcatttagcctgtgaaatttattctctatttacaactggctgctacatcactacttctgaacctcttgccaaatattattacaaaccaatgaatttacaaaatctgttcaaacacaaagatgggcaagagagactgtattgtcttacaattgcctctgtgttccttaagatttagtgtattttcttccctgggcacaaatttggtatttacttcactatttcaagtaattacttacttggttttgtcattcaaatttttaaatggaaagaaaatgtctaaggcccttagtttaaaaaaaaaaagattaagagtgtcagaattattctgatccaatgactttcgctaagcaaatctttttaaaacagctcaaatagtatgagcattttacaaatgagctttaaacatccttaatctaaattgttcttaacttctgaatacctagaaaactactatttgcagcttaaatataaacattcatgccagactaatgcagaaaaatctagggcaaatccatgattaatatttttttccagtttgcaatatccagctctatttaagaaagggccttaatgaatgctgctgtaataatttaaatagaaaattgatttcatttttgcattctcactgtcatttcaatcagaattgtcactatcactcacatcttctattcatcattttgatttctatctacactcatttcacaaatgaaaaatacatcattaaactcatcacattttccaaaactataagcaagcacatgaaatcctctcttctttgtaaagaactgccaacatgagagggcagactctagctagtaaagcaaaggatggatggttcaaatttatccttgtaagttatggctgcatttaaatttaattgtctataaactaaagggtgcttttctccctctggataaccttaaatatttcaccatggcttattcaaactactgtgaaaacttaaacatatattcctcatgattacatccattttggtctttagaagaaaaactagcagagcttaaatgtattataaccccttcttggacacacgatgttaaaaaactcagtttgttggaaaaaacatattactattctatacacacacaaactccatatagtaattccatatatttacattataagcatattatatatgtgtgtatgtgtataacgtacatatatataatgtatgtattatatgtatttatagtgtatatttatagttttgtcaaccaaatacttactgtttaaggaatatggtttaagcacaaaatattatatggttcaaattgttaaaaaatcacagcttacttaataaaagattaagaaaacctaagcaaattgatcataaatattaggggcaagtaagcatgaatagaattttaatttaacatctttattttgactcagtattattgttttcaaatcataggaggtttgacgcaatggaatatcaaactaagaaacacttagtgagattacttataaagatgtaactcactttttattcgatgtccccagttaatgcttattatcctcaacctgatagttttctttgagtaagaattatttagtgctagaatattaatacttgtatgatcaattacaattttattttattttgtttttttgagacaagctctggctctatcacccaggctagagtgtagtggggcaatctctgctgactgcaacctctgcctcccaggctcaagccatcctccaaactcagcctcccaagtagctgggactacaggctcagacaaccatgcccggctaatttttgtattttttgtagagatggggttttgccatggtgcccaggctggtctcgaacttgtgagcttcagtgattcgcccgcctcggcctcccaaagtgctgggattagtggcgtgagccactgcacccagccttacaatttgattttgatgacactagtcaacagtaaacacaacaatggctattggtctataccatcatgataaagcagattaaagaatatttggcttttgtttgctttgttaaactgtttctaataaagtgagcaagttttgttttaagtcacccattccaatgaatttgctacgtaggctgctggtcagcacaaaccatgatggggcaggtgaacaccttactccaagagctattaggtgagacacacctaacaacatcactgggtttttctcccatgctctaaagtctttctaacactaaccagaagtactacatctgttacacaataaatagtcctctgtcctataacactgtgagtcagatgaactgatcagaaaaaaaaaaaaaatcaatgtttacagagttataacttcagactaaacaacaacaaaaagaaggcatttcagttggaccatagagccttgaaaaatgtaaatgatttaccttcaaccctgaccattccagcaaataaccccaatcaactcttgctcctcaaattttccttcctcttctattttctgttgattctattaccagcatcgaaaccttggagtcatggctcatgccttcctgatacagtcacatccaagaagctctaaagcccaatggctcaactgtgttccctcctctccatttctgctgttacctaagttgagtgcttataaagtgatcagaggagcaatttagaattcatcaaattaggaatgactcttgatgacgaaattacagatgaggcagtgggaattcacaggagagtgggaattcacaggacagtgggagtcaagggagaccaaggacaaggagatgagttcatggcttgttgtttagatattagatgtgacgagctgaaagtctcaatggaagcgatggaaagtagaaatagtataaaagaaaccaagaaagaaaaactccattgggctaggtacagtggctcatgcctataatcccagctctttgggaggccgaagtgggtggatcacctgaggtcaggagtttctgagaccagcctggccaacatggtgaaactccgtctctactaaaaatacaaaaattagctgggtgtggtggcgcacacctgtaatcccagctacttgggaggctgaggcatgagaatcacttaaacccagaggcagaggttgcagtgagctgagatcgcaccactgtattccagcctgggtgacagagtaagactgtctcaaaaagaaaaaagaaaaaatccattggttattacaacagatttgtttatggggtcaaaaaatctatgaagtttggctgggcatagtggctcatgcgtataatcccagcacttcgggaggctgaggtgggaggattgcttcaggctaggagttcaagaccagcctgggcaacatagcaccaccccatctctaaaaagaaattatgtttaaaaaacaaaaaattatgaggatcaaaactataaggataaagaaaaggaagagtaaggatagtgtgagtgtgaataagcacaacggctagatttcaaagcaaatccagaatacgggctttgctggtgaccttggagaagttacttaacctttctgtgcccccgttataactcagatgtttaaaaaaaaagaaatggggttaacaaccctatatcctatggttcttttgaggattaaatgaaaaacaaatatgcttatgaagtactaaaatcacattattagtgaatttaaaaatcttttagccctaaaatttgattttctgtgtaggagctattgtaaccctggatatttttaatcaacatattttatgctacaatatacctaaggcgtcctgcttcaggatgaccacatccaataaatattcaacaagcatctgggattgcacttttaataaacgtctctgtgttgaaagagaattcttatcatttggaggagtcattttatttatttattggccttggaattacttcagactgttgataattctgattttggtaatagtcttgggtgagaaaattgttcaaggactaagagtgacctgtcatggtaacaacagtctgtgaattctataaaatataatgcatggaccttggtttggagaagagcaatttactttagggtgtattcatccataattctcttctcttgagcaactttcatttttatgtgaattctttacaaagtcaaaaacaactgatgcattgtcttagctacatacaattcatttaccagcacctaaactatggaactgcagtgacttaaagggctagcttaggaagactaactagtttgaggtaagtttgcaaactaaaacaacccactttttgatactacatcaaaaactgctttccaaatttttagtagaacttctcttttaagcagacagtataatcattttatgaaggtttttgtgtcctctaaaaagaattcttgtgttccaaactctcccaaggttataagactgaagtcaaaactatgtgatgtatactggccccatgtacacttttccatgtgaaatatcactgattcttcaaaatggaggttaaaatgtaagtgactgatctttcctcagagaattccagaaacaaatatgctttcctactctccaaagacaggaagatgagcaaagtgagaaataaaatgtcaactacttcgatcaaggatgacacctgagtgggaggccccagcccacacctgggctccaagcgccagttagtcctgcttagtcctagctctgcccctttctagctctgtgaccctgaggaactccctccaccaagaccactctgaccctctgtgtgtgtgtatttgttctctctgtaaaagaggaacaataacctcttgccaggtgctctctgacttcatctccagctgctgtcccctgggttcagctcactccagactcacgggccttcctgctgcccggtcctcccacccaacctcccctgagcctgaagggcctctgtacttctttcctccccctgaaatgctgggcccaggctggccacatcgctcactccctcagagaggccaggcttgatccaaatcccacctgccccgtgaggcgtggcctcatctaaagtcagaaattggctccatctcctcgactccctcccacaattccaatttcccattctgccttacatttctccttagcacttatggccaatacactatttaacgactgtgtgttctcttccttccttaattaaatgcagccccacgagtcagagattttggccaattttgttcacttcatatttttaggatccagtatagtgtctggcatgtagtaatgcttaaaaaaatctgtggaataaataaatgaatgactcttctccacaaggttgtcaaatgaatgagatgtcatcggttaaatcgctaagctgtaaaacatatgattcactatttatttttaaattgttaatttattattattctttggagacagggtctcactccattgcccaggctggagtgcaatggtgcaatcacggcccactgcagccccgacctcccaggctcaggtgattctcccacctctcagcttcagactacaggtgcaaaaccacacccagctaatttttatatttcttgtaaagctggggtttcactatgttgcctaggttggtcaaaatttctgaggctcaagcgatccgcctgccttggcctcccaaagtgcagggattacaggcatgagccactgcacccagccttttaatttattttaacattctgttcatgaaataaaatgtagatgacaaactatcggagtcaaggtaaaaataattaaatagaaattagttataagaactataatgcagaacctccacaaggctaagggaaaaaaaaaaacaactactacaaaatacttggtatcattagaagtaaaaaaaaaaaaaaatcagaaaacagtcaaaagcttaaaaatgaaccaaaggtggccgggcacggtgggtcacgcctgtaatcccagcactttgggaggccgaggcgggcagatcatgaggtcagaagttcaactccagcctggccaacatagtaaaaacccatctctactaaaaatacaaaaactagccgggcctggtggcgcatgcctgcagtcccagctactcaggaggctgaggcaggagaatcatttgaacccgggaggcggaggttgcagtgagccgagatcgcgctttaaaaaaaaaaaaaagtactgaaggtttgtggattaaaccagagctgtgacctctggaccaaagtaataaaagtccagcccatagcctggtagaagatagctagatggaagaaaaagaaaagctgcataagagaataacaacaggcccagagaggcctggagacagaggaaaacacagaggattagattttcagaagctgtggacttaagcaataaaaagtctatcaaagtgtaccttgttgatgtatggcacgtggctaataattcctaggttagccctttaagacacattgaaagatgggtcactccctaagtatgacatgatgaaatgaaactgtgtagaccatcaagcaccaggggaaaataacctgtgtgaggcttgagcttttctaagagagaaaacaagataaaaaaataaaaacaaagcccacaacacaaataaacaggatttactctacaaaacaaagctcacatttgcatatactaaggcttgttctctgcttaatcgaaggtaggaggagccagggtgattggctctctccctgagaacttgaactttgcttcagagggcagtttctagcaaggatgagcactgtttctgatctgaaaccgggataaaacataactgagtatccacagctcagagcaagaccgacaagcaagacgcatagttacagtgagtgtatgatagagctaatctgcattttaaattcgcacataacagtcttcgaaggtatgcaaaaaccgttttcaccaacaggaaaatccaaaataagtacattcgaggatttttttttccacaaaataaaatagttacaaaggttgaataaaaaattatctaagtgaaaatcacttcatactgggaatataaatctctggttctttggtaaataaaattaacaagaattattcaactagaactatcagcatataggtttctaggtttctagatgaacagtttactaactgggtcacgtataaaggtcaaaccagtttcttcgttacgactggttaaaactgatcgaataaaaaacaaatctgctatcagctgataaatactaactttaacaaaggctcagtacatgtagacatggtccatgtgtgttttaatttttaaaaggagtgaggagggaataggagaaagcaatatagctctcatcagcactttcttcccatcaggcgctttacatacagtcgctccttttaatctcatatccaccctgggaaggagaattaggacattacagttaagccacctgcccaaggccacattaacaagtgacaatggctggttctgctggatccagcctgggcctccttccaccaccaatctcagaggcatggcccaaagagacagctcagtcttcaggaacaatcaactgaatttaatatttactcagggccaggtgtggtggctcatgattgtaatcccagcactttgggaggtcgggggagggcgggggggcgggaggggtgcggggcggcgggtcacctgaggtcaggacttcaagaccagcctggctaacacggtgaaaccctgtttctactaaaaatacaaaaaattagccaggcgtggtggtgggtgcctgtaatcccagctacttgggaggctgaggcaggagaatcgcttgaacccgggaggtggaggttgcagtgagccgagattgtacctctgcactccagcctgggtgaagtgaaactccgtctcaaaagaaaaaaaaaaaaatttactcagataaaccaaacaggaagtacaaggcaggactcaagacaagttataatagaagagcaaagatcagtaagaaataaatataaataatagttacataatttacagaaaatagtcattaaactgcattcaagccaagatataaattacttagaagattctattcacaaaatattttaacttctccttgaaggttagtattgtcttatttagtgtaaatttaaagtatcatgtacgcaacaccacagaaaagatactgtctggaagctaagacattactaattaaatgcaaagagttgatatgaaaaggaagtaaaataacctagaagatggggcacggtggcaaggctgaggcagtcagattgattctacgagtcctgaagtttgaggttacagtgaactatgatcccacagcgccactgaactccagcctggatgacagagtgagatcctgtctctaattaaaacaaaacaaaacaaaacaaaacaaaaacctagaagagagtaacagcaccatactcagctttctcagctttttacttatttattttttttggagacggagtcttgatgtgtcgcccaggctggagtgcagtggcgtgatctcggctcactgcaacctccacctcctgggttcaagcaattctagtgccttagcctcccaagaagctggactgtcatgcaccatcacaccgagctaatttttgtattttcagtagagatggggtttcaccatgttggcctggctggtctcgaattcctgtcctcaagcaatctgcccacctcggtctcctcaagtgttgggattactggcatgagccactgtgccggtccatacttagctttttttagtgatacatttatactgattagtttaattctaacttgatgggaaaaaaattagtagttgggaatgaatgtataaaaatacttcattcaatagttacaattattcattacatttaaaatatccttacacctgaagggaactagaaaagcatgcctatatattctaaatttctttttctcctccacactctccaaattcccctgccaaaacagaatattgatattacaatggaaaattataaagacgatatactatgaaagttcttaatattcattcattctgagtttcttaaaatgtatagaaagatggcccaaacacctctgtgttctgcagcaggcaggtctatgcaacccacccgccaagttcgaggaagctgagctgacccatccagtctctcgaaaagaaacatttaatagggacttacggacagaagccatgtctcaggcagcagtgaggccagatagtggattcctgtgctgctacccaccacacccagggcttatataccctaggaaaggaatgtgtaggacaactgaagtccatccctagggaaaggcaagaatgctacatcaacctatgtaagggcagggtttatggtcaaggttgttttgacctaaggccaggatttatagcaacagtagataaagtaaaaatcttaagctgggcgtggtggctcatgcctgtaatcccagcactttgggaggccgaggcaggcagatcacccgaggtcgggagttcaagaccatccttaccaacatggagaaacccccgtctctactacaaatacaaaattagccgggcgtgatggcacatgtctgtaatcccagctactcaggaggctgaggtgggagaattgcttgaacctgggaggtggaggttgcagtgagccaagatcacgccattgcactccagcctgggcaacaagagcgaaactaactcagtctcaataaaaaaaaaaaaaaaaagtaaaaaagtagaggcattcccaggagttaattattagttaacatgattagcatccaagatggatttgcctggaaatggaagtgggatggggcggagaattatcttcatttgtatcacttgaggaatagctgagtgaaaacttgctgtaggcagctgggtactcaggttagactttgaagactcacttaggggctagatttagagaactgccgcttaatggctcatagtcagaagtcaaagccacattgaaattaaacagactgccataaaacagtgtggcctagttgaaagacaaagaatctgaagtgagaagttccgggttaaagtccgagacccaccattaccagccatttccttgggtgaatatttaaatctccagtctcagtttcctcgtctgcagaatgaagaacacagtctgcctccctgggagcagaaatacatctaccacttagggttgctgtgagaatgcagtgagaaaagcactggaaagcgtcttatgaagtccaagtcatgcatgagggatcgctattagcagcatgtttaatggaatatatgttctcaattcaaatgacagagactcgcatcctaaaatttaaagaaaagtaagttaaaaagtataagcctggcgcagtggctcacgcccataatcctggtactttgggaagccgaggtgggtggaatgcctgagctcaggaatttgagaccagcctgtgcaacatggtgaaaccctgtctctactaaaatacaaataattagcagggcatggccgcgtgtgcctgtggtcccagttacttggtagcctgaggcaggagaattgcttgaacccgggaggcggagattgcagtaaaccaagatcacaccactgcactccggcctgggtaacagagcaagactccatctccaaaaaaaaaaaaaaaaaaaaatgtacaggccaggcgtggtggttcacgcctgtaatcccagcactttgggaaaccgaggtgggtggatcacctgaggtcagtagtttcagagcagcctggccaaaccccatctctactaaacatacaaaaattagctgggggtggtggtacatgcctgtaatcccagctactcgggaggctgaggcaggagaatctcttgtgtaaccgtcaaggggttcaccttgctcgctgcctagacagagccgattcatcacaacaggggaattgcggaattgcaatagagaaagagtaattcacgcagagccggctgtgcgggagacctgagttttataattactcaaatcagtctccccaagcattcagggagcagagtgtttaaggataacttggtgggtggggggaagccagtgagccaggagtgctgattggccagagatgaaatcataggacccggagctgtcttcctgcattcagtcagttcctaggtgggagcacaagatcagataagccagttaatccatctgggtggggccagctgatccatcaagtgcagggtctgcaaatatctcaagcactgatcttagaggcagtttagggagggtcagaatcttgtaggctccagctgcatgactcctaaaccgtaatttctaatcttgtcgctaatggtagtcctacaaaggcaatctagtccccaggcaagaaggaggtctgctttgggaaagggatgttacaatcttgataaactgtctaagtcataattttgcaaaggtggtttcacttgaacccaggaggcagaggctgcagtgagccgagattgtgccactgcactccagtctgggcaacacagccagactctgactccaaaaaaaaaaaaaaaaaatgtaacaaaacttactttatctacatttggccacagtgttgtaaaccttctaacattctttacaacagcacctaaggcaacgacaggttcttagcgtcaaccacatcttcactttggcctacagcaaaatatatttcccctatttacccaaatggaagaagtttcccctgaattgtgtttttaaggtatctccccccaactcctctctccagatagcacaaatccaagtatgtccctagactcccaagagctgcttttatggactataaaactagcaacctagctttccacaaacatctttactgctattagtgaaaatatgcacttatgatatatgcacgcacacaagcatattcctgtcaccttacagagctaagtctacatcacggagacgtgagcacacatctcatagtgcacatcgttacacatccccccaggggctgacaggcaggggcttggttttatctttgcttcatctcttgcactttaagagtcccttgggtagtatcttttttgtgctcaggtttgatatttcttactcagtctttatgatgtctgactgaaagctcaatggctcaagatgtcctcgagggtgctaatgtttttatctctgtgtcctagcaccctgcccactctgttccctacaaatgttgagtgaattaacttccgtctgaattaataagaaatgtaaaccacttgtgataaaaaataatctatctcttccacacaaaaggtcagtgtaaatctggattctgaacacagactagattgaacaaagatttcttatctgtatcggaagcaaaactgagtatggtgttttgtacaaggaacaaaggaaatagctacacctctcctactgtagacgtcactgaaaaagtctgtttctctccctggggggatactgtaaactcagtagccagcactcaatactgttgccagaagcaggaactggaagtcatcattctaagtcgcctttaataaagcagaaaagatgcaataatgtcttggcaatgtcagttcccaaacactgacaacctaaactacatcttctggccctaggtgcttatcggctgtactgacgtgcttcacattttataatgttggtaaaatgagggaaggcctgtggctctcaaattcttgtatctgcttagctaattccaacccattattgtaagcagcaacaacagaggaaggacagtctctcaagactgagcactcatgttttacccagttacaatgctattgttctctgggtgaatcagttttaaagtaaatacatttatggctgggcgcggtggctcacgcctataatcccagcactttgggaggccaaggtgggtgggtcagttgaggtcaggagttcgagaccagcatggctgacatagtgaaaccctgtctctactataaatacaaaaaaaagttagcagggcatggtggcaggggcctgtaatcccagctacttggggagctgagacaggagaattgtttgaacccaggaggtggaggttgcagtgagccaagatcgcaccactgcactcaagcctgggtgacacagtgagactccgtctcaaaaaaagacaaaaaatccatcttcaatagaggcaatgtggtgcattacaaaggggatgagtgaaaacaggctggcttcaaatgcgggttttacactttaccaactcagtgatcttgcccaaaatactttgtctgagcatgtattttctatcttataaaaagagatatatgccgagcacacacctgtaatcccaacactttgggaggccgaggcgggcggatcacctgaggtcaggagttcgagatcagcctggccaacatggtaaaaccccatctccactaaaaatacaaaaattagccaaacacagtggcacacatctgtaatcccagttacttgggaggctgaggctggagaatcacttgaacccaggaggcagaggttgcagtgagccgagattgcaccaatgcactctggactgggtgacagagccagactccatctcaaaaaaaaaaaaaaaaaagagatatgaaggaggattaataagacaaatgtacataaaatatttcacacaggcccacatcatgaaatcccagatgttagtcatacatcatctgcctaagtctttgaatatttggggcatgcaaaacaaaccaaaaaggagttgcctattgaagaaaaggcaaatgtcttgacatgatgttcagatcttatgtgattcttcgccatcttacgctagcaggttgatgtctttgtcttcccccacagctctactccagttgaaccggggtaggcgtactctctaagctacttcatgtctctccacttccagaagcttcttcctgctggtacctctgtccccatctctcaggactccatctgccatgaccctttcatgattccactgagaagttacttttctttttcccttctttgaacatcgaaagcatgctgtgcctctttacggtagttcttttacaacttggcacggtgctttgcaatgtaatcacttgattacaagtttcattttcttcattagaccgcacactccttgaagtttatatggctttattttttgcacagagtagttattcaatatacactgactgaatatattttaaaacttcagggagtaattaaatcagccaaagtaaatttagtctacacatacatttatagaatgtacaccatctccagcctcagacaactgcactcaagttgcccctttcccgagccactttctggctaattgctaaacatgtttccaccagatctgcccctccagctgcctgcagctccagtagaggctgtgtggagaagagccatgcagactgcatctgtaaggtcctgcctgtgcactttccgcttcccaaatgaggacagagagcactcctgccagctaccaggcagggcccaatttctaaactctgccttgaccccctgccttcccatcagaggagaagcatccttacctaagaacactacttcttcaatgaccagtcttccttccccagttctcttccttccccagtcctcttccatccccagtcctcttccatccccagtcctcttccatccccagtcctcttcctgggggtatgagaaaaaactcttaacaggtgctggctaaagggaagcccagggtctccaagatctatatctcaccagagtccttcacagcagtgccagtcggagttggctgtgttcatgttccccaagctatcacttgctcggtctttctgcagctcagaggggatggctggactaccaatcctaatgggttgggacctttctgcaaactccagtctccccatctgccctggtcctgccttgttagacagttctcagtttgagttcagataacttttagagtccctggttcctattataatacttaatattttgtccaatgtctttcttcatcatatatatgcatatatatgtacatatatacctgaaaatacacacatatataatgacctcatgcaagatcatctgtctctcagagtacccatttcctatatatgaatagatggtgtgtgtgtgtctatatatatataaatcaaatgactgttttgtatttatcccactcaatcatccatattcataaataataatatttctctagcattccagaatcaaagttaaaatatggcatgaggaccaggctcactgcctcatgcctgtaatcccagcactttgggaggccgaggtgggcagatctcttgagctcaggagtttgagaccagcctggcaacatggagaaactccctttttaccaaaaatagaaaaaattagccgggcacggtggtacatgcctataatcccagctactcaggagactgagtaggaggattgcttgagcctgggaggcagaggttgcaatgaaccaagatcgcaccactgcactccaacctgggtgacagaatgagaccctgtctcaaaaaaaaaaaaaaagaatttggtctgagcctggtcagcactggtctgatgtactgaaaaccatctcctaaacttctctctccaacaacaattaagtaccttatttacacatcaaactatagcaaaaacatcaatgacaagtacaacatctgactgttccatgaagatggtaggactgttcccaaagctttctgcttacaacttaaggccaaaccaaagagccgtggttctcctgcactaaaatggtttcagcctatttccagtcatgctgctttactaacaaactataatgaactactgtaaaacatgtgtgctatacttcactcagcaatgccttcactataagatgttgaaaatctgtgtttctggatgcataaaaatgacaagcagaaggtgttattttctattctaagggtccagaacaaaagaatgtgctttcattgtgactaaggaagtattctgcacagaccaatataatcttctactcacaatgtttccagttcctttgggtacctggtgtcattttagctctgagttatgtattaaggtcacctgctttaaaaaaaataaagacaacacatggaactcagtagagaaagtgaagtttcttgctgcatctccttcgagccatcttccctgcttgtctgtagggattccactgtgctatctcacctacctacctactcctctcattgccatcgatgctgtgataccggcaaacttctttatggctaggccttgctgtcagtgagtttccttaatgatgaaggtctctgctacctgagcagaaaagctcaagctcagcttggtccatgacattcatatgtggagtgtcatgagtttacttttaaagaactgcaagaaatatgaataaacacatttttttgaagcctatgttcaattacagcacttcaaagatgctgtaggaaaagctgaagtataacacagcatgcaaagatgcattgatttctttctccaaatcacatgtaacatatgtaagtctatacatatatgcatacatatatatgtacaccaaagtttaagaaatagatggttgttgaccaattgtatgtttttaaagagttttctaacaattatattagatattttataacttttaaaaatttacttcgaaaagattctcataaatctcccagagaaggcttagaaggctggcttcaaactccagttgcctgaactaggtacagagaaggctgagatgacagcagtttctagccctggctgcacatcacagtcacctggggagctttcaaaactattaaacagcaaaatatctgacacacagtagctaatcaatacacggaaatttctctgttttcccttccaccctatatccaatcccatatttcccaaaatgcctacagagcatactctgccatctcactagcacctcactccgtagcctaaagcttccaacaagtatcaccacatgttcccgcttctttgctcaggcccagtgagttgccaggggtttccgcatcacctatattttatgcctgtttcttcctcgtgttccctgtcacctggcataatggtcttgaactgtcttcccactttaggcccacagtttcctccctgcagcctgggggatctctccacagtgcacgtgtgatcgcatctttcccactgccacctcctccaaggcaatctgccggcagggatctccctgtctctgtacttctgtctccatgttcccctttctgggaccctatattgcaggcaaacagaatcagacagaatgtgtgaaatagatgactcctgcaatcttgtcctgtccctatttctacatcagcttcctgtagatgtttcctctttcccatctcctgttctctccaccagcagtgtccatctccatgtcaactgttcccttcccaaggcccttgtcacttatgtgtatgtgggatgctttaatatttataggaagacttgtgttggtgaaaacacaagtcatcaggttcattgtgggatttattcaagggcttgccttctctcttaagtctacatttgtggattctcttcttaaactacattaccccaaacacccagtggacagctacgacattattgttttgttttgatactggtataaatatagtcatcttctcaactgaatatatctcttccataaaaattcatgtaagagcaaaatataatttcaaaagtcaaagttggaaatacccaaatacctcggcgggtgcggtggctcacgcctgtaatcccagcactttgagaggccaaggcgggtggatcacttgaggtcaggagtttcagaccagcctggccaacatggtgaaaacctgctctaccaaaaatacaaaaattagctgacatgatggcacaggcctgtaatccaagctacaaaggagactgaggcaggagaatagcttgaacctgggatgaggaggttgcactgagctgagattgtgtcactgcactgcagcctgggtgacagagccaaactctgtctctaaataaataaataaaattaaaaaaaagaaaagaagtatctaaatacctaaaggcaacacaacttaaaaaaccatcattattcatcatactaaaattacatgtcttcatgaaaaacaagtggcagaaagtttggtgtgctatgtggtgcagaaattcatccagtagtcagtcctgcccagactgattccatgtttttgtattttctcatagctgaaaatattaaatccagacagaatctctgaggcaacgaccgcgtgtgggaagtcagcctatttaacttgagatcaaccgatctacagagtatgcacatggctctcttgtaaagaggtgagaaaagatttcaaaaagcactgtcgtcagcagaaaggacctttacagccagatgaagctctggttgttttcagccactttcctctgctggggaaaaggcacattaaaaagacacagctgtctatttcagtgtacacatgcttggtagcatgggtgttatttactgataaaaagcacatgacagcaattttaaaacagggcttgtcctgtcagtcaaattagagaggcaggatgtcctctccaagtgattaccgtgggggcccacaatgtggcggcctgccaggtcaattacagcagggctgtgaggacacatgaagaaggatcgccttaattctaaacaggagcatcagtaaaatagaaaccaggggacatattaacacaatgaacaataccttaagactgtggctttggctagagctgtaaaatgtatttatattgagtgtttctccatgtaaacattttttttttaattaacgagaatgaatgtataggaatacaattgcaaaataacatttgtatatttctggagaaaaacatttctcaaaggaaaattgggatgctataattttcatctcatcaagaaaattagacacatgggtaaattagcatttggaaacctgaccaatgatatttcataattgttcatgtccctgatatgtcaatttgccttccatttctcctatactaagattaatttcagtttcaaatgtccttgtcattttttctcctctctattgcacctacagcttctttgtctacaggaaaaaatattaagagatcagcagcatcagttggaggatttacatcatcgactatctgaataccagggacacattcctttgttttacactcatattccaggagtctcatggaaatgcattaaacatcagacaaaaaaatgtaggctgcttgaatcgcagcttaattgtttaggaactagatcctgatagtgccccaataacagaagaaaatccctattcacatctacgtagagaaaatactgggctgctgacactgaattttgcagctatgcgaaatttaatgctgattagtaaactctcaaattaaacagtgaaagattataaagacacatgcaaaagatgtaaattaaacccaaaatatcagaaataccacagtcataatttcccacctacctaaagagttatttctcaaaaaaaaattgttgcgaatttattttattttgttttgttttgagatggagtctccctctgtcgcccaggctagagtgcaatggcctgatctcagctcactgcaacctccaggttcaagtggttctcctacctcaacctcccgagtagctgggattataggcgcccaccaccatgcccagctaatttttgtatttttagtacagacggggtttcaccaggttggccaagctgctctcgaactcctgacctcaggtgatccacccgccttggcctcccaaagtgctgggattacaggcgtgagccactgcacccagctgaatttattttattttttattttttattttttgagatagagtcttgctctgtcacacaggctgaagtgcaatggtgtgatctcagctcgctgcaatctctgcctcacgggttcaagcaattctcctgcctcagcctcctaagccaccatgcccggccatgaatttaaataaattcaaagatcccattaatgtttattacaaccccaataatataggtaggcagaatacaatcctgaaaaaggtgccaaaagttgaaacaatgtaagtcaactcagtttccccaagttaaaattataagagtatattaactggctgggcgtggtggctcatgtccgtaagcccagcactcagggaggctgaggcaggtgatcacctgaggtcaggagttcgagaccagcctggccaacatggttaaaccccgcctctactaaaaatataaaaattagctgggcatggtggtgggtgcctgtaatcccagctactctggaggctgaggcacgagaatcacttgaacccaggaggcagaggttgcagtgagccgagattgcgccattgcactccagcctgggtgacaagagtgaaactctggctcaaaaaaaaaaaaaaaaattaaaaatgatactaaagaccttagaatttctggacatatctgtccaagtatctgtcacgtgtcattctcactatacagaaaacaatctctaaagtcattgatgtctacatgtctaaacttttcaccatttttgacatcttaatacttttaaattacaatccaagttaaaagggcaatgtaggattagaatagaaagaggtgaggattcagaaatcctcacatcaatttcacaactccctgtacgatggaggcctctcttccctgattcttccttagggttttcaaacacggagtccctcctaggtgccagaggttgttctgggctcaggcagtacaatggtgtataaagctgccaaaacccttgccctcatgtggggagacagacacgaggctgagtaagccacacaatctgttaggatggtgatgagtgcgtggtgcatcatttcatatagggtgatcaggaaggcctcaagataaggtgacatttcaggaaggcctaaaagttgaggcatgcatcatgcagataactggggagagccatccagacagggagggcaaaggcaggggcacagggccaggggccagcaaagaggccagtgagaaaagggccatcctaggctctggactctactgctgctgggatggatggccctggggagttcttgcagaagaaacataagccaatcacccaaggtgactgttaaaatgaaaatccccaggcctctcaatctggacttctgattcagtaggtttgaggcccagggattaagatttcttagtttgcaggtagttcagctgagagtggcccaaagagcattctcagaaacacatttctgaatccctgatagtttggcatccctcctctatttccttatttttggtcagctgccctctacaacaagcagccatcattttgcagccgtttagcgttaaacaactaggagagagatgataagaaggaataccctaagtataagagttaaaaacgaagccacttagtttttgtctagcaagagagtctggccccaatatcttctgagctttgctgacattcagtgattggcttgtaactgacaaatggttgaattctatgagtatgggcgtcctatgactatcctggtcattgatttgactaatgattcctgtgcccttgggttgactaaaacgcaaggctgttgtgtttggtgagtttgttaaggtgaaggtcaagtcaaatattgactgcagaagtgatattacagatacccaagttcccaggttgcggaaggtaagagaattcagatgacagggattacaggtgcaaagaagtagtccaatgatcctaaatattttcagttcaagtgcttcttttagggatattacttagtatttcatctcttttcctttgatgtctagataggtattaaatattgcagcaatgaaaacaactgacatcaggtgcattctctctacattattttatttaatcctaaaatagccctgtgaggtaactactgtatgggttaaccaaagcccagagatgttacttgcccaagagtcacagggctattaacaggcagaattgagactctaacctatgtctgattaatccaacacccatgtcttaaccactaaaatatactgctccttaaatctataagaaacatacttgccataaatgttttacatacggcatttccacaagagagcttaatattgagatgctggttaattatcagagacagcgtgatgcatgaggaacactagttttggagcaaaacagatctgaggctcaaatcatttgaccactgaatagcaaatgacttaataggcctgagcccccaaaccttcattcatagagaacattatgtctctcagaaatttaagtgagaaaataagtgcaatgcatggggcatatagcacatagcatagatactaattccttccctactgacttggaagcaaacactgaccatcacctccacctccacctccacccggggcacagagcacagcactcgcgcaaacccccaacagagggtagagggtcatctcggttgggcttgggcttctgtagcggggggctcactgctccgccgagtgccctaaccactgatggacacctccagcccctctgagggttcttcctcctactgacccaatggtcgactccccccaggactgcttctctgaggcaacactgagcaaactgactgctctttcctagtgacagtgccactaataactgaagacagtcagttggtgtcccctggtctttctttctctaaattaaacatgtccacttcagtcagaagtccctctgatcacaatttccgaacaacacagtatcctaattttcctctgctgggaaaactctagtttttctgtgtcctttaatgccaggaccagggccaaaaattgagattgacatattaagccaagaatatgattggactattacataggctaatctagaaaactcaccttgataatcccaggcttcttggctaatcttagcgccttggcccagagcagtcacatcggcaaaaaattcccgcccacttctcctcccagttccacccctcacagcagctgctcacatctttcctcctcccttttttccctccgaggccctccctcagcctctgtttcatctcttcaggaatctcctcttcccagcccaatcctaaacccaggtagcctttgttctaaatttgtataagtgtgttctaagttcctcgcctccccagtcagccagtcagctcggcaaaacaaaaggaccttcccccaaaccagctctccttattaagtagaggaggagagagttctgtaatacttgtaattactcagaccctgtcacactttaagtaactcagcctaagaccattattatacctgtacttcataccgctggctgaccctgagcttgtggtcaaccctgagtcctagagctttcatcatcttaactcctgcccaggccaatagatagcctcaatcctgttattgcatacagtcatgttttggaaagctaaacaaacaaaaaaacatggcaaggtgcaggcccagcaaaggggccaatgagaagagagccgtcctaggccctggaccctctgaaaggtttctgactatgaaacctttactttcatcccaggtaagtccaattttggtttagcaaaatcaaaattcttcttgcagcttattgcaatcatttcatttttgcttctgttatctcttgtactctactagctctccttttcggatttgtaccttctgtgaatgtggtatgactttatgaggatcatggacaaaaatgttgagaagaaactaaccaaggaaaacttttgttgcatggataaatacatagatgcatataaaacaggcagtacataatggatacataagcatataagatgctcataaaataacacaaccctgaggacacacagagatgccaggtaacatcactgcactgagtctaatagtctttagcactcccacacgagcaaacctggctgcaaaatcatgttacacagcaacagaggaatgctcatagcacagaattaaatagagattctaagtcatgtgagggggcagccaggaaaaagggatgtttatgttatttaagtgacaatgaaagttaattatacagcacaggagactagaaaagctttatttgacgttgcagacttttagtgaccacagaagcagttgtaggtattaaaatttcatccatctcagtgtcatttatttactttgccagataatcagtgatcttgcatttttatcttctcactttaaatgtatgcacagaatgttctctcctatgcgatctcacatttattttattttttatttactttattgttgatttttttttttttttttttttttgagacagagtctcgctctgtcacccaagctggagagcagtggcgcgatgtcgactcacggcaacctccgcctcccgggttgaagccattctcctgcctcggcctcctgagtagctgggattacaggcatgtgccaccacgcctggatatttttgtatttttagtatagacagggtttcaccaggttggccaggctggtctccaactcctgacctcaggtgatccacccacctcagcctcccaaagcgctgggattacaggtgtgagccaccgcgcccggcctcaagttcattttaaaatctgaattgtcagctgggcatggtggctcacacctgtaatcccagcactttgggaggctgaggtggacgaatcgtgaggtcaggagttggagaccagcttggccaacatggtgaaaccctgtctctactaaaaatacaaaaaaaatgagctgggtgtagaggcaggagcctgtaatcccagctacttgggaggctgaggcaggaaaatcacttgaacccaggaggcggaggttgcagtgagccaagatcacgccactgcactccagcctgggcaacagagtgagactccgtctgagaaaataaaaataaaaaaatttaaaaaatatctgaattgtcctggtattccatccagtatcaggcttaagttgtcaagaagagataccagtcttgatttctgtgaactgccagaattacacagaaatttgctccacttcccggaaaaggcaaataaaacataccaggattttaggtggtgcaagtaagttgcttgccagagcagccatggctacatataatttgcccaattcccatcaggcatttggttatttaaattttaagcatgcttgatacagcggtcatattaaccttccttatatatgaggaaaacatttcaagttataattatgttaatggtattctaatagtatttttaaaaaattatataacatttattactccgaggaaattaatgtcagatgacactaaaataattaagtttgaattaatcacagattatatcactttgttctcttcaacttttaaacatgtttgataattataatctaacaaaggaaaaattaatagagaaaataagtctaaaaattttctcctccgaattggtaattgggggaacaaaagatgtgggcaattagcaaatgaatatggtgcttcaagactgaagaatttaggatatgtaacaggtgacttagttcagggttgttcctagaggtaagaagtatcaatagaatttaagagtctacactgttcattctatcagtatatcttctatggcacacaagaagcaatggttattcagttatcttaatttcttaagttataaaagttaaatttgagccaaaagcaattaccatgtaaaagtgtatgcagtttttttttttttttttttttgagacagagtctcactctgttgctcaggctggagtgcagtggcgtgatctcagctcactgcaacctctgtttcctgggttcaagcgatgctcctgccccagtctcccaagtacctggcattataggcgtgcgccaccaggcccagctaaatttgtatttttagtagaaacagggttttaccatgttggccaggctggtctcgaactcttgacctcaagtgatccgcctgcctcggtctcccaaagtgctgggattacaggcatgagctacagcaccaggtcggtgtgcagttttgaccttgttatttgaccaaggaaaatttagccatttgaaacaaactcttttttttttttaagactgagtttcactcttgacaccctggtgcgatctcggctcactgcaacctccccctcttgggttcaagctattctcctgcctcatcttcccaagtagctgggattacaggagtgtgccaccacgcccggctaatttttgtatttttagttgagatggggtttcaccatgctggccaggatggtctcgaactcctgacctcaggtgatccaccctcctcggcctcccaaaatactgggattacaggcgtgagccaccgcgcctggcccaacacacactatttcttacattaacttgatgtctcctttcacctaacagaagcaaaatacacgcctaattgaaagacagtcagtgtgtcagactgaaacaaccaccaccaaacaaccaaggcactgatcaggaaaacagcacttttcccttgattctgactttttttctcacatacctttatttgcattattcataggttttatcagaggtttatttccttgggttaataatgaaacatttttcatttgtttccaccaaggggcttgctattctactattgcttagagcttcgggtgtctccatatgacaaatgccaaacatatgccaatcacaacattcaactggtagcatatgctgaatttcccagacgccagatccagtcaggaactttctggtttaatgagtcttgcctattatgtttctggtacacatcattacagaatttttccccatctacttccaagaactagaataaaccagaagaacaaaacaaactacaacaaaaccataataaatcctctcttcgtttatcatctatatgtcacatacgaaattagttacactagcagcatttactgagggcatggcaagatttactaagtcttgtttctcatgttacagccaaattttatcaaagttgaaaataacaatattttacatccatatagttctttgtattatttatttcaaaggactttcagaacttttacctaattggatatttacaaaaacccgtcgattgaagtaggcagcaattctttctcccacttaatagaggagataaatgaagcccagataaattaagcagcgctcccaatgtcacagttagttattattattatattattttttgagaaggagtttcactcttgttgcccaggctggagtgcaatggcacaatctcagctcactgcaacctctgcctcctgggttcaggcgattctcctgcctcagcctcccaagtagctgggattacaggcacacaccaccacaatgggctaatttttgtatttttagtagagacgggggtttcaacatgttggccagggtggtcttgaactcctgacctcaggagatacatccactttagcctcccaaactgctgggattataggcatgagccaccgtgcctggccaacagttattaacagggccaagatccgataagaagttgccttgaacctcacatccactggtctcccactattcctcattaggctgtgccaaggacacaaagtcagcagggatcgagacaccattaacctccctcctgacactggaaggtggcccctacttcctctctgagttttttgtttttgtttttgtttttgttgagacggagtctcgctctgtcaccaggctcgtgtgcagtggcgcaattttggctcactgcaacctccacctcccaggttcaagtgattctcctgcctcagcctcctgagtagctaggactacaggtgcacgccactacgcccagctaatttttgtatttttagtagagatgggtttcaccatgttggccaggatgatctcaatctcttgacctcatgatccgcctgcctcagcctcccaaagcgctgaaattacaggcgtgagccaccgtgcctggtcctctctctgatagttttttaaacattcagaaaaatgtgaatgcatacttaggtttctgcctatatttcctgagagaaaatcatgcctcaacatcaaacgcaaagatcagtcttaaatctggacccaggaacaggaattctcctaattaagcacataatcccatttatctctctagaaacaactgacattcaaataatgcttcatttcgtttgtaaatactagttagatggattgtaatacaaaccaaagagacattaatacaattgtccatttcctttggaaggatggctatccttcctatttaagctaaaagacattttcatttgaaagccatttgagcttgagctgcaatgagctcaggtgcaaatttcttgatgaacgagtctaataatgacacaaaatttcaaaaagaccaagagctatttcatggattatttcctgtggcaatcatctcaagttaaataacttgacattttagaaatggcattgggtaaataactctcgggtgcttttttcactggtccgctcactccccttatcttcctgctgactaaggaaggtaaagggtatcctccacaggaggtgggaattcttggtcctttgaggtaaagggatttcccatcatatcgttccatctgaggctgttatggactcaatcttcccctcacatttatatgttgaaatcctgcccccccaagatgatggtattaggaggtagggcattcggagggttattagggcacaagggtagaaccctcatgagtgggattagagatcccagaagctagctctgcctccttcctcagtgtgaggacacccccagaagacggccatcttcaacccagaagacggccctccttcaaacccagaacttgcggacacctgacttccagcctgacttccagcctccagcagtgtgagaaatacagttctgctgtttataagccgtctatggtaatttgttacagaagcccaaactgaccaaaacacaggtttctatgaagtttgttttgagaaacagaaaaatgcttggtagttctgctattggttatcatttctcagacattataaaaattatgtcaacagcaccctcgacatgttatctctggacaaactgatgtgcttctagaattttgaatttatttacttaacttttattattagcgattagtttctacacacgtttgcaaagacggataaaatcagagccctaccattgagtagataacagcctagcaggggaggtagaaagacaaaactaatagtaatagaatgcgataatctttttttttttttttttttgaccgagtcttgctctgtggcccaggctgaagtgcagtggtgcaatctcgactcactgcaaccgctgcctcctgagttcaagtgattctcctgcctcagcctcccaagtagctgggactacaggcatatgacaccatgcctggctaatttttgtacttttagtagagacgaggtttcaccacgttggccaggctgtctccaactcctgccctcaggtgatcatctgcctcggcctcccaaagtgctgggattgcaggcgtgagccaccgcacccagccaataatctctttaatagggattaatgtaaaacaaaaagaaaaagccacacagtggatgatgaagctaaatatgtctcaccgtttgtctggtgttttatagaggtggtaaaatttcagttggtggttcctaataatatcaccttcacaatagaaaataaagatctatgtgcagataggttaaggttactccagtgatcaaggtagtgtaaaggataaagtaagaatgataataataatgagtatgtagctaaaagtcaaggattgtaaaatatcacagtagcttcggcctttaggtggaacgaagcctgtcttaggtaggatttcctagaagcagacactaagtggaagtgaattattaggaagggctgtcccaagggagaaagaaatagagcgtctgggggctagacagggaaaggaaggaagcccaacaagggtgtgtcattaggtaaattcttatgaagggttattttggctcattgctacaagagaactctagagacacttctcagagttgtcccgtttgggggatgggcagatgatgagagttgggagaaggaggagctgaagtaaacacccccatccttgtcagtctttggttaaagactctcctaggggtatgtaagtcaccaggcgaggctgggctctacagctacttggtaaagtttctgagcagtacagcatctgttacaggcccatttcagaggagttggttctagagtctattttattaatatctaagcatatgttaggttttaaacagaaagcgtcaagtctctggtggatgtgcaataacatcacaccatatttaagttcttacaaagatgtagaaggaagatgtgggtttcagaaatgttctggaaactagaaacacttccctgtgtgtcatgctgcgacggtgccatgtcacgcagcccactggagtggcgtgtgaggtaatgacattgacttcaggtcctggtgagaagactattgctaggaggcatctggctggctggtggctgctcatatcctacgcatacccacctgacagatctctaggattgaaacagagaatgtatgtatgactaagcataacagcaaattttcttctgtatgtaatttcaagacccttcttatcatctctcttagtgatctagtgatctgatgcttgtaataggccttcgtgaatattcctcacttcaaagtagtctgtgagacacacatacaaacgagattctattaacaggtctgccagtgaaacagcccaagtagcaaatttgatagagaacacgtacttgggcatacaaatcccaaaactatgtactaattccaccaggtataaatctcacccaccagaccaacgtctgaaaactatacccaatttccagtccataacaagttaaatggaatttaaggaggttcgttaaagtgttataaacttacaatataagagctacaaaagaatatcataaacaaataatgagaataactccttttctctaaatatacagttattcagagatttcttttgttcttagagaattgttgtcagtcttcctgattataaaaataaagtcttgttgcagaaaattaggcaagtacttcttagcatttttcccttttcctttttcttttggatatgccgttttattgaggtgcaaccatatataaaaacatacacaactcctaagtacatggttgagtttttataaagcaaagaaacctgtgtaagaaccacccagaagatggtttggtttctgttgagggcagagtaagttcatacagaagctccggcctcatcgttgtaacatgtatttgtgagctacttgaagaaacagaccatttcttctcttgtcctccacaatccttgaatatttcatttgttttggagattgacagatcaagttattcattcattaacaattattaatccctactatgtgctcagcagtcagtgtgtgatgatgagacttggagtctagtggaagacacaggtaatacagaagcaaatatacaaagtgttcactataaaatacaaaatgctagggaggaaataaaactgatactgtggtcaagaataactaggtatcctacctagaaaaaatggttagagaaataaatcagagatgagatttagatagaaacttgaataaaaagaacacagccatgagaagagagaaggaaaacacattccaaacaaagggaacactgtgaacaaagtacacaaatccggcttgttgcacaaatggaaaatcaggtgactaggcgttggtggccataggtgtgagtcggacagcaaagacagagaccaggccagtcatggctatactggccaggagagtgacttaaagtgctaagtgcaatgtagggggaaaaaacggggttttagcaggaaagtgaagggaccgatctacgttttaataagagtaccttgaacactgtatgagcgggtggcgagagacaaagcaaggtgccggcaggttatcgcggtggcaatggaagatgtactctggaggtatatcaaccatttctgtggatggattggatgtgggagtgtgggaggtgcagaatcaaaatccatcaagtctttttacttcggcaattatgtggaatgagttgtcattcactgagatggagaagattcatggagaaataagtttccatgaaaaaaagcaagagtttagttttgaacatattacatttcagatgtttgagaaacatccgcgtggagttgtcaggtaagtaatttggataaatgagacgggagtgctgagaggagagctgagctggagatataaatttgggagtcattagcatatagatggtttctaaagccatgggaatataactcaaggagaagatagagaggacgtggggccaagctctgaggaccttcaaccttcagaagttgttcaggttcaagccagaaaaggctcaaaacgctaagcagaaagaatcgtagatgtaggagaaaaaccaggtctcagaagccacgaaagcagagtttcaaccagagggggtggtccacagtgcccagtgctggagagaggctgcgtaagaacaaacgagaggagcatctaactgggcttggcattgcccaaagctgttggtgatgctgtctcaggggaggaaagattaaatgggaagggaaaatggggcaagaagtgaagtgagtggggtccaggtaagttctttaagaggcagacgctcttacaacacaatgtgcattggggaaatgagagaagacaataaaggagagaggggaccagccaaaggaacaacctctttgatgaggcagaggtgggtgtccagcacaagtggaggcctttgcatctaagaggagaaaggacgctttttctcaagaaatggaagacaagaaagtgagtgctcttggtgtcaccttcttaaattgcagtaacatataaggcaaagtgagcagccggaaagaaagaggcaggggagggtgggaggagtgggaggtcttattagaagcaagggatagatatagggggggtgctgtagagagtgggagctcatacctcaggaaaccgggtactgacaaggagggaagagccatctgctgatgtgaacttacagtgtcctcggtttacccaaatgtttactaccaaaaaaaaaaaaaaacaccctaaagcttcaagggaaagaaactaaaacacagaccaccacagtcatttaaagctatgcatttgctcaggaagtgcaataaaaagcgtgtgggtaactgggcgtggtggtgggcacctgtaatctcagctactcagaaggctgaggcaggagaatctcttgaacttggaggcggaggttgcagtgagacgagattgcatcactgtactccagtatgggcaacagagcaagaatccatctcaaaaaaaaaaaaaaaaaaaaaaaaaaaaaaaaaaaaaaaaaaaaaaagggtaaaagtgagtggggaaaaggcagctgaaagaacatgagtgaaatgatgaactttggaatctcaggtggataaagacaggagtcatggcaggagggctggggaaggagagaaagcggcgagggactcccgtggaggttaacacagcaagggctctgcaagcaccgcagctgtcgctggagacgcgaatgcttcattttgttattttggaggtgaagtaacatctagttcgactctgttacactgagagtgttcgatgagaatagagtagaagaaaatgtcactgaagatgagcagatcaatgaatgaagatacaggatactgaggggaccattcatgtaaataatgagttgccaagaaaacggacagaatggccaggcgcagtggctcacgcctgtaatcccagcactttgggaggctgaggcgggcggatcacctgaggtcgggagttcatgaccagcctgaccaacatcgagaaaccccatttctactaaaaatacaaaattagccgggcgtggtggtaatgcctgtaatcccagctacttgggaggctgaggcaggagaatcacttgaactcgggaggcagagtttgcagtgagccgagatcgccccattgcattccagcctgggcagcaagagcaaaactccatctctaaataaataaataaaaaagaaaagaaaacggacagaatttggagaactgggggtggcagacaggacagataaacatcctcagtgaggtggcggggggcaggaggttaacagatgacagtggcaacacggggtggggggagcacagcgcagcgcaatggcatgaagatcaggggcttttactagagccatgggaatggcagcttggctggtgttgaggaggaagcatctcatggccttgccggagccaggcgtacattgggacggcctccagagaaggcgaaagacccagccaaggccaggtcaccacagaaatgttctaaaatgagactgagaatttaacaatggggtttgtgattgtgggaaaaattccaaaagcagagtgtatcaactatcaagaaaaatgatgaaatatacttatttggggggctttatagaaaggaggaattctgtgctacacctattatatatctaactcaaaagtcacttattcagttccttttatacgcaatggactatgcttctaacagacttttcagccacatgcaacaaaaaaccaagtaggaagggcccataggttggtgcacaggtcagtatgtgataccccaacgcaaacacatggtaaatgactggcaaaagtcaataatggctatatatattatatatggaggcatttatacaaagaggaatatatagaaggaggaatttaaaatcatgtctagagtaatataatagatgttaacaatcatgataatagtatttcaaagtatattaaacaaaatggattcatttctaacccaaccagtaaaatattctttgaaccaagattttactaggatgccaaatttaaaagttaaaaaaattccagctttttgagtaatgagcaatttcagtcatcaataaaattaatgaaaatgagagagcaaattacactaatccattgggtaaagaaaaacttaaaacattacccaaatagaagctttcttttctattgcttttcatcagtaataggtatcaactacatttaacaaaaacactgttgctgagataactcaccctcttggtttttaaatacactcaagatatgtcatgtttcaataaatgatgtcagcgttacactgtgtgaaaaaaatacaaaaaaaaaatttaagtttcatctataaatattattccattgacatttcataattaaagtttctaaagaatgaattcaaggccggtggctcacggctgtaatcccagcactttgggaggccgaggcaggtggatcacctgaggtcagaagcttgaggccagcctggccaacatgataaaacccagtctctactaaaaatacaaaaactagctgggtgtggtggtgtatgcctgtaatcccagttacttgggaaggcgaggcaggagaatcgcttgaacctgggaggtggaggttgcggtgtgccgaaatggctccagcctgggcaacaagagcgaaactccatctcaaaaaaaaaaaaaaaaaagtgagaaaacattggagaacataacttgattgagtgagaaggaaatggcagcttagagcagaccctgaaagcagggaggcagctagctgggcctgatctcctgctgcagaaacaggcaatacatccgtactgtgtgaagcccctaagtttgtcactatttgtcatgcagaaacaggtaagtaagacatattataactcggaaaaaatctcaaacctgttgcacaagaagttatttaccattgtaagctctctgcgaaatgttttggaaacccaagttgagaacagctttgatcagaggcaactgaaggcgggcagaagaaaccaagcagtaactactcagctggtgtgtgtgtgtgtgtgtgtgtgtgtgtgtgtgtgtgtgtgtgtgtgtgtgtgtgtgtgtgtcagtttggcagacgccttctttttttttcccctctagtgcatcatgttgaaactgtagctaatgccgggcgcagtggttcacacctgtaatcccagcactttgggaggccgaggcggggggatcacgaaatcaggagatcgagatcatcctaaccaacacagtgaaaccccttctctactaaaaatacagaaattagccagatgcagtggcgtgcacctgtagtcccagctactcaggaggctgaggcaggagaatcgcctgaacccgggaagcagaggttgctgtgagccgagattgcaccactgcactccaaccaggtgacagagcgagactccatctcaaaaaaaaaaaaaaaaaagagaaaaggaagctgtagcttagaacaggagaatgcaagtgattattatcaggaattgcatctgtgagggaacctgaggactcaagccagcccagcagagggcaaggcagcacagggcatgagtcattctcctgatgctaccttcacaggatatcagacaaaggaaactgagcacctgccccatttgatgaaataaagcagataaaagataatacatttaaacaattagatgtgtatcttttatatccaagcaatattgtacagaaaggcaccacctctaccttatgacaagtgttactacccatactcaggaaaccccgatgttgccagcacagaagccaggacaacagaaagctgaacaattccttttgcccaatgtgaacatctccaataaggctccagtttggaagacttctgaaggcctttcaaattcataataaatgctatgaactgccacacttaatcccctgtattctggctgggccagctgttataatacaccaccccacagtcattgctgcttggtagtcgaacaaacacgctggagtcagaggccagagtccttcctcatgccaccagcttccctgagcctagtcccaacaccattccccccagggcactttgctgtggcctcactgggtgtgcccacgtggtcttgccctgaaccccaatctgtaatcagcaccagctcttcaggcgttgaccataaaaggcactgaatgatggtggtgtttttttgttttctgttttctgtttgtttgtttttttgagatagagtcttgctctgtctcccaggctggaatgcagtggcatgatctcactacaacctccacttcccaggttcaagtaattcttatgcctcagcctcccgagtagctgggattatcaggcgcccgccatcacacccagctaatttttgtatttttagtagagatgaggtttcaccatgttggcctggctggtctcgaactcctgacctcaagtgatccacctgcctcggcctcccagagtgctgggattacaggcgtgagccactatgctcggcggatggtgctgttaacaacagtatctatccttgacaatatagggcttcttctgaccacctcaaagatgctactgcatcaggctttaccaaattcttctcttgttacatgagtttcagctcaagaatcagatcatgggggaagcttcaagagcagcaaaacttgtaatttttgcccagttgccctacaagaaaataaagttttgactcttaggcataatcaccatggtgagaacctatatattaatatctacacacaagtatctatatctctccttttaaatatactctttagatggctgctccttacgacaaaggttttatttggtgatttgatgataaaaaaaatcacttttctttatggtgactattatgccatcatctttactaacaagtatattatcaggaatctcaaagaaagtggcattcatgttatagccttcattacttcaaactattccggattccccatattattttacatattttcactgacttttaagcaaatgctttaattttccctttttttttttttttttctgagacggagtttcgctcttcttgcccaggctggagtgcaatggcgccatctcggctcactgcaacctccgcctcctgggttcaagcgattctcctgcctcagcctcccaggtagctgggattacaggcatgcgccaccacacctggctaattttgtatttttagtagagatggggtttctccatgttggtcaggctggtcttgaactcccgatttcaggtgatctgcctgcctcagcctcccaaagtgctgggattacaggcatgagccactgtgcccagcaattttctacttttttttttttaatttcttagatggggtctcattctatcactcaggctggagtgcagtggagtgatcttagcccatcacagtctctgcctccaaggctcaagcgattcttctgcctcagcctcctctgtacctgggatgtgccacaggtatgtgccacacacccagctaatttttgtatttgtggtagagatggagttttgccatgttgcccaggctggtctcaagttccggagctcaagtgatctgcccacctcagcctcccgaagtgctaggattacagcatgagccaccgcgcccagccaacttttctactttaaaaaggcaattggtgaaacctcttctctactaaaaaatacaaaaaattagctgggcatggtgccaggtgcctgtagtcccagctacttgggaggctgaggcaggagaatggcgtgaacccaggaggcggagcttgtagtgagccaagatcgtgccactgcactcctgcctgggcgacagagcaagattccgtctcaaaaaaaaaaaaaaaaaggcaattggtaagttgtatgaacattttgaaactcaaacatttttgtgttaccaggaaattcactatagagagaatgaaaactacgactatttgtaaataatactatgacacagactgcgacaggccactaggctgatttgcaggtaaaatttttgttctatcaaaaccttaaaaaccacatggacacacacacagccttccccagcccctgccatcccatcacacacccttccccagcccctaacatcccatttgtggatgtaactgacatataggaagacagcccatagttatcatttaggttcaccttgtccctggaattgtgctacataaagaaactgagaagcatttctacaagaaagctacgggtcacttgtgaaaagccccaattcatcccagctgaggcatttatcttgttggaatcactggtaaaagggaaagccttgtctcttaaagactttcagttatagaggctacataaaaagcaatggccaccacaaagcttaaacagataaactatccattttgtgtcttctcctatacattagtaattacttttaaaaacatctccacctgtaccttagcctcttattcctcaccagtattccttaccaataagcaacacatatcctactgatattttgttgatggagatagaaattaaataggtggctaattcttcttcacatacgagaaaggaaagttatggaatgaaaatgatgtctctaaggtcctaaatttttcaaactagtgccacctaatctgtgaccatggctaaattctcttgtctcagctttcttccatataaaatgagttgtctaacaaacagtaagctcaattaacatctgataccattattattaaactttttctatttatatgtatttcattctcagttaatatgatgacagaaggggataaacataacttatcaacgacattaatatgacttctttcccctactacattcgttaataaagaggttataattaggtttcaaagacagcatttcattaaggtgatttcattcagatacaactatttgcatataagtgcaataaaaaccttagaagtttctatttgactatgttagcttcataagtagaaataatacacatgctttatgcttaggttaaaaatcagcctaacaatatattcatgattagttcaaaagagcagacatcaattacctataagtttataactgtcaacacataacaattacaaattagaaacagagtaatcaaagtcaggtcataatcaatgtccagaaggtcaaagacatgcagaggccaaatgcatcttctaagtgttgcctggatcaatgtcttatattttacaagtgtaaacatggaaaaatcaagttatttttaatacacttaagaaatgaagtgatttttaatacatcccatatagtaaaaacataaatttgaactaatgtcataacacccttctggtgtccttttcattaaaatgcactaccctaatcatgtttacaattgatatttctctgaagtataaattacagattgtgttaacaaatttgcaaaatgtggcaaaaatatccattgccaacatatattcattcaagtcaatcagtgtatacttaatgagtgtcttctttctccagaaactttactaagatggaaagaaggctttcaattaaagcccagagagagagaggcaaaaaaaaaaaaaacccaggtcattataaaacatgaaaatctgtgaagttataaagatgcccactgggtatgagggtgataacagagatcatttccaggtaacagaaaagactttataaaagggtcatgtctgagttgagccgtaactgaggagtatttgaccagatgggactgaggaaggaaagacgatttgcagcctaggcgatcaaaggagcagggcgacggggagaaatccatggagcgtgtccaactacagtcagtctggtgtgagatgctgcagtcccaagcgcatggagtgatgaagataaagctgaggtctccaggttgcggagagccttaagtattaaggggcttgggctttattctttgggcaatgatatttactaaacagtttcaagcacaggaatgccatggtcacatttttcattgtaaaagaacatgcttatagcagtggagtagatattgaagagaaagactgagcgaaagaagaaagccaatgactatctagtttttaaaagataatctagtgagatgcagacaagatggtagaatagaaagctccaccgttcgtcccccgaccccgcaaggacaccaagttaacagctaatctacataggaaaaacaccttcttaagaaccaaaaatcaggtgagcactcatggtacttgatttccacttcatatccctgaaagaggcactgaagtgatttaaaaaaacaaaaacaaaaacaaaaaaaacccgtcctgaatctgctgacaccacgcctcccttactgggggcgaagagcatctctgggcactaggggagggagaacacagcaattgtgaggcattaaattcagtgttgtcctgttacagcagaaaggaaaaccagaccaaactcagctgatgcctgcccatgccagggggaatgcagatccctgtggtcggaacttgagtgcctgcaaaccttgccacagagggctacagcactctgagtctccaggtcaatgtgaaaggcagtctaggccataaggactacaactattaggaaagtcctagtgctgaactaggcccagagacagtgaactgggggtgggagggcacgtgacatactgagacactagctgggacagacaagggagtgctggcatcactgctcccctaatcccaggctgcacagttctcagctccagaaaagaccccttccttccacttgaggagaggagatggaggagtagggaggactttgttttgtatcttggatactagcttagccacagcaggaaagggcaacagactgaattgtgaggcctctgttctaggccccagctaccagacaacatttctagacacactctggcccacaagggaacccactgccttgaaagaaaggagctggtgccagcagcattcatcacctgttaactgatgagcccttgggtcacgaataaccagcagcaatatccaggtaccacgtcgagggccttgggtgaggctctgggacatgctggcttcaggtaccagcacagctactggggtccaaaatgccaagtgtgctcttggggtccccagttccaggacttgacccttggatggcatttctggacctgccctgggccagtgggaagtccactgctctgaagggtgagtcccagaccaggtggcattcactacaagctgacttaagagcctttgggccttaagggaacatcagggctagtctggcagtactcctcatggtctggggtagtggtgattacagggtgaggctcctctgcctttggaaaggggagagaaaactgggaaggactgtattttgtgttttgagtgtcagctcagcagcaataccaggttgatgtctaagacttttgactctagttcctgacccccagatggcacctctggacctacccagagagcctggcagacctcactgccctgaaggggaaaaaacaggcctttatcacctactgattataaaaccccagggccttgagtgaacataggcagtagccagggagtggttacagcaggacttgggtgagactcagccctttgttggcttcatgtctgactcaacaaagtcatagtggtggtggccacaggggtgcttgtgtcactccacctcaagctttaggtggctcagaacagagagagagaaactctttgtttaagagaaagcaagagagccgggcgcagtggctcacgcctgtaatcccagcactctgggaggccgaggcgggcggatcatgaagtcaggagatcaagaccatcttggctaaagcagtgaaaccctgtctttactaaggaatacaaaaaaattagccagacgtagtggtgggcgcctgtagtcccagctactcgggaggctgaggcaggagaatggcgtgaacccaggaggcggagcttgcagtgagctgagatcgcgccactgcactccagcttcggcgacagagcgagactccatcttaaaaaacaaaaaacaaaaaaaaaaaaacaaaaaaagagaaagcaagagaagagaacaagactctctgtctggtaatcaagagaattatcacagatcttgtccaagaccatcaaagcagcacctctatgagtctgcaagaaccacagcattactgggcttggggttccccctaaagtagatacagcttagatcacaatacccaagtcctgttaaatatctagaaagcctttctgagaaagatggctacaaataagcccagacagtgaagactaaaataagtacccaactcttcaatgcccagacaccaaagaacatctgctagcatcaacaccatccaggaaaacatgatctcatcaaatgaactaaataaggcaccagggaccaatcctggataaatagagctatgtgacctttcagacagagaattcaaaatagctgtgctaagaaaacacaaagaaaattcatgataacacagagaagcaactcataatcctatcagatacatttaacaaagagaatgaaataattaaaaagaatcaagcagaaattctggagctgaaaaacacaattggcatactgaagaatgtatcagagtcttttaatagctgaactgatcaaggagaagtaagaattagtaagcttgaatacagactatttgaaaatacagagtctgaggagacaaaaaaaaaaaccacaataaattatgccttgcctacaggatctataaaatagccttaaaagggtaaatctaagagtaattgggctgggtgcggtggctcatgcctgtaatcccagcactttgggaggccgaggtgggtggatcacagagtcaggagatcgagaccatcctggccaacatggtgaaaccccgtctctacaaaaaatacaaaaattagccaggtgtggtggtgggtgcctgtaatcccagctagttgggaggctaaggcagaagaatcgcttgaatcagggaggcagaggttgcagtgagctgagataacaccactgcactccagcctggcaatagagcaagactccatctcaaaaaaaaaagaacaaaaacaaaaaaaacagtaattggcctattggccttaaagagaaaataaaggacaagataggggtagaaaatgtatttaaagggataataacagagaacttcccaaacctagagaaagatatcaatatacaactacaacaaggttacagaacaccaaggagatttaatgcaaagaaaactacatcaaggcatttaataatcaaactcccaaaggtcaaggataaagaaaggatcctaaaggcagcaaaaggaaagaaataaataacatacaatggagctccaaaacatctggcagcagacttttcagtggaaaccttacaggctaggagagaatggcatgacatatttaaagtgctgaaggaaaaatcttttatcttataatagtgtatctggcaaaactatcctttaaacatgaaggagaaataaagactttcccagacaaacaaaagctggagaatttcaccaatagcagacctgtcctacaggaaatgctaaaaggagtacttcaatcagaaaaaaaaaaaaaaaaattaatgagcaataaataatcacctgaaggtacaaaactcactggtaatagtaagtacacaggaaaacctagaatattataacagtgtaactgtggtgtgtaaactactcttaccctaagtaaaaagactaaacaatgaacgaatcaaaaataataactgaaataacttttcaaggcatagtgagtacaataagatataaatagacacaataaaaagttaaaatgccaggggataaagttaaggtatagagtttttattagttttctttttgtctctttgtttatgcaattggtgttaagttgttatgaggttaaaatgataatatcaaaccaaaacaacacacagtggagacacaaaaaagaaaaagcaagaaactaaaacgtatcaccagagaaaatcacctctgctagaggaagataggaagaaaagaaagaaggaagagaagacaacaaaacaacgagaaaacaaataacaaaatggaggagtaagtccttacttataaataataacattggccgggagcggtggctcaatgtgtataatcccggcactttggaaggctgaggtgggcgggtcacctgcctgggaggtcaggagttggagacaagcctggcaaacatggtgaaaccctatctctactaaaaatacaaaaattaaccaggcgtggtggtgtgtgcctgtaatcccagccactccaaaggctgaggcaagataattgcttgaacctgacaggcagaggttgcagtgagctgagatcgtgccattgcactccagcctgggtgacaagagtgaaactcagtctcaaaataaatacatacatacatacatacatacatacatacatacatacatataatgaatgtaaagggactaaactctgcaacaaaaagacacagactgggtgaatggatgaaaaaaacaagactcatttatatgttgcctacaagaaacacacttcactataaagatccacatagattgaaaataaagggatggaagaagatattctatgctaatggaaaacaaaaaatggcaggagttgctatacttatatcagaaaaaatagatttcaagacaaaaactataagaagatataaaaaggtcactatataatgataaaggggtcaattcagcaagacgatataagaactttaaatatatatgcacccaacactggagcacccagatatattaagataaagcacatggtattagagccaaagagagagataagcctcaatacaataataactagagacttcagtaccccactttcagaactggacaggtcttcaaatagaaaatcaacaaagaaacatcagacttaatcttcatgatagcccaaaaatcagcagcatttctatatgccaagaattagtagaagaaaataataataaagatcagagcagaaataaataaattgaaatgaaaaaaatacaaaagatcaataaaacaaaaagttggtttcttgaaaagtcaaacaaaatagacaaatctttagccaggctaacaaagaaaaaaagagagaagatccaaataaaaccataaatgaaaaacgaaacattgcaactgatactgcaaaagttcaaaggatcattagtggctactatgagcaactatatgtcaatatattggaaagtctagaagaagtggacaaattcctagatacatacaacctaccattattgaaccaggcaaaaaaatccaaaacccaaacagaccaataacaagtaacaagattaaagccataataaaaaatcttccagtaaagaaaagcccaggacctgatggcttcactgctgaattctaccaaacatttaaagaagaactaataccaaccctactcaaactattccaaaagacagaggaggagggaatacttccaaacttgttctacaaggccagtattactctgataccaaaaccacagacacatcaaaaaaagaaaactacaggccaatatttctgatgaatattgatgcaaaaatcctcaacaaaatactagcaaactgaattcaacattacatcagaaagtgggatttatccctgggatgcaaggatgattcaaaatattcaagtcaatcaatgtgatacatcatatcaacagaatgaaagataaaaatcatatgatgatttcaattgatgctgaaaaagcatttaataaaattcaacatccttcatgataaaaattctcaaaatactggggataaaaggaacacatctcaacatatggcttttattaaaagccataaatgacagacccacaggtagtatcatactacatggggaaaaactgaaagcctttcttctaagatcgggaacatgacaaggatgcctgatgtcaccactgttattcaacatagtactggaagtcctagctagagcaatcagaaaagagaaagaaataaaaggcatccaaattgtaaaggaagaagtcaaattatccttgtctgcagatgatatgatcttatatttggaaaaaccttaagattccacaagaaaccattagaactgatacccaaattcagtagagttgcaggacacaaaatctacatacaaaaatcagtagcatttctaaatgccaacagagaacaatgtgaaataaataaaagaaatttttaaaaattccatttacaatagccacacataaaattaaattcttaggaattacccaaagaagcaaaagatctctataatgaaaactataaaacactaatgaaataaatcaaagagaatgccaaaaaaggaaaaatattccatgttcatggataaaatccaatattgttaaaatgtccatactacacaaagcaatctacagtttcagtgcaatctctatcaaaatgccaatgacattcttctgggaaatagaaaaaagaatcctaaaagttacatggcaccacaaaagacccagaatagccaaagttatcctaagcaaaaggaacaaaactgaaggaatcacattacttgacttcaaattatactacagagctattgtaagcaaaacagcatggtactggcataaaaacagacacacagagcaatgaaacagaacagagagccaagaaacaaatccacacacctacagcaaactcatttttgacaaaagtgccaagaacatacactgggaaaaagagtttcttcagtaagtggtgctgagaagacaggatatcaataggcagaagaatgaaactagacttctatctctcaccatatataaaaatcaaagcaaaatcgatttaaaaattaaatagaaaacctcaaactatgaaattacttcaagaaaacattggggaaactctccaggacactggtctgtctgggtaaaaatttcttgagcaataccccacaagcacaagcaaccaaagcaaaaatggacaaaggggatcatatcaagtcaaaaagcttctgcacagtgaccaagaagcagcttctctgctccttctggaatctctgcctggttcaatccacttgcctctactcctgcctccaccatgtccatcagggtgacccagaagtcctataaggtgtccacctctatgggcagcagcagcttccgggggtggcctgggtggaggctctggtggggccggcggcatgggaggcatcaccgccgttgtggtcaaccagagactgctgagcctccttaacctggaggtggaccccaacatccaggccgtgcaggagcaggagaaggagaaggagcagatcaggaccctcaacaacaagtttgcctccttcataggcaaggtacggttcctggagcagcagaacaacatgctagagaccaagtggagcctcctgcagcagcagaagatggcttggagcaacatgggcaacatgttcaagagctacatcaacaaccctagggggcagccggacactctggtccaggagaagctgaagctagaggcagagcttggcaacatgcaggggctggtggaggactttaagaacaagtacaaggatgagatcaataagtgtacagagatggagaatgaatttatcctcatcaggaaggacatggatgatgcttacgtgaacaaggtagagctgtagtctcagctggaagggctggctgacgagatcaatttcctcaggcagctgtatgaagaggagaccttggagctgcagtcccagatctcggacacatctatggtgctgtccaggacaacagccacttcctggacatggacagcatcattgctgaggtcaaggcgtagtatgaggagatcacccaacctcagccgggctgaggctaagagcatgtaccagatcaagtataaggagctgcagatgcaaagactgagatctccaagatgaactggaacatcagccagccccaggctgagactgagggcctcaaaagccagagggcttccctggaggccaccatcgcagatgtcaagcagcgtggggagctggccattaaggatgccaacaccaagctgtccaagctggaggctgccctgcaacaggccatgcaggacatggcgtggcagctgcatgagtaccagaagctgaagaacatgaagctggccctggacatcgagattgccacctacaggaagctgctggagagtgaggagagccacctggagtctgggatgcagaacatgagtatccatacaaagaccaccagcgcctatgcagatggtctgagcttggcctatgggggtctcacaagccctggcctcagctatggcctgggctccagctttggctctgacatgggctccagctccttcagctgcaccagctccaccagggccatggttgtgaagaagatcaagacctgcgatgggaagctggtatccgagtcctctgatgtccttcctaagtgaacagctgcgacagcccctcccagcctgcccctctggtggctgccccagagcctgggagggaggctgctgtgcagcggagcacagggaatgggagacccacctgaggctcagccctagccctcagcccacccacgggggagtttactgcctggggaccaccttgcccatgccttcagctacaaaacaactcaactgcttttatttttttccccccaaaataaaacctcagctagccctgaaaaaaaggcttctgcacagtaaaaggatacaatcaacaaagtgaagagacaaccaaaataatgggagaacatatttgcaaaccctgccaggggattaataatcagaatatacaaggagctcaaacaatgctataggaaaaaaatatataataatctgatcattttaaataggcaaaagatttgaacagacatttctcaaaagaagacatacaaatggcaaacaggcatatgaaaaggtggtcaacatcactcatcatcagagaaaggcgaatcaaaactacaatgagctattatctcaccccaggtaaaatggcttgtatcccaaaagacaggcaataacaaatgctgtcaaggttgtggagaaaagggaaccctcatatactgttggtgaaaatgtaaattactacaaccactatggagaagattattttttagttttgaggttcctcaaaaactaaaaattaagctactatttgatcctgcaataccactgctgggtatatatccaaaagaaaggaaatcagtgtatacaagatatatctgcactcctatgtttgctaaagctctgtatataatagttaagatttggaagcaacctaagcatccatcaacagatgaataatgcataaggaaaacgtggtacacatgtacaatggagtactattcagccataaaaaagagtgagagccagtcatttgcaacaacctggatagaattggaaactattaaataagccaggcagagaaagacaaacatcacatgttctcacttatttgtggaatctagtaatcaaaacagttgaacccatggacatagagagtaggagaatagttatcagaggttgggaaggtagagggaggatgggagggaaaaaaatagaatgaataagacctactatttgatagcataacagggtgaccacagtcaataataacttaattgtgtattttaaaataacttaaagagtgtaattggattgtttgtaactcaaaggataaatgcttgaggggatggatactccattttccatgttgtgattatttcacattgcatgcctgtatcaaaatatctcatggctgggcacagtggctcatgcctataatgctagtactttaggaggctgaggcaggtggatcacctgaggtcaggagttcaaggccagcctagccaacatagtgaaacccctgtctctactaaaaatacaaaaattagatgggcgtggtggtggatacctgtaatctcagctacttgggaggctgagacaggagaatcgcttgaactcaggaggcagaggttgcagtgagccgagatcgtgccattgcactccagcctgggcaacagagaaaaactcatttcaaaaaaaaaaaaaaaagcaaaacaaatgaaaaaaagcaccttatgtatcctataaatatacacgcatactatgtacccacaaaaataataattaaaaaagataatctagtgaaaagatgattcaggactgatcagaggcaatagttaggcaaaaaaattaaaactgctttgacaaacttttggcagataaaatttgtgattggttgaatgtaggcactcagtgagaagggataaaacagaaaactctagtatggaggactgggtagatgtgacttccccacacgagaaaacagccattgatttaggggcagcaatgaagattttagctggatgtaaagtacccgtgggatgtccaagttgagggagccaggagcaaggtgcctgagctggcacttcagggagaagcctggcatggagctaggaggcaggcaacatatgctcaacgaggaaagagcccagaggtggcatacaggataaacagcaagagaaatatgaagagaactaggaaaatgcagataagtaactgcactatcaataaaatattaaaccacaaatgtgagactcattgccctgtcatgttatctgagaccaatacattcaaaagcaagtataataaaggtacagatgacctgagagcacagaaatgcttagacaaatttggaaaaaaaaacaaacagacattccagatgcaaacctaggattgaacaattagtgtatctttgactatcccccatctcattacccatccagcctgcatcctggcacctagacttgagctctggccctctattaccccctttaggtactgtctcacctgtcccaaatgtgtctttgaatgtccacgtaggttctgaaggtggccttcagtctgtcatgctgaatgagttaaattttccaggaaaatccatatcccaaattattgcttactatgatctcctgcataatgttaagtaacttgggttttactctacatgcttccatactgctacagaataaacactcagcactcgtgaaaaagaatttatggctacagaaaacatatccaagacttacacaagaagatttacagctaagccctgacattaattggctttgtaatccagcttagctcctcttgctccagctgtcatctgcagaatgaagataatggagcagtgaagttgtcacagcatccgaattactatcctgatgggccaggtgtagacagacatccttaagtctgtcactagagagagcaaaacgtcttcatgggggcaatatcattttacagtatttggggcactgaaatattcctttcagagtgtccttactttactacaaaatgtcctaccagggaaagaaaaatattatcaattctattgaaagaaagcattaaaggaatctcactagctctttcagtaaaatcaatcaggaaatcatgaatgataacacttattatgcagacatacattatccatccactcctttaaaaatatttatagaaaatttaggttcctgtggctgtgaaactattctcaaaaaactctgcgtaacctaaaaacaaacaaaaccccctggggctcttccctttgctccccagtaattctcctctgcatttttaatatctgtgtgtcaccccctgtcattaataaagctatcaacagtcagtaaaaggcaacagaagtgtttcattgaaatcttaattgccagacatacagaatatcttaaaaactgtcctttaaatgcccacatttctcaaaatcatctcttaattttatttacaattacatttttcactttctgggtgctccattttccatttttagaatgtcttatatatttgggtagattccaaacagaaaatgagttccaagccttggactgaatcactcattccaatgggtgatcctaaaactgaaatgcaggcttacctcaaaaactaagacctcccagccctcactctgtgcatgcaagcttccaccttttttcatgcaagctccccaaggaggacactgcctctcgtgcacaggcaggcccaggagctgatttggagatctttctggctctctgtcgtctgcagactttcagtgctcccatgcatagatattggtccccttcctgaggatcataacaccttcgagttcttccatcctttgaaacctcctcgttgtgacaacgttccagctagacccagcttgcttctactaagtctgttctgtttactgtctcttttgttataaaattatttactcattttattttagtgatgtgaattaaatgggtcatatatgcttttgctagtaatccaagtgatattgaggtttctacattttaataatgagtcacatcctctggtctaccaatgccacttccatcacccaccccttcctagttaaaaatttggctagcatctttccgtacttttctcttatttgtacaaacgtgaaatacatttacataagttcatttaaagggaatgtataacttattctgaattatgatttatatattctgaattgtgatcatttatgtaacacaaagctcgctgcttgcagagtagaattaacaagcgtgaggcctgttagaaagaaagtgactttattaaccaaaactagtcgtggggaagtggttggattcccatccaaagcaactacttcaaattttggtggggaaggaaagagtttaaaaagggagaacttgatacgaaaggcatgccagaactgtgctgaggacgatgcctgtgcatcttgttccagtggctatcttgggtcccagtccacctggtacatggtctggcatcatctcaacagtggcggggctgctgattagccctctgaggccatctctggaactctgcagctgggtctccaggcttggtctgtctgtctcaagattagcccccaaatcttcaaagaaggcacataattagatgctagcgtacagttagataaataagaagggagtatatctggagaaaaacggagggacgtggagtctattttaaggctaaaggaaacaggcttctgtagtttgcttcaaggttacatcttgaaacccaagagaaagaggaaaaaaaaaagttttaaaatgcattttgaggttatgctgcccagttacatttacatcatgatattcttaagccaaccatctttttaacgtctctttcatagtatggatattccggtttttattctaccatttcattactgatggatcttcacattgaatatttcgtcactagaagcaatactgctacttatttcaacgtgtatcttggacattcctgtagttttatttctgaaggctaaattctcaaaataggatggccgtttcataggaaatgcatatgtacattttgaagagatcataagattgctatcccccaaaatgttgaagtaatttattcctctatcaataagacatatagcccctatttcttcaacagcagtgaatgatactaagttgttttttttttttgctgatttgatagacaaaaagaggtattttgttgttttaatatgaacttgcttgattccagtgaggtcaaatggattggttgttttattttccattatgtacactagttgttctgagtggacttggcaacagtgtagttgagttttcccctttcacattttatagattagggatgttaatcctttgttttatgcttttcaaatattctctcccagtttatggtccatcttttatttctatttgttatttctttcaccatacataacatttcagtttttatgtaatcaaactcatcagtgttcttggtaatggctactaggtctcctctcctccttcagaaggcctcttctatgccatggagaaaatgaggctcgacgtccctcaaattccaggccatgcacctggatctgcatctatcttcatcttctgtcagtcttggagaaagcgatgtcttctggtagaaacagaactacctactgtgttcttcacctcttcattgcttcagacaaaagactgcaaaatgacctctgcatggtcacacccagtaaaccatttttaaccctgacctttattgctcattctacacaggtgacccctctgatgatttcataggctctcacttgtgaattcctgaagacatcctggctgtcctcctctccctccagcaattgtatctcagcttcctgagagcacatgccgcttttcctccgtattttcccttggtcttttttcatttaatgcagtcttacttgttgaccccctagctcccaggacttacagtttagtctctatgctgatacatgcagacttgacctccatgcttgcctctctagcacattcccagatttctcagctccagacccatttttatacagactacacatccacaactgagcctgtcatcaccatcagatatttggtgtctaaaagaatggccagggctacatcccagtcacacaggctataggtctcactgtctccatggactcctcaacactatttgtattataaataaacaccataggatttgtgccctctagacccatgacaccctatattccagaacaagagaacaatcggcctggaggttttgcttggatctcttgtacactcttgcaacagtcccccagcagcaactctccagtcattctccattcagttttgcattctgtagccataaaacctgggtcttgactgtgcctcttcccttggaaaaatcctatcttggttctattggtttataatgaagttcaatctccctgtaaggtttaggagaccacgcatggcttgaatcttacttctttcttcaaccttggttctcactctgcttccttctgcctcctcactctgaccatgtcctctcttcagaaaccatatcctgatttccagtttcctgtctactatgttctctctcacctatgtaccattgaacatgcagttccctctgctgactcagtcttaaagtatgatgggaaggctagagcatcacaaaaatgcctggacagttagacacaattattaataaaagtcaaatctcaaaaggcatgctgtctattaatacaaacactaaatgtaaacaagaaaatttcatattaggaagatgaaatcaacgctgcattaccactaacttgaacaaggggtgggcaatagacacagaaatgaaattacccagtgttgaacattcagattgactttggaatctcacaggctttcctaaaaaaacacttcttccctttaaaaaggtactactggcttggtgcagtggctcacgcctgtaattccagcactttgggaggccaaggtgggtggagtatttgaggtcaggagttcgagaccagcctgaccaacatggtgaaaccctgtctctactaaaaatacaaaaattagctgggcgtggtggcgcatgcctgtagtcccagctactcaggaggctgaggcaggataattacttgaacccagagaggcggaggttgcagtgagacaagatggtgctactgcactccagcatgggtgacagagtgagactccgtcaaaaaaaaaaaaaaaaaaaaaagggactacttattgtacattttgaataaaagacgaattgagagcgaggatttgatgcccctcacggcatcttagtgactaaagatttaccatcagggtgggctcagtttctttcaggtaaatgaaaaatggcaaaaataatgcctttcatttctaaacacgaccataaagataaaacataaaaaatgatgacagatttgacgaactaaatctttaaaatgtctgtatgccaaaacatacacaaaaacacacatatgcaaattaaaagataagtgagtaggtggagaaataatcataaccaaagagagttatatcttcaatctataaaaagctctgataaatatgaaaaagataaatacccccaataaataagcaaagatataaacagataacttaaaaaaagatgatcaataataggaaaaaaatcaatcaaatcacatggaaaagaataagataacagtttgaattctaaaactggcaaaaatgggccaggcacggtggctcgtgcctgtaatcccagcactttgggaggccgaggcacgtggatcacctaaggtcaggagttcgagaccagcctggccgacatggtgaaaccccgtctctactaaaaatacaaaaattattcaggtctgatggcaggcacctgtaatcccagctactcaggaggctgaggcaggagaattgcttgaacccgggaggcggggggtgcagtaagcggagatcacaccatggcactccagcctaggcaacagagcaagactctgtctcaaaataaataaataaaataaaataaaataaaatataattggcaaaaatgggccaggcacagtggctcacctataatcccagcactttgggaagccaagagagaaggattactcgagaccaggggtttgagatcagcctcagtaacatagtgaggatctgtctccactaaaactaaaaaatttagccaggcaagatggtgcatgcctgtagtcccagctacttgagaagctcaggtgagaggatcactggagcccaggaggtcaaggtttcagtgagctgggatcacaccagtgcagtccagcccaggcaatagagtgagactctgtctcaaaaacctataattaatttaaaaaattttgaaaactaaataaatacaattggcaaaaatgattgaaaggaagctaacttcaatattgatgagggtgtgcaaacatatgcactcgcaaccactgatgacgggaacataaaaacccattcaaaggctgatatatggatattctctcaaccagcaattcaactcataggggtttatcaagaggaaatatttggacaaattaaaataatatttagccactaaaaatagtaatccacaaccaaaatattaatggtactgagtgaaaaacatgtacaaaactatgtgatatatacaaacatatatatagtataagcctctgttttaattaaaaatatgaaaattaaatgtattaaatataatgtattaaaaatatgttataaaaggttatgtgtgtgcatatatgcgcatgcctaaaatggcctcagaggactttgcaacaaaagtttaacagtctggggccgggcatgtgaaattaattatcgtttttaaatgtttctagatctcatacatatttaaacaaacagcataaatatttcttataataaaacagcaatactattttaaatgtctgttttgaggacaatgtatttaggaaaattgtatatagaacaggaaaggagtacaagcatggaaaagagggaagtcagtgttaaattataaaacctgatcacacactctatttgttcatcatttagaatatacttttcaaatggtttcaatacaataaagccttaaatgttttgctctaagcattcttgatttgatttttcacacatagtatattttaagggctgttcatttgactgcatttggttcatttaaattcatctcatcaaaatgcaaaatttctaagagctattttatcttcaaaaaaatcccatttaagtctaacttatgtcatattttttcttagaaaaaggaaaacaaattttactaaaagtaaatgaacttaagttccaaaagttcaaggttgacacaaaagtaacttaaacaccataagacagaaaaacatactggccttcaattcttattcaaaaagtttatttacccacatatgtttctttagtcatcagtctacaaaacaatttgaaccaatttttcctatcttttaaaatcttatgttacatattcttctttgacatagcaaatgaatgttgagccttttcctggaaaaagaaatcaaagcctgtcattgccatgtgcccctctcctccaatcctgcgactcccagtccattgaatctatctgtcacttagtttcaagaatatgacattaaacatgctgattcctctacttagaatgacttttcaaatcttttatcttccatgcccagcaaatactcagacccaatactccttcaagacccaatctaatcaccttatctctagagactcctaatcactgtagtggagggtgcctcaacttccttcagtggacaaaatctacatgcaacaagttcatgcacacacacacacacacattcacacacagaaattgacacacccactttcacacacatatccagactcacacagatttacacacaaagttcacacacacagattcacacagattctcatacacactttcacacacatatccagattcacacacagatttacatacacaagttcacacgtgcacagattcacacacacagatacacacatacacacaaattcacacagatttacacaaattcacacacacagatacacacagattcacacacacatacataaacacacaaatttcacacacacaaaatcacacagattgaaacacacacattcacacacatttacaaacatataaaaattcaacacagatttatacacacgttcacacacacaattattgggcttatattgtaactatctgttgacatgtctttcttctctagcagactcagcttcttatggaatgccctgtttgcatgccgacatatacacagaacctccccagatgggtgataccccacaacacattccccacaagagtttgctgaattgattaaacatgacctatcatgaacgttatcattattttagattattttctcagtataatacaactccttttaagatccagtcccatagatgtgaagtgggctgaagagtttggagttcatatgacacaagacactggactttcggtgacaaggaaccatggtatcagatggtgctttgaaagtaacattggctgcacacagtggctcatgcctgcaatcccagcactttgggaggctgaggcaagcagacggcttgagcccaggagtttgagaccagcctgggtaacattgcggaaccctatctctaccaaaaaatacaaagattagccaggtgtggtggtgcatgcctgcagtcccggctacttggaaggctgaggtaggaggatcacatgagcccaggaaggtggagatttctttgaggagtgattgcaccactgcactccagcctgggctacaaagcaagaccctgtctcagaaaaaaaaaaaaaaaagtaaagaaaataacttcaaggagggactgagaattgggagcaatttaggtgtgaccaatctagcatggggtgacagggacctgtattaggaggataacaatggcaaacagagaaaaaaaaaaaaatctgtacgatgccccccagcaagtgtcaggaacaggcaagaaaatattttatgaaattcatctggatgtgagaaggtccatgaactgtgttggacaatacatcaagggaggcaattaggcaaggcccctttcccacagaaaccttgagctacactgtttatatgtggaagcacacaaacagcaaggagctgggcacaggttctcagcaggctgatcaatctgaggctccatcagtgctccctctgctgtagaatcctgagcgcttgctgagtatataacgcctttgccacttcttcagagattcctcccctcgccccaaagtgtaagacagacatcattcagtggcatgtactaaaaatacaatggaatgtctagcatacttgctgaattgagaaaacattaatatcccaggctcctcgggtaccagaatggagtcaatgctagaaaccactcttctgagaaagagtcaaaagtgccacagcaggttcaatgagggtgtcaccactaagttaagatgctgtcacaaggctaataaaaagattaaacgtattaaaaggagaactgatactaagacaaatttgatttcctttccccaaaagaataccaagcatctgagatataggaggttaagtgaaggtcaaaagagacagttagattcattcataagcaatttacttttcaggagagattttgaaagattatttaacttagaatgaatagtaaaatattcaaggtagttatatggcaattaatgaaaaagtggaaatgaatattaaattcctagctcaccagtgtcatggtctaacaagaaaaggaaaccaatttctaattttcccatggaatgacttacataaagaatttgtagatcttcatatacaaagacaaatatttaacttaggccaggtgcggtggctcacgcctgtaatcccggcactttgggagggaaaggcgggcggatcacctgaggtcaggagttcgggaccagcctggccaacatggcaaaatcccgtctctactaaaaatacaaaaattaaccaggcgtagtgacaggcgactgtaatcccagctacttgaggctgaggcaggagaatcacttgaacccaggaggcagagggtgcagtgagccaagatcacgccactgcactccagcctgggcaacaagagtgaaactctgtctcaaaatatatatatacttaacttagattttaagagtttttctcaactaatagagttaggtaaagtaaattacttaactgaactatctgcacattttcccctaatttatctttggaatatagttatgagaaggctggtcaaaaccaagacacaaaggtagaccccaaaaacccaacagggagagggggaatcatgttttccctcacatgacctctctcacaaagggctataaaagccaaaaatttaaacagacttagataaaaatttgaattatttccaaatgcagagtgctaaccactatagtcaagtcatttaaattccctgtggttaagtctcttatctgcaaaacatgaacatataaatctctttgatgacattattaagcatttcacacattacatatccatctgagaagacagcactgaagcagagaagtccaatattatgtatgcaaaggatgccttgcaggaggaaatcctgtcctccttcagttctcactgatttatagatcctaaaatgtataaaaacaagcattaagtatttttaaaatggaaaacaaaatacactggaatgagaatgtttatccatgtgactttgcacatatgaaagctgaataaatgttctgtatcatccagttatttcagtttcaggagttaaggatactgaggataaaatatcctgattatggtgcctgcatttttgtgttcacggagttatcctgtcatatagatagcctaagggtctctgaaagaaaagatggagttacgaatagaaatttatttctaggaccaaattcaagttcaaatttgcatgataatatctgcagtgctttattcctcttaaaacccaagttaccaagctcttaaactcagctctctttgcattttaatgaacagagtccaagtctgatgcttaaatggtttgtttttattttaagcttttgaatcccgcataagacctaccacagtgctaggtactcagtgggtctctaaaaaacttattggctgtttttaaactgtaccttacatgtctctgaattataacacatgatattaaattcagcagcaaggaaaataagcctttaagttcttactttgctatgcttccttgctatatggaaagacagtgtttatgaaaatgtgattgctatggcttacatgtctgtccccttcaaaactcatcttgaaatttggctgccattgtgacagtgataggaggtaggacttttaggaggagatagggcgataatccccaagcggatgggattaataccattataaaagggtaagttgtgtgcctttttatctcttggcccctttgcccctgccatttgaagcctctttgatcccctcgctcaggaggacaggacggcatacaaggtgccaccttggaagaagagaacgaccttaccagacacaaaacctgctggcaccttgaccttagacttcccagcctccagaagagtgggtcaatacatttctgttctttgcacattacctagtctgtgatattctgttatagcagcataaatgcactaagacaatgaccattctatgtggcaaaggctagaaagaggtatagggtttagagttagcttctgaagtgaccagctaggacagaaacactgcgagaaattctttgtgaatcatggctttttcattcctggagtcacttttccttcgataaacaaacaaaactccacctgtgaatataatagtctcatatccaaaagggctggctggtgctgggagaacaggatatatactcctgaagcctttccttaagtggtagaatcattcttcactgatgaatccaacaattattcctgagattgatgtgttgatttagcaatgctctatcactcagcatctctctgtttatgcttttcctctcccagagggcagccattctaaagagttatccctctctgcaagtagcgagactcataaactctacatgagcatatttaaggacttccaccattcaaatgaaaaaaattaccaaatagcaaatgatcctataaagaaaaaattttcaaatgaaaataaaacaaccctcagaaaagccatacaaaaatataacccaccactatcctctgaaacctttggaaatctctgctgtcttactgaagtacttggagttttaaatgcagtttactggctaagactgaaaatagctgggcgcggtggctcacgcctgtaatcccagcactttgggaggctgaggcgagcggatcacaaggtcaggagatcaagaccatcctggctaacacggtgaaaccccctctctactaaaaatacaaaaaattagccgggcgtggtggcagatgcctgtggtcccagctactggggaggctgaggcaggagaatggtgtgaacccaggaggcggagcttgcagtaagctgagattgcgtcactgcactccagcctgggcgacagagtgagactccgtctcaaaaaaaaaaaacaaaaaacaaaaaacaaaaaacaaaaaaaaaaaaaacactgactatatttacatatgcctggacagagaacatagaacactgtacacaaaacattatctgatatacctttaaagttattcttaaccaacatgagggaaaatctgtcattagtcaataaacaaagtcaattgctgagaggaacactctgtacattcagaaaaattagaattcctgccttgcccctaaaaagaatttaaacatagctgctactgattagagacagggtatttcaaagtccagccaggaaaaaataatcagaataattccccttgctcctagatccaggagtcagaaggtgaatcacaagcaaaaaattcattaatttatgcttgtatatcatgattttccagctctctaaattaagggaaaaaagccagccatacaatgaattgtgggcatatcctataaatggattttcagaaatattgtcaaagttcttcaaattaacttttcaagaccaattcaacaaatacctttctgggtttctttcttttctttctcttttcttttcctctcctctcctctcccctcccctcccctcccctcccctcccctcccctcccctgtcccatcccctcccctcccctgtcccatctcctcccctcccctcccctcccctcccctcccctcccctctcctcttctcttttcttttctttttgagatggagtctcactctgtcgcccaggctggagtgcaatggcttggctcactgcaacctccacctcctgggttcaagtgattctcctgcctcagcctcccgagtagctgagattacaggtgcctgccaccgtgccaagctaatttttgtatttttagtagagactgggtttcaccatcttggccaggctggtcttgaactcctgatctcatgatccacccacctcagcctcccaaagtgctggggttacaggcatgagccactgcacctggcctataaatacctttcttggactatattagaaattaactttcatttttatcgtaagtacttttaactctaaaataaaattaatatcaaatcacagtaaacatttaagcatatctaaaaatgagtggttatgggggccatgtcctccgacagcaaactaacttcccttacacaccacatttgtcccgttacccattggctgcatttagttcttctaactgcacccaattcctatattctggaaaattctctggctccattcatttattccatagatatttactccaattatctcaagggtaatgcagggcattagtgtttacaaacattcttcaaacctgtcataattctattcttctcttatttcctgttagcagttatttacatgcgtacatatgaatgattaaaagatataaaaaatgctcagtaaatgttggtaattatttttgattccacatttcagggcaaatatactgagtatttcatagacttacattattattattattattaatttatttatttgatatggagttttgctcttgtcgcccaagctggagtgcaatggtgtgatctcggctcactgcaacctccacctcctgggtcgaagccatctcctgcctcagcctcctgaatagctgggattacaggcgcgtgccaccatgcccggctaattttttttgtgtttttagtagaaacagggtttcaccatgttagccaggctggtcttgaactcctgacctcaagtgatccacccgcctcggcctcccaaagtgatgggattacaggcatgagccaccacgcccagccaatttacattatttaacacatcaacctgattaataacatctccaatattacaaaagcaaaagctgggtttccataggataagtaactacctcagtgtcaccaaggcacccaatagaggagccaggattcacccccatttagcctgaccctatgtgctgggtaataaggggaaagttgtatataagttcagtagacaaaattaaaaggaggtacctttgggaatgtcataataatgcaacgtacctccttctaactacgtgataaagcattataagtatctagatttgataatatcctgatattggcatctccgaagttattgtgtttcaatagttagcattaattcgaaactaaaatgtactctgctaatgctatctgtgagaaaccactaaaatgttctgctatgattgtcagaaatatgtctttatatgttcatggagagggcaaaggtacactatgaacactactgactgagacacattatcaccccattaccatgttctggttggtgagtaagtgtcctgggaatctcagaagagaaagaggtcctgtgccatcctctccaatatgactatgagttaaggtcatagcaatcaggacttgaaatctaccacgaggggctataagccggttcgtaatttgacagctgctgcatattaaatctaatatcaagagccaaacagtatttctaatcaagtaaatggatgactttttcccttgaaacagaaaaagaagttctgtaaacatgtgtttgaaggacacagaaaaagagagagagagacagaataaattaggccaaaagatatatgaactgttaaagcttgcaattaagacacttgttcttgattatttaaagaaatgagttcagttccatcaacactgaccgagtgccttacatgcccgtgataggcactgtggcaggtcctactaatgcagacacaatgcaggcatcagtgctctattagtccaatggtcatgtgaaaggtaagctatatagttaaaatcaccagatccaagtggaagaaggctgtgacttattcacctcgctattttaataaagaactacattttaacaaacatttaattaaaatgtttttataagaacataacataagcacacagtagcatttattcttatttttgcttttttgagatggagtctcactctgttacccacgctggagtacagtggcgcaatctcggctcattcaacctctgcctcctgggttcaggcaattctcctgcctcagcctcccaagtagctgggattacaggcatgcaccaccacattcagctaatttttgtgtttttagtagagacagggtttcactatgttggccaggctggtctcgaactcccaaccccaggtgatctgcccacctaggcctcccaaagcactgggattacaggtgtgagccaccacgcccagcccacagtagcatttattaaaacctggggttacagttgtcactgacataaagactagtctcacttcttgacctggtagcaactatcaaaaataaaacatagagtctcgggaacaaatggtagtccttcccccttacagaacaatggcaataaatatatttatgataatataatagtcataatgaaaataaacattactgtgttgttatgcaaagaataggttaatctgatgattatacatgcataatatgtgattaaatataagcataatagactatcagttaggttgcagtgatttacctttaagaatatcaaaataaacctccttgatgattacaaaatgactttcctcataaagaagcacagaaagaaagtaatcttgactagcaaaatgaaagctttactcatttgaattatcatgcagaataaagggagagaaaaatgtatctatgttgcaaggagattatacatctttcataacttggctctcaataatacaaataactagaaattttcatattttctttgggaaaaaagttacatatcaacataaccatacttgaactaagtgagtttttgagttttttttttttttttagatggagtctcaatctgtcacccaagctagagtgcagtggcactatcttggctcactgcaacctccgcttcctgggttcaagcaattctcctacctcagcctcccaagtatctgggattataggtgcatgccgccatccctaactaatttttgtatttttagtaaagacagggtttcaccatgttggccaggctggtcttgaactcctgacctcaagtgatctgcctgcctcagcctcccagagtgctgggattagaggtgtgcaccgcggcgcccaccggaacaaagtgagttttgctgtgagaaaggccaaatttcagtaagaaataggatgatcagaatgtaatattcctcacattaacaaaaaaaaaaagcaaacaatattaaactaggatttctaaaaaacaactgagtttcccaggaaatgggaacttcataacactgtccagccaggtgggcactatgtccaggcagtgtccctgtgctttgtgcggtcctgctttgctttattagagcagagctcatttttcttttttttggagacggagtctggctcagtcgcccaggctggagtgcagtggcgccatctcggctcactgcaacctccacctcccaggttcacaccattctcttgcctcagcctcccgagtagctgggactacaggcgcccgccaccacgcccgggtaattttttgtatttttagtagagactgggtttcaccgtgttagccaggatggtctcgatctcctgacctcgtgatccacctgcctcagcctcccaaagtgctgggattacaggcgtgagccaccgcgcccggcccagagctcatttttcatcaccattaacgtacagtgccataaagaaagcttctgggtggcacctggcacacggtgggtgcgcagtaagttgcagctgtcattaccgtcactatgagtgtggaccggatgaaagctgaggtcaccatcctctcactctcttccactcccaccagctctcctccccctgcaaagcaccccacctttgggcaccatggctcatcaatcttgtactgttatgctccagctgaaattctgggatttctgacaaactgtatgactgtgatgttttatcttattacaaattttagtgttctttacatagtcccttatgccataaagcaacacaaacacatacccttgagatagttcacatggggtcatacctacgcagattttaaaaataccaccactagacttttttgcctttttctcctttgtttcattgtaaatatcttcaatctctctctctctctcaaaaatacaaaaatgttacaagaaatttaaaaaaaataacactgatagctcctaccatccataaacagatatattcgtattttgctttctttcttcccagtatttttcttcctcattcacacttctgggaaaagaaaggatagtgactgtatgtttaaacagctgtactcataagtacactttttttttgtcttccctttttaaacatttaactttaaatttaacttttaaaatttaatatgtgttttttctgtgtttcagattatttgcaacgcattcaaaacacatcttttcatggtgtaaccgaataataatgaatgtggctctaagccttcccagatactcataacagcaacatttatattaaaagtagagatacacttaggcttattgttgatatttgcatttgtattctcaatactttcgaccattactagaaatctggtcttgcaactctgtttgttttctcactttaaaacctccctggccattataaacatatattcacatattgctttatgtttttgtttctgtcatggtaatactgtacttgacatttgtatctccaacagcatctggcacagtattgtgcacacagtaggcattaagtaagcactttaaaaactgaactcacttaagggatttcaataaaagggctaactcgttggaaattaaataatttgtgaatgagacaccaagtaaatgtattagtcactttctgacttgatataattttcacgtaagatgtgtgtgtgtgcatgtaaacacatgtgagcttatctccaaaagtgccagatgtctttatctttcttctcctttcctttaaaataaaatttatatgtttttaatagcaaagtaataaatgctcattatggaatttttcatatatatggacaaaaaaggacttttcattgttcatgtctaatagtaatatattttaggaataatactaaccttctgagaccataaaatttccattcagattatttttccaaatgaaaagaaagtatctgagagaaaaattttaaatacctgctgataaacatactaaacgaaaagcaaaagtaatgaccttaattccaactttgtatcaaccttaatctatctgcaaagttagccatctttcttttttttattaagatagtgaaccaataaagcagaaaacaagtggctagtacaacatatttcaaagcatccattgatcttgcggctttcttgccactttccatctgaatcttctgtccaccagtcttgaatgggattgcaacctaaatcagtttcactaaagcccacatcacacatagacagctggctctagtcttaatgaagactaatgaaaacaatgaaagccacaatgaaacccgtaagaaacactgacataacctacagactcatcaagctttcatcagtactctggaatacttttttattatgagtgaattggtgaaaaaacaaaacaaaaacaaaacaccgccatgacccggcacagacgcaacgtgtcacttaggagcacatactctgggcacacaacagcctcatgatgatcattctggcaacgtgggaatggctggccccacagactatcctctccaggcctcgtatcaactagcctctcagcttgggagctactctagttcaaagtcaccaggtctgatgatatcatagacacaggtggtcactgtctcatggggggccctcctctgaaggaacaggagccagattcctgaatggcgcactccttcccatcaggctgtgctcaagatgcatcaggctgagattaggctacaagccccagatggttgttaggaaaccattacaaatggctccaaatttaaggatagaggcaagggacagaggtaggcaaacacagctaggaatacacaggcagaatgatactttcttttttttttgtaagtgtcacatcagaactttgtttttctttataggtacatttttgttagtatcatctaaactggccacatgtcgtgttctgctttgctaagtgctgagtatcctcttcttaatttttttaaattaaatttaaaaaatttttcacggatacataatagttgtacatatttatggtgcccatgtgatatgttgttacgtgcattgaatgtgtaatgatgaagtcagggtatttaggacatctatcacatcaagtattcttaaacgatgcaattgtaagattattcttgtgaagaaaaaaatgactaaaaggaacatttaaatggactcatgttcatctcttctgtgtactctgaaaattttaataccaaatatcacctaatatataagcttttttttccacaatcaatacaatgggtgggagggggttcaccttgaggtattgaatacattaagaatttaggttaaacttcagttaagctaactcagcagtaatttaaaatgtttctacaatgaaggataacaattttgacaattatacagcaagtgtgaaataagtaagtaataataatcctttgtaataataataatcctttgtaataataatcaaaattagtgatattctgacccacattcaaattcctatgtactgaactgctagaaaaaaaaaaaaaggcatgttaggaaaaagaagagattccaataatagcagttagtatacagcttcacagtttacaaagagtcttcaaaaccagaacctcatttttttgtttgtttgtttgttttgagatgttgtctcaccctgtctctcaggctagagtgcaatggcaccatcctggctcactgcaacctccacctcccgggttcaagagattctcctgccttggcctcccgaatagctgggattacagacactcatcaccacgcccgggtaattttgtatttgcagtagagacgaggtttcaccatgttagccagctggtctcgaactcctgacctcaagtgatttgcccgccttggcctcccaaagattacaggtgtgagccactgcagctggcccaggacctcattcttgtaacagctctgtggaataggtaggctatttataatccaattagatgtatttatctttgaactcattaaacacaatttatgaatacttgtttcagggatgcattttctggcaacctcttcagattcagctttatgatgaatatctggttacttgtccccatttgggttctgtggggatttgtacagtccagcattgtgccgatcagtattggaactgctcatcatgtacctactgacttatcacctgcctgcttccaaacaccactgcttcagaatctgcaaagagtaaaacagacacaaccaaaagaggtgtgttcactttttgccctgtacattagataaccacagactggatatatggttatttgatggagaaataaaaccaagtaggtaccctagttctcttcaaccttgacacaacagctttatgtagatgtcaacaaaaattttaaaagattcagaaggatcaaaagagtgggacatagaaaaggatcaacattaattttaaaaatatactttattataagaaaaaaataatgtgtggtgtacaagctgtaaaaggatgaaatgtaatgcgatctcagaatgtatgtcaaagatacttccaaagtcagctaacacatcacgattacaaagcccacaggacataacctttaaatcctctgaacaatcacagacatgcaaggcagggaccatttacagaaggacactacgcgaaatgatgacaaccagaccaaggagagacaagtgctgctggatacgatgtcagctaaagcattaactcttctactgtctgaatgtggaaagcaattatatacgaaacagaattaggggttaattaggaagtataagagcacagcccaggaatatagaagtaaagtcagaaagacccagaggcaagtacaatcagcaaagctatcgagggcaattgggcatctttctagaacaactggttgcatatgaaagaaacagaaaaatttaggttcactaatcaatgacaggtgaaataaactgatcatatgcaactggatggcacgtctattttgtgcttttgaaaagaacctgagaagcccttggtggaatgctacatatctggaaaacaatctatcaatatcaataatgaaagccattccatcaaacttataaactttatttatatattcctcatgtgaaactatggcatcatctctctggactttacacagtacggtttatcactgaaatctcacaatacggttccactgggttcagcaaacaaagggcctattttgtttctggaccagatctcttgccttcaagttgcttgctgggggctagatgtatgaagataatgaggctatgaaagggtgtgtaccaggagccagcgggcccagaggaagggcaactggctcaaactcaagggcagtcacacccaaaggagagtcaggatagggcagggacaggaacagcttttagcagagaaaggaaaattttggtagatattaaaaaaggctaatgtcgcttttgttaagtgtgtttctagataatttattctagaataatctaaccattaaaacactcctttgggccaggcacggtggctcacgcctggcctaacactttgggaggccaaggcagtggatcacttgaggtcaggagttcgagcccagcctggccaacatggcaaaagcccgcctctactaaaaatacgaaaaattagcctagcgtggtggcgtgcgcctgtaatcccagctactaaggaggctgaggcaggagaatcacttgaacctaggaggtggaagttgcggtcagcagagattgtaccactgcactccagcctgggcaacagggcaagactctctcaaaaacaaacaaaaaaaaaactacccctttggaagagtagtcttaaacctttttgctcaaattcttcatgaaacaattctgagaaaatcacatgccctttgcatactttaagtacaattaacagtattttatcttacatataaataattacaaaaatgtagtttagatgtaaagactgcaaattctaaataaacattttagaatctcctaaatatatccaatggatctcaattcatgatatgatatccactattattaattttaaaaatacatgaacaagttccttttaaaagtctggacattttacagccttccccttcctcttttctgtttgaagtctacttctattggattttattgtaatatattttgattcttcaaaatctttcattgttcactccatatacatttctgcaacaaaaaaatatgtatgacttgcatggtaactgaattacataggctagtttattagctagaccacttagaggaatttagtatgaatgaaatgaatatgtcatccaagttcactgttagttacagaatgttcacatgctcaaattgttcctatgatgttaattctaaaaagtacagtggtcaaagcctgaaatacttcctgatgtgactgaacatgatattttttggatattatgtagaaatacttcctttgcttttcctgtgctatagttaagctcttcctttcttagagcttattttctctctgaataatctttcagaaaatcacctgagctgggcgcggtggctcacgcctgtaatcccagcactttgggaggctgaggtgagtagatcacgaggtcaggagatcaagaccatcctggctaacacggtgaaaccccatctctactaaaaatacaaaaaattagctgggcactgtggcgggtgcctgtagtcccagctacttgggaggctgaggcaggagaatggcgtgaacctgagaggcagagcttgcagggagctgagatcgtgccactgcactccagcctgggtaacagagcgagattctgtctcaaaaaagaaaatcacctgaaacataactatgatatccctcatggcaacaaaaaattgttcctgagttttctttttttctttttcttttttctttatttttttttgagactgagtttctatcacccaacctggagtgcagtggtgcaatcttggctcactgcaacctccgcctcccgggttcaagcaatcctcctgcctcagcctcccaagtagctgggactacagatatgtgccaccacacccggctagtttttgtatttttagtagagacgggttttctccatgttggccaagctggtcttgaacccttgacctcaggtgatccacctgccgcagcctcccaaagtgctgggattacaggcgtgagccactgcgcctggcttgttcctgatttttcttgaggtttggctctaacaattacagttattgtttttttttaaatatctttagtgttgctctatttgaataattttagtgttatttttaaatagaaataataatttcactgctaatccaaaagtaaataaaaatcacttttccaaagataaaaagtaaaggagttaaggttgaacatgtgttcctctctgaactagagttctaataacacctatattatcaagtctacttacttttaacaggctccatttgagttactaatgctaatgttaatgaataaataaaaagtttacaaatagattcatacttcatagcaaagaaaataagctcattgaatattaatgtcataatcaagttgtacaatgtatacttttaacttaatccaaaatgccttcacaatttctaacaagtttgctgtagaaactcagatacatctggtgaaaaaaaaaaattccaaatttaattgcctaacactgcttgtaataataagactgtaacaagatacaaagatatcaagaagtcaagactgtagacatctcaaagcaggtcaaataacaacatattaaaacccccttttaaaaatatgtggaattctaaataacttataggcataaaaccacttattatctgcccccttcccgtgaaatttttgaaatcataagacaatggtttatcaatttttctttttcttttttgtatttccacaagtgacaactcagcaacttgtaaatgtttcacaattatgcttcaatactttaaaggtaggctgcaaatacgaaatatttctttattattttctcgctaatcatgtccattgagtgaaaggaataattgttaccatgtgatgtttcttacttcatatttactataatttgataagtagatcaatattatatttcaagtatttccattaagtgtgcaacacagatgctcaaaaggtgaaaggcaataacttcctaggcattgaaataaagcaattgtcttctctgtgactcattctttatagaaactaaagcagaaagcatatgatcaatgttcctgtagtgtgaattttctaccataaaagaaaatgcacacattttatattaatggtggaaatcaggtatctgactatcctagaatagctacccaaatctacccttttcatagaacccaataggcatttaatcttaactacagtcatattgagaggcatggttttaaaattaggacagcagagaaagcttagattctcctggcgctaaagggtgaattatttctaccaggggcccagagaaagggactgacttcccaaggaaaggaagcttcatgcatggggaatccgatccccgccacctcctacatacaagagggtcacagaatattggtgcagaaagacactatactagttccgggtttcagacacacgtgaccttcaagaaatgcagggctcctcccaagtctaaatagttatcaaaaatctaactttaggaaatgttagtgaactagttctagtaactaaaaataaacgaaccattaaagcatgctttcttttatgctactacagtatttgtgttaatttaaacttgattttttctcttaacctctatggaaatggacaaaagatacaatgttaccttatatttatatgaaatgtacgaaagttaggcaatgcttccttatttttttagaatatgtggaaaaaaataaacagggctactaggcattttctcctaggccaaacctggcaagtcgtctattttcctattctccaggataatttaacagactttaaacttttctactattttagatgtattttacgaggtggaattaaaaatgaacattgaaaatggcataactgtttcatatccttaaatatttttcccaactcttctttgaaatggttaattatgcacataaagaatagttttgattcacagatttgactctgctgtgattatatatttgaagacctttcttattatgtgtctatattgtatgaattttgcttgtaatacagtaaatacagttttgtctaattgtttcatgcctaatgtttctgacacgctatttatctgttttgaaatgcaccctccaatcttgattcttactcccaacagacatagattgaacttttatcatatacaattttactctgcacaatcttgatcactattcagtaatatgtggcaatgttaaactccataataacaaaccagggcctggtcccccacagggtgacttccactaagtcctttcaggttacaaaggaactgtcattattcctgtgattataggtaaaaataacctgcaatagaattcattcctagataatgactagtattattttacaactgtctcttttcatccagacataattttcatctagaattataatatattgagcattttcaatggtattttacaaaaaacaagtttttatctgaattaaaattaacgagcctttatctgagttaaaatagaatcacgatggaaatgaattcatttcactgtgaattaaccaacatccactgagatcaaaatcaccatctgtgttgccaaaggaagtgtaatatttgtgcatcagcattttcattttaaattttaactttcttataaatttctgagaaattgttttaatcatatcatggaagtctactatttgaagtaacaaatatatgggccccttcaggaaaaaataggctcctatgcaatcgtttttatttcttaatctactgaaagaaaaaatcttgagtttccagatttttattcatttatatactatttcaaccagccattcaacaatatttgatctgagggtctagtacatgccaggcactcacaactgtgaatacagaagtgaaaaacacagaaaaattgctcctcatggagcttacattttagaggagcttttggaagatgaaaaagataataatagcaagtaaataataattagttctataaataacagaaaatatgaagcctaagaagttcatgaaatagaaagaagttgttgcaaggctgggcacggtggctcaagcctgtaaacccagaactttgggaggtcgaggcgggcggataacctgaggccaggagtttgagaccagcctggccaacatggtgaagccctgtctctactaaaaatacaaaaattagctgggtgtggtagtgcatgcctgtaatcccagttactcgggaggctgaggcatgagaattgcttgacccgtggagacggaagttgcagtgagctgacatcacgccactgcactccaacctgggtgaaagagtgagattctgtcaccaaaaaaaaaaaaaaaaagcaattgcagaataattaaatgattaaatattaaatgattaaatgcaggccaaaggactaatcatgtgcccttccctccagacaaattacagtacgttcaagaatgtaggtatcactccttccctttctactcctatactgaaagagctttgcaagtttcacatattattttatgaggtcccagtatacatcctaaaaatgtaaaaatcttttccagtttccatttctggacatatgatcaattaaactgtaatccttcctgctacaaaacaccagaaaagctggctcggtgataagaagcattttcaaatgttgaagtcatttataaaaagaaatccccaggcagttaagaaacaatgagtggacacaaaataagagctaacccagaagataatgacacttcccctaaattggctagtcccggcaaccagtaggcttgaaagctgtgccctcaaaaggctgtggccttgatggtggaccaggaaagtccacccgacctcacaagcaggacaggttgaatttgcgtgtcttttgtccagaatctgggcaagaaaaatgtctttccagataacagaatggggttcaaattgacatactttcaggtccagacatccttaaacagaaaaaataacaacaacaacaacaacaacaaaaagcagtctcaaccaaataatacgcccggcagaggcaaactcgaaagcatgctggagaaagatcctgtcaaggcaggctgcgtgggttattcagtgacagagcccaggtgaagatgggctcacaagtgaaaacgtcagggtacacgacagcacacgtggccattcttcccgaagatgtcaatcagaatatgggcagaactctgtcagcgtaaatatgaagcagaattcacgctcactgttttatgcttgatgcctaatttcaaccatcaacaacaatagtaacaacaaaacagaaatgatgaaaagtcttctagaatatttacaaagcatatacttcactagtttctaaaggtggaaatcctaagagtcctaaaattattaattcagttaataaattcatccttgaagaaaccatgtatccaaataccaggccaggtaacaaccaatttttaaaatctatttttaattgatgtttcatttatgtacagcaaaatgtacaattcctaagtgttcagcctaataatcttttatacatttatatacccatctcatcccaacacagatcaagatgaatgctttcatcaccccaatagcttccttgtgcctctttccagtaacagcgttccctaactctcagcagtaacccctttcctgacttctatcaccaaaacgtggtgtggcctattccttaacttcatgccatcacgtggtatactcgtgttcagttcctttcaaccagcatagggttttgagttcaaccatattattgtacatatcagtagtttattttttaattacagactaataacccatgatttgattgtgccacaaattgtttattctttcttttgttaatggacatatgagatgtttccaatttggggctattatgaataaagaagatgtgaacatttttgtacaagtctttttgtggacatacacacttacatctcttaagtgtatacgtaagagtactaagtcagatcccataccccaaaacgctgttctgatttattttaatcacagatggtgatgtggtttggatccgtgtgatttggatcacccaaatctcatgttgaaatgtaatccccaattttggaagtggggccagatgggaggtgcatagatcatgggggcagtttctaatggtttagcaccatcctctcagtgttgttctcatgacagtgagtgagttatcgtgagatctcattgtttaaaagtgtgtagcccctcccccttctcactcttcctcctgctatggccatttaagatgcacctgcttccccttcgccttccaccataattgtaagtttcctgaggcctcccaagaaagagaagcctctatgcttcctgtacaacttgcagaaccataagccaattaaacttcttttctttataaattacccagtatcagacatttctttatagtagcgtaagaatggataacatagctagtatcttagtacattttctgttgccataacacaataccgcagactgggtaaattataaattacagaagtttattgggatcccagttctagaagctgagaagtccaagaacaaggcaacggcacctggtgagggcctttttgctgcatcataagatggtgaagggcacacatgtcaagagggcaaaagcatgcgcgtcagcttgggcctctcttcttctaaagccgccagtcccatcatagtggccccaccccgatgaccttatctaatcctaattaccctcccaaaggtcccacctacagtcaatatatgaatttggggatttggtttccaaaacatgaacttttgggggacacattcaaaccacggtaaatgggttttgttttagaaattcatatgtataaaagtataaagtatgtaatatttgtttaaggcttctcttactccgcatgatgatttctgaggttcatccattgttgtgtgtataattagttcgttcctctatcttgctgctgatgggcagtcttgcacaagtacttccgtggacatatgttttcgtttcttttaggttagagaggggccatgtttccctttcctcgaaccctcttcccaactttctctcataagacaatgaatttaaaatgttttctgaagtatagctaggatcttatataaaaaacaattgtacttttcatatatgagcagtacatttttatatatgaggagtacatttttatatatgaggagtacatttttatatatgaggagtatatttaaagggtgaatgctcagaaaatattaataagacacccctagattttactatacatattgcatatttatcagattttcagggaagaattgtgattccatcagtgtcatttatgaatttatcgtatctttaacaaactgcaagttttgacaaggcagtgttccaatctatcatgtgttttctcacctgaagactcatttattcaacaaatatttatcaaacatctattttgtgccaaggattgggagtacaggaacacacaaactattcactccgtagttgaagagcagagggtgtggtacagctaatacagcaggcagtcacatacatccccatgtcataaatgctaggacgggtatccccgcatggtgcccagggagcgtgcaggagagagcacctccgcgtagtcccaaagagtcagaaaagaatccagggagaaacaacctctgggagcaccctgggtcctaaaggctttagccagatgaggtggcgttgagagggagagaagagagaagagaaggcaggtaagggttgtgggatggacaaggcagaatgtttcaggcaaacagagtgtcatgaattaaaagctgggaagcaaggggaggcatcaagtcagtaggagtggagagcagcattgaaggtgagggtaatgaggggaggccacagaggtgggtgaagccagaacactgtgtcttgcatgtggttttggagaattaagagtttgttgtgaaggctccaaagagccactgaggagttggggcagcccaaatgtgtgatttggaatcatcattctcactgcagtggggacacagagcggtgtgggacaaagcaggaacaaaaagacacaaagacacattaagagtccattgtaggtatctgggttagagaagttgttggtcctgagctatcatagaagtgggctagaaagtgaaaacccatgtctattcctttacctgtcttctacaacattttcacatgcaaacaaactaaaatgtatttaatcataagaaaatcaggtaagctcttttcaaaattaaaatataagcctcaaagcaccaatgggtctcaaaagcagagagtggccttttagaaagcaatgggggaacaaagttcgcagctaaattggtgttcttggcttggcgatgcagaaagtaagaggctgcaggacggcaaccatactaagtgtgtcacatcctctccgcctggggttcttggctgacattacccatcacaaggaccgcacagggttggtccaactcccaaaccccagaagctccaggatgcattgctattatgccaacttttagttttcacacaaaacaaaggattttttcttttggttcgtggggtgtttcttatgaatgaattgtgtataactcagggaagagttccctatctgagtatattactgttgagtgacagatttctcagttgtgaattattaaggttgcagagatacctctaaaagtggcaggtaacaactaaaaaacaacagtctgcgaattcctacatattttgctactaaatgacatcagctggagccatagtcctcaggccttaactaccaaaaaagttgaggaaatacatactcgctttctcttcagcttttcccctaagccagaggttggcaaactacagcctacaaaccagatgcagcctgctattggtttctgtagagctgtgctggaacccagtcccacccgttcatttacatgttgtctttgactgcctttgcatgagagcatctgacctgagtagatgggacaaagaaccttacggcccccaaagctgaaaatatttaccacgtatcccttaccaaaacacatgcaggtccctgctctaagcgatgctgaaaaataacatctaaagtatcctgttttctaaatttactgaaacgaataacaatgatcaaacattgaaattgcaaaagaaaagttttaaattccccaaagcaacttcccatatcttctttttactgagatgtataaaattcatgagctgcttgagagagtagagcacgctggaaaccacccgcacgtgccatccacagatgggaagggctgtcacatttctgaaagggatcctgcggaagctgattaaactgttagaaaaccatttaagggagatctgccagaccccaccaacagactcagattttagaggacagatatttcagaggagtttcatgaggcatttaaaagaagttcagatccttaacactgcgaggatggataccaagcagaggctcacgaacacttttcagcagagttattaaccaagtcaacacctccctctgttgcctgacttgaatgcagagacaggtgtgtgagttcgacctgaggaccacactgcaccgcagcaattgcacctgtctgaccacagcaacctttcctctcttaacagtaaagcttcatgtactccttgtacatggcaagtacctgctttcataaatcagggcaagaaatggcaaatctatcttaatttccacctcaaaaagaatcactgagcaccgttttaaagggtctcagcactgatccccttgggtattctctgaggcacctgtggtaatccttatttgtttcgcagcctgtgctgaatgaaaaccatccaagtcaaataccttgctttcccctgtagcttcccccactcagtttgccttccagggctaagacagcatgaagcacagaatattgattggaaaagcactgcagactcttcgtaaagccagccaaattatcatctaccatatatgttcccacatgtaataagaaacctgattgattcataaattttagagcatatttctagaaattaacaaaataaaatcttttctgggtccatgtttttcccccacactcatcccctacatatgaagtctctggtgtgtcagctcgtgtgtgacagacaaacaatagccttttccccacaggccctgtttctttctctctcctttttttttttttttttaacttagaccctgccattcattttcacctctgacagtaaaaccccaggacaagattgtcacaaaaaggattatctttcagatcaatggtgaaattgatttgaaaccccactatttatcagcctccagcaaaagtgcaactggttaggaaatatgtcctttcacactcatgttatgctcagttcacccaggcagcacttcacttcatttcacataaatgcaataacctggccttttacttaaaattaagtcattttccacatagatttctatttttttgttagaatatatgcaaaatgaggattcatactccaaaattacttgcatgtatttctaatcataaagtatatatcacttgccaaaagtgatcttttcattatccttttataggtgatagagaatcctttacttctagcttaatataatagaccaggtatagatgattttttcagttaaattttctaaccctgaatatgaaggctaaaatatagactaaatggaaagctccagtaagaatagagaagattaactaactactttcatcctacttctcaatatatttttggtctcccacattgattcccatattaattcccttaccccaaaacccaagagaaaatttattcaaattaccgacaatgttacttgcctaagagttattttaaccacagagtccaatagcagtgaaattttatcaatatcaactaggtaaaataaacccagaaaacccagggtatcaattccttggtataatttaaataaattaatttaaaactaaaattctagtctgtctattcagtaattcaaaacaccctaagaactcaaaatactaaagacaactgtgtaagtgatttttaataggttgatataattcattaagaaaccaattaccacaggtaaaagttaaagaaacagtgtaagagctcttttagcaagaaatgtttacctgtatacttatatagacatatatgtgaagtactagggtaatgatttattatacccaaacagcaaataaacagctaaaaagaaaacaaatatgtcaaaatgatatattcatatcacgtggccttgtacaaacattttacaatgtctagtgtacaaattttaagttccttaagccagaaataaaagtagacaaaaatttgccaatggcttctattttaagtattcatatttaagccaactatttagactaatatgtattttctcataaaatttgactatattcagtgacaaaaattttatgtaaccaaaatgccactgaattcaaatgcagagattcaaagtttattgttaatcttagattccaaggccatacagcaaaacctttcatccaagattagatttgcatttaaaaagatcaatgtgcctacaatgaacagaatgtttgaagaagaagcaaaatagatgtgaacaaacaaattcgtagattaaccactctatcatcttttgcctctcactgaattacagatgctccttaacctatgatagggttacatcccaataaacccaataaacaaatttaaaataccctaagttgaaagtgaatttaatacacataacttacaaaatattatagcttagcacagcctaccttaaacatgcttagagcgcttagattatagcccacagttggtcaaaattatctcacacaaatcctatcttataataaagtattgaatatcttatgtaatttattgaatacgatattgaaagtgaaaaacaggatggctgtatgggtacttgaagtaacgtttgaactgaaagtgtattgctttcacaccattgagaggtcataaacttgttaagtcaaaccattgtaaaagccagggactgtctgtagttcagtcaagaaaagatgattgattggactagggatagtgatggggaagatggagagtcacagatgggaggaaaaactgacaggacttggtgatagatttgatattgacatgaggaagagagaagttgcaaggcagattcccaggtgaacagttgagcagtatagttatttattattttttgagacagtctcactctgtcaccaaggctggggtgcagtggtgcaaccttgcttcactgcaacctctgcctcctgggttcaagtgattctcctgcctcagcctcccaagtagctgggattgcatatgtcatcacggctggctattttttgtatttttagtagagccaggttttcaccatataggccaggctggtctcaaactcctggcctcaagtgattcacctaccctggcctaccaaagtgctgagattataggtgtgagccatggtgcccagcccggttatttattgaaacaaaaacactggaagaagacccagcttgggagtgggtgggtgggagaagagatcctgattttaattttacacgggtggggtttgaggtgccttttgagacatccaaatgtagaagtcacagacacaaagagatctctgggtctagactagagattgattcatgaatcatttggatactgctagttatgaatgccatggacataaatgacattggtgagagaccatctagtgagcttccaaaaaagacaggaaaacacatggccagaaaagtagaagagcttgtgtcaccaaagcctgaagaaggatgatgctggtgctggatgttgctcaggtggcactggtaaacttggtagaagtgaatactgtggagataagaggttagacaacatactaatattaggtggagacaaagcaagtgagaccagaagcacaactttacccattccagaggtgttactgccaaggtgggaagagagtcagggttgtttccaaagagagagagaaattaaatgagtttttttttttaatgggggaaacctgggtctgtttaaaaacacatggaaaacatcccactgataagatgaggctgaatataaaagaaaagggaggataatcaatagagttaactttcttaataaactagaagtgatgggatacaaagcaaagcaccagtgggagatttgccttaggatgcaaggaagcttggatgggtttaggtaggtttatttgcttggtatcaggaagatgagggagtttccatatgttacttttcatttcccatgtaaagtaggagaagagttcatctgccaagactgagcaggagtctggaaaagagaagggaagaggtatgaaactgttgttgtgaagactgggaagaaaagctgatcagagatgcctagcaagagatgggacaagcagtgctgagagctcatttgaagctggtgttcaaacattaacatagagccaatttgtcctcttgggcgtctttctccaacatcttgtggctgcacaggttgaaaggccaaatagttgggttcttccaagttttgtgtttttacagaagacagcaatgcaaagattgaaaagcaaaggtagattctaggcctactctaacacagagcataaacaatggtgttattgaagttatggaccagggagtcaggtggagaaaagaaaaagggaagactgacgtatcgggagaaaatacaggagtcaatagactggaggtcctaatgtagtcccaaaacagtcccagtgacaggggttgaaagcgtaagctggagtatgttcactggaacaggtgaatataccgacaaagtcaggacgttaatgtaggaccctgtggctcaaggacaggaaaggaagcagtgagaagatgggaggtcaaggtgtcggatgctaaatctcccaggataatgggagaggttcgagtatagacagagattacaaacaaggtgtcaactcttctgtgagcaagaaagaatgtggtgatgacacaggagactaaaacttgaatgacataaacctcaaatgatcatgttttgcaaaaggttaaaggacaaatagtcaagaagcagaaattcagagtaaaaatgtcaccaatcccaattcttggccctgggttagttggatgagaatgtaaacattcatgacttgaagggacacttccaggaaatgggaaacctcagatgtgagccaggatccagctaagaataagagaggaagttaagaacatagggaggcatgctggttatggagtggaagtctcagtagaaaaatcatgcaaaacatgtgtgggtggtcagaagagagtacacagccctttaggactgaagggacaggagggtatctactggggcatgggacaggagggtatctactggggcatgggtcagtagcacaggggagaaagtctccacgtttcctgggagtggatgagcaaaggcctcgcctctctgccagtgaggctctcttcctgagaagagacagtgtgctggcagcaagcactggttctgcaccaccatctcagcttcttcacaaagaggaccaacttccagatagaagagaaaaagaagctagaaagaaacataaaggcaacctcatcaaacccctttcatgtacagaagataaagtgcaggcccagggagcttaactgaccttctcagggtcatgcatttaggaaaggggcaggactaacttgagctcaagtcttttggtacccagaccacaaaggtttctgatattccatctcttcctgacctcgccttagactgattcactgcagacctgaagaagtaacccacgaaagtgggaattaaactggacatttgactcaaaaatatttttataaattagaaattaaacagaaaagaatagcaacttcatatagtttataatcagaagaggagtttgtggcttttaaaaggtaaaaagagtttattttacttacgatgctaaatttactcctatagttatgattcttcattgtcctgaaagtcaaatatcactaacactgatatcaaattgactgtgcattggcctcaaactgcctttttaggtaatctctcattattgtaggatcaaaatcaacattttagccaagcttcaacacaaactttggatatttaaattcttatttttaaatttacattattctttatgaaaattgactactatatttaaaacacataaaatacattaaacaaaataaaactaatgctctacaatgattttattgccacagaaatcttatttatctttgtgtaatctatttcactaggttagtaccagtgattctggcaataccctaagacagaataaatggtaggcagctgtgacatatcacaactaagcgttcttaaacgcataacacagacattaagtaaaaaacaacattagggcgattatacattaattacatggatacgttttggaacaaaagtaatttaaattgcattttccatagtgatactttgaaaattcttaccatttcatgtatgttttgaaatcatttgagatggatgaaatgtaagagaaagaacgctcttacaacaacaacaaagctcatatttacatagcatgtactctgtcaggtactgttataaatgctctgcaaatatgaactcaacccttcttcacaacaaccctgtgtgctaagcactgttgtccccatttagtgacgacaaaactgagacccagagagggtatgtaaatcatccaaggtcacacagttggttagtggtagaggcaggatcagacctcaggaggactgcctccaaaatctaggctcttcaccacatgctatggttctgtcctaagcaggattttatttgtaaaaatagctctagaaatcttactcgctaataagtttataacgaatgtgctgctacgctgttagaggtcactattccaacatggaagcaaccatgtcctgctacgattcctcaccaggctcacatattgtataatattaacaagtaacgttaaactataaaaccatttatacacaaatgaaggatttcttgtggtataatagtaaccatagcaacaaagtaagatgggtttgcaaagtgaaaagtatcctaaggcatttgatgccctcacaaaaagctttctctcaatttacaagaagatgtaaccagtaacagcaaaataatagtaaattttcaaaacagattatattgctatctagattagcaatatttcatgttagcatttttatttctaaaagaacaaggggctatattcaaattgctcccatttacatctctatagcaggaatccttaattcattcgagattttatgataaattttgactaaggtaacattttttaaaaatcatgatatgtacataggttcaatgacaaaaatatgcaattagaataaagttgtaacaatatcacatgcatcctacataagtataatgagtagaaatatatacttagcatacaggagaatcataattatctttagatttatttccctaagaaatagattttattttttgtatatcagaactgattgtgaagaataggcctcactggagaaataatgtgttgaatccttttgtaatatctattggcaaaggaactatacaattgcttaagtaaataaatattaaagactgctagtaccatatatagaattaataaagaaagaaatattaagggagggctctgcttttgctacaggggtttctcgagccttgttctcttcaatgtatatcaatgaatggataaattaaagtagcttattgcttttcaaatatttggatgatagaataagaatacaaaattcagattgctacaatgtgctgatcttattaagctgaagtttaatagaagtaactgtgctagagtttcgaaaaacaacatacaactagcagaactaaggagatttggtattaactgacaacagcttccatacaaatcaacagcttataaccattcacagagtaaatattatcacaggtgtatcaagggtgcattacactcagaaggaaggagccgctaacctaccctacactatcacatcacacctccagtacaagggcattgtatttcaagaaggacacacacactgagggacatttacaagaaaagtgccaggatgatggtggattgttaaaataatttcatgtgaggtgtgtgtcacactgagaaaggtccagttccacttgagaagtttcctgaggtcagggactgaccacatcttagttttgtcatcaataccaagtatgcagtagactcaaggtaaatgtttgttgtacaagtgaagcgattaataaatctaaatgtgcagaaaaagatacttagttatgacaagagtgtgaaaatcttcaaatacttgaaggagtgtatataaagaaatgatacagcggggcgtggtggctcacgcctgtaatcccagcactttgggaggccaaggcgggcgtatcataaggtcaggagatcgagaccatcctggctaacacggtgaaaccccgtctctactaaaaatacgaaaaaaaaaaaaattagctgggcgtggtggcgggcgcctgtagtcccagctactcgggaggctgaggcaggagaatggcgtgaacccgggaggcggagcttgcagtgagctgagatcgcgccactgcactccagcctcggagacagagtgagactccatctcaaaaaaaaaaaaaaaaaaaaaagaaatgatacaaattatttataataatagaacttaaacagaacctccataatagaaccaggaccaaagtgtggaagccacgggaaaacaaatttcaattcaaaagaccatctagtcagggctgtcctaggatggaatgttgaggttcctcatcttggaagggatcaggccggacgaaggtttagacatgttaacactggggaaaatagctttctagcgcagtggaaaccaggggcagagacatcgcggtattgaaccagatttctctcgacaagttaagatgctgacttgctgaggctctgtttggtcctagggaccagatgcagtgagccgagatcgcgccattgcactccagcctgagcaacaagagtgaaactccatctcaaaaaaaaaaaaaaaaaaaaacagcaaaaaacaaaaccaaaccaaaacgttgccttaaactgaagcatacacatcaacagcataagttcttccaggatgatgatgaaaggacaaggcataaaatggttacagtgtccccagagttacgctttccagacgcagccctaagtggtgaaaaatcgtgctcctggagctccctagggagggtgcagcttccaggagagaggctgcacctgcttctggcccacagagggcaccttgctgctcacacatttttatactactggatcattcaattgtaggtttgcaactagtctcttcccaccaacctataaccccttggaagtaaaatgtttaaaatttccactaaccctgaaattttgttactatcaaatattggtttaaaagactaaaattaataccaacaagacataccaattaatcctgacatgttgcctatgagggagatactatcattattatttccactttacagattaataaaatgcaatttagaaatataaaataacttccccatggtctctcagtttgtagcatttggactaaagctgcaggatatccaactccaaaactcaaggttcagccatgatgataagatattccttgcacttagaagcactgacattaaattaagagagagaatgaataacagcagctttaaccaaccaaccaaagtaaacctgttttttagggaatagagaataagtcttgattttttaatttaagggaatttgtgtaatacccaatgagataaatttcaatcctgtattacaatcagtttgactcatattatcttgttgacaaaccatagatttgtaataattctagaaaaatgcctctgttgtgtttcaaactcactacgtcactttacaggcagccacaggtgcagttgtttaacggtgagctgcctgtagagtataaccaagacagctgaactctcattgcagtttactgtaagcttgaagataaataactcattttgcagcaaatgcttctacctcttcaccaacaattacaatcctttagtttttcaatgtacataaagagaactcccctaagaaaaaaatgaaaaaatatacacaaattttgaaagtcatccttcctgagtaggtatccattgtaaacagaatggctgataaaatgccttacagactgaaacgcaagatgaccaagcatgaagatttaagaaataggagtaacaaaaataaaaacaccatataactaatacagtcattatctcagaaataaatgtgtattgcttagcttgaagagtcactaccaaaaaggtcaagatcttaaaagaacaggtactgttgcaatcactgagagggttccaggaaatatacagctaatatgaagaaacaaaaagaagagaaaagtcctgaggttagcaggactagtggaataaatgacaattatttaagaattctgattatgtattctgtaaattatttcttgcatttataaatactgtatttgtaggagtcaaatgattctgacaatattacttttgtcttctcctatagtaatattttaatcataaactaacacctcctaaacatgtaagagatatctgaactttttaattaattaaatcacccagttagttactaggtgagttacctgagtgcctctagggactcaggagatggcggtggcaatggcataaatgagaagggtaagtcatgagggggaagttttgtgccataaacctgtaagtgcaaaatcaggcaaagggccacattgtctgctttacatgccattttagtgtctctctaaaaaatattttcattgcccttgtaaaataatttatatatgttaacttatacatacacttcaatatatttgtgcatcaaatttcaaaagctctagaaccctgaatatatttaatgtgtgcctttaaatttgcattacacctcaaatatataaatgtcaaatatgtacatgaatttttaaaacataaaaatatttttaaggatgccctgtggtctaaatcaaataaatgttcacgaagggaaaggaaggttaggcactagactctactaggccacaacacgtatctgagctttgcctatgaagttttgaatctacaaaaacaacttatctattttccagatttgtgaactctaattgatgaaaactcaagtctgtatttttttaaaaaagaaactgaaagataactagcatagaaagagccatatacacagtttagttggttttgctactgtttatattttgaaaagcaaagattataggcaatgctccacactgtaaataacaattactctatgtctaatccatttctatgcattgagaatagaacacacagtcaagatgtgtccatggtggctttttgctttattctcaccaattaacaggtgattggatatgacagtaattagacacctcagctggaagaagatcattatgtcttaatgagaggattaaaaacaataaaaatgtgcttattgcaaaatatgagcacataccttaagtagcaatagtacaatttattttgtctccaagtttattgtgctttgtcagcccatatcaaaaaaaatttcccaccaacatgtgacttagaaaattacgcaacctaagcatacaattaacaatttttggtgagtcagttctatgttttggcttattttttttgataatgttcactagtgcttctctgacaagttacagttgccacataatattataaatgttatactggtacatttcacattcacccaaaatttcagctatatactcagcagtatacctgctatgtagttcaagataccatctcaaatttaacttcctcaatttccatgagatggattttttttttagacctgcacacagacctatgtacacccttggcaggcactcacagatgcagagtgactggaaggagcacagaaggtctctgatgcaatgcacatgccaccccagcaaggtcaaaagtctcctagcaactcttcttcgggttagagttttgtttccctaaaactgatgtttaattgcatgtgccatctgtaaaggacagtattaatagctaacacctcctcttattccaccattaattaattatcaaatgtgccagcattgagatctgctttacaggaactgaaaaatacagtgtaaaatcaggacaggatagaagagagggacgaagaacgacttgcaaaaccctacttgtcaggggacatgtgggtaaaaagttttgttcattcactcacacactctttcagtcactcattcagaaggacttactgatcacctgttatccacattggcagagtatataaattaatatttaaccaaggtaatcattctttagtcctaaaccaagaagatgctctcataaacattatgtattattgccaatttggaagtaaaacaattctatacccgtatattcaaaaccatgagctgtcacccaggaacctcctaactcatggctcttaaacctataaatattagggtatccaaatgtatccttctctccttcatttaagagacagaatagggtttccctcttttatttaaggcccatttacccatatcctctggacactacccctgaccccactgccttctgaagactttgtgcattatcccatagtagttcatggtagagtatttatttgcttgatagtaagcccgctggggacaagggagcttgcctactttattcttatttctatctctagcatctaacacaccttggcacacaatattaagtcaatcaatccttgctgaataaatagacttagcaatgtgcacaacttctgccccaccccgttgctatcactgtaattaccccattaaatgccataaatattatttataaaaagaataaaacttacactgccttccagtggtaagcatataattgttgcatgacactctatacaatgatacccccccgtaatataactcactacacagtttttacactgaaactgtatccttcttgtattataaaggtgaaatggtatatagccaagcatatctgagcaatggtatggctttttcttgctatcttctatcaatcaatttatttgtacagcacaaaattgctactcctctgaattgaagcaggagaaagccttacataatataacactattctgatacatcttgacatatacattatgtaacagtacttttcctttgctatacttcgcaatataatcgagaaatgctcttttaaagtcagcaacatcagcaggaataagacttttaaatgaagctcctaggaagacagaattctcacacttaaaaacaaagtatttattccacaggaataaatattacatgttttctgaaattgatcaactgcagtgatcaggtaacacttgcattgttaagcagtaagaatgatttcttaaaaattattatttaatgtcatggcattttaagttagatcttaaaatttttaattgataataattgtacataattatgggtacaatgtgatattttgatatatgtatacattgtagaaagattaaatcaagctaattagcatatgcatcacctcaccctacttaccattttttgttgtgagaatatttaaaatctattcttttagcagtttagaaatatataatacattatgattaatattattttttgagacggagtcacactctgtcacccagcctgaagtgcagtggtgtgatctgggctcactgcaacaaacacttcccaggttcaagctattctcccacctcagccgcccaagtagctgggattacaggcacctgccagcacacctggctaatttttgtatttttggtagagacagggtttcaccatgttggccaggctggtcttgaactcccgacctcaagtgatctgcctgctttggcctcccacagtgctgggattacaggcatgagtcaccatgcctggccatataatacattattaactatgatcagcatcccatgcaattattccttctgtctagctagctagaactttgtaccctttgaccaacatctccctatttccttccactccagcctctgcttctatgatttcagcatttttagattccacatacaagtgaaattatgcagttatctgtctttctgtgcctgacttatttcacttagtataatttttatctgaaaaataatttttttttgttatggtcctatgatgaaatataaaaccatagtaataactaacaagtaatagtactaccaggagtactaatactacttaaagtttattgagcacttactatattcaggcactttcctaaggggtttcaatgtattagtgcatttaaaactcagagcagccccagtaacacaagaataatcattatcagtatttattcttccctaggaacctgaggtgcagagatttgaaggaattttcccaggacggcagctgataagtggtagactgagggtttaaacccatgctgttagtgttaaacattattctttctttagtgtctttatactttcatgtgaataaaaataaattactattacatgcctctttctgtctgaaactgaagtcattttttaaaactgtttggagcacatttcagaataggaatgatattcaggatcagccactcaaatttcaatattttaaggaaagggtcttatgaagtgtgtattcaatcttatcaatgcatggataatggtgagctatctggcaactgccaaaatcctactactgtatgacttagaaataaacaactattttaagcgctacttggtaactatgctgccaaccagtttctacactgcctttataggaaataatgtactgtgatcaccaatgactctgtttataataaatcaaatattttataaatttatacaattatatggaaatcccagacacatttctcctttagaaaggcaagcagaaacaaatctatcccgtgttcaggaaagtaaaggttttcttcgtgagtacgctctgaatctaaataagcctcagtccaaaaagagttttactgcagactgataatcccctaggtttataataaaaatgctgacagagctttagctacagcataacaaatgaaaggccataatgttcttctgtcagaaattcctatttatttccagtgtcctaacagatgggctttactgccttgaaactcccccccaaaagttaattgcttgtctatcaaaaagataaacatcttgttttaggctttggggatattacatgtgtagagaaaaaccaatactcgagcaacacattgtgtccgaaatgcattcgcagtaagagagccatactctctcagggcatcagagtaaggaacagctggatgactccaacttcttaaaaagtacaggattctctgcatagtgacactagcatctataatacctagattttagtataccaataaggattgatttactgccacataaatgactataataactttacaaaacaaacttcaaaatgaaggtgaaactcttttagactcttgaaatagtgcctcaagcaaaatgaaccttaaacatatctaatccagtatttttcctttttttttttttttttgagatggagtctctctctgtcgccaggctggagtgcagtggtgagatctctgctcactgcaacctctgcctcccaggttcaagcgattctcctgcctcggcctcccgagtagctgggactacaggcatgcaccaccacacccggctaatttttaatttttttttttagtagagatggggtttcaccatgttggctaggacggtctccatctcttgacctcgcaatccgcccgcctcggcctcccaaagtgctggaaaactatgcgtttactactttagctagtgtacaatagcatggggatctcattctccaaagagctggtttaaatggaaaatatgtagacagcctcttaactaatgattcgcattaaaaaggaaaattatgactttaacacatgcgtattggtgccactaccagattgcacgggaaatgaacctgactgaatctggacatttttgtgttcttagaatattttacttacaaatataacagttgtataaaaagtaataatacagaagtgttggtatctatcctttcactttttccactcacacacacacacacacacacactaccgcagataggcaagcaggccgactgaagcatgttgaataaatcatacttctattcttactgttctgctgcttttttcactaagcaatgtatgatggacatctttgataaaggcctcattcattctgacgaatggacagtttccattttatacatattctacaatgcactttattagttaatgagggtatcttctctctcacaatattttttataaacagaaaggtaatatttgcacatgcattaacatacatgacattgcaatctgatatgcttaaatacatattagacataccaaaatatatcaaatacatattatttcttaactgctttgcacgtgcattctgcttgtcttctatggaagataaagaattgagggatgttatacccattccctccttctttcctattctacctcctgacttctggcatttgtattttacttttatctcctcaacaggttatcatttataacttcaagtaatatatatttaagctgtcttgttgacttatcaaccttaagtcaacatctttttcagtgaaaatgaggaactgctgcgtagacacttgattccactttttccgtgttctgccaccttctggttattgttaattacattattttttttctaacatcaagagaataatttagtctccaatgctttgtgtaaaatttgattctaaaaattaaaactcaacataagcaacatttctagcattatgactactgaatactattcattgcaaaatgtagtagtgtaattagatccttagggaagggattttcatccaacactaatgtgctgctgcataagaaagagttttgaaagtttcaggccttcatgtattatctttttattcccttttagttctccatttagtttcagttttccctttaatttatattcagctatcacttctcctgtatatcatccttttactcattttttttgggttaacacccaacacatttgcatatagatattctttttaatttttaataaagatggggtctttctatgttgttcaggctggcctccaactcctggcattaagcaatcctcctgccttagccttccaaagtgttgggatgacaggcatgagccactgtgcccagatatatattttttaccaatctttgtatttccggtgtgtatgattaaaagttgggaatagaattctatatttaaattaattttctctcaggtctttgaagacactgctttgatagcttctcggatccagtgttgttgatggaaaacataatgttagcctggttttcattcctttgcagacaatctattttagtctcattggaagcttgtggcatcttctttattttgaaatttcatcaagatatctccacatatccagctttgatccagcccgcttgccagacttttacatctgtctattgatgcctatggtaaattgagagcagcaatggccccaatttgtgcctagctttggaagagcccttcccgggttctctgggtttggccacataatttgctttggcccatgggacagtactaaaggaaagtaagtagcgacttgaaaatgcccctgccttggaaattgcactcctgctgctcttaggaatcctgctgccaagagaacaagtcgaggttagcagggtgatgaaagacacatggctcagctcctcccatcaccacaaagatcacagataacggcatgtgagttcaccttctatgagctaatcccagccaatcttccactgaccagagaaacatgagtcagttcaggtggaaacagccacactgcccacatcagaagaatcaaccagccgaatcagacacaagctaaatgaatggtctttgttttaaatcactaagttttgaagtcatgtgttacataacaaatgttaattgacatagactatttcttgagcttataaaatgttgtcatgaaactttattttctgcctttcattgtcttattattttgtattaatcagatgttggacctactgactctattcactattgcccctaactctttaatgttccatttccttatctttctgttttaagtgttcagagttaatcttcaatttatttatttattttttatttactgagacagagtcttgctctgtggcccaggctggagggcagtggcaccatctcggcttactgcagcctccatctccgggttcaattgattctcctgtctcagccttccaaggagctgggactacaggtatatgccaccacgcctagctaattgtattttttagtagagacggggcttcaccatgttggccaggcttgtcttgaactcctaacctcaagtgattcgccctcctcagcctcacaaagtgctgggattacaggcttgagccaccgcacccagcctaatcttcactttaagttgaagaaaaaaacatgtttaggcatcaacagttccctttccattatttggtttaatacatttttactgtgataatcatacttttaatttcctggaaatttcttgttttgattgttcctttttcataacagcctttacagctattatttcctttcaaattctgtttttttttttgttttgtttttttttggtagcagagtctcgctctgctccccaggcgaatttttgcatttttagtagagacggggttttgcaatgttggccaggttggtctccaacacctcgcctcaggtcatctgcccaccttggcctttcaaagtgctaggattataggggtgagccaccgtgcctggccttcctctcaaattctgctgagggtattaattagacacctttttaaaagtttctggtaatccctgaattgtacatgaatcttctggtatcggttgcccttttcattcttctaaatacagtttttccctaaatatctgattgatgattcttggatctgataatcctagttacttttctaagtgaaaaatgacattgatttgtatgggtaattcatattgtttcatctgcactgtgaaatacatgatcccaaaaggcttcttcctggaatgaaagacatgtcaacactcagaacattctgtgggtttcatgagcggaaaagcaggcaggcaggctggtgacacccatgcctgccaagacagacaagttttattttacacgtgaaatgctttatgaacctcccttttttacacgtgaaatgctttatgaaccgccctcctgaacacctttcccacttttccccaatgctcaatgtaggatttcacttcagagaaacaaaacaaaacagaaaacaaaaacaaacaaaaaaaaccttttccattgttttaatgctaccatatgagaaaagagaattaagctagtgtgttgaacctgctgacttaaactggaaacccagtcattaggcttcagcctcaacctcttttttttggatcttgttcgttagcttcttcgggtcataaatgcctcatgctgataacagaattcactcggttttatttttgagagaatacattttgagaatgattcatgtagggaataatttatgtgtgaagaataaagtttccaatatagagatcttattttaaaaattggctttttttcttaatttcagagaattgatgacactttttaaaggatttctgaaatcagtgatcacttagatgaatgttgctattatctgcacacattgctacattaaacgctccagaatttaaagttcgtttgagctttctgacactaaataatatttcgttttatttccaaacttatgaaagcaacataggcccaaaaggacagcagtatattaaaataaaataaggttattttccaatgagaatagagataaatcattttcccaaggagagttcaccaaagctagagactggccgaagaaaagtagccctcagcttcaaagatcaagctaattttaaaacacaacctatctcctgcttcatttgtcttaaatcttaaggctgttgtccaacaggtcatggcagtcaaaagaactgtcatataaaatgtacatctagtaaggccctctctatttttattttaaaacagtgattttaaaaattttggtagaataacctaattatcaaataaaagcttatagaaacccacatacctacacatatataaaaaaactgaagtacagttgttttgcttgagaaggctgaaggtgggggcagagatgcttcacagcctagcttcattcagggtcctgagataccacaaagacaccgtttttctcaaacaaaactgaaatctgccaggcatggtgtctcacacctgtaatcccagcactttgggaggccgaggtgggcggatcacctgaggtcgggaggtcgagatcagcctggctaacatggtgaaaccctgtctctactaaatatacaaaattaactgggcatggtgccgcatccctgtagtcccagctactcgggaggctgaggcaggagaatcgcttgaacccaggaggcggaggttgcagtgagctgggatcatgccactgcactccagcctgggcaacagagtgagactctgtctccacaaaaaaaaaaaaacaaaaaccaaaaactgaaatctactcttctgttacgtgaggagaacaatctgtgtctcatatttaaaatttacaagtatagatacatttttcatgaatatttattaaaaacaattaaataaaaattattccattaactcatttgtttaacatttccatgtaaccacagcaatgcaaagcactttgagagctgcatgggaggtctaagacatggtttctaatatcggagttcaaatagaaatcacatcggaagctgaagccacattgtgtggtgctcacttccacagcagacttgtacagcttgaagtatttaagcagattaactgtaaaggaaaaggaaaaatgttacttagctgcatcttaaaagactcttgggattcaaacaatctataggaggaagacagctaacacaccagcggtagagaaaacacaaacatttttgtttgttcggttttttgtagagacagggtctcctcttgaactcctggcctcaagggctcctcctgccttagcctcccaaagtgctgggattacaggtgtgagacaccatgcccagcaaggacagattttcaagaagagaacacagcagggatgtggtaacaagaggacatctgtgtaactgaagtggaaaataacatatattggagcttgaagggaaataaaattaaatacctaagtgaggaaaatacaattagtgtttcaaccatctgctaccacttcctactatgcccttccttctgggaaggctctatttcccttcttcactcaggtaaggctcttgcataagtgacttgctttggccaatgaaatggaattagatgaaatcactgtgatgtctcttctctctgtcataaggctgaacgtgctccagatagaaccagctccatcagcttctgtcgtggagtgagggcaacttcagccgtgccactgcaaactcacgatgagcgtgtaactgagcgaggaataaatcagtgttgttgaagcccctggatcaattatcactgcagctcagacaatcctcactgatacaatgcttagtaccagatgaaggatgacgttaaagtgaggactgatgtctatctagtgtaggtttataaacagttttcatttccaaacatgccttttcactcagtgactttaacatggggatgggtgatgctgaacttggtcttgtctagccttagtttacatggcggcatggcagccagtgctcatgttcaggaacctaagatgagaaggcaagtgtcttcagggtttactcaatgtcactttctcattaagacttaaccatccatttcaaattgtaaatgagtcccttcctctttttttctactctgtatctccctcccttattgtctttctccacactacttcaccaccatttgcatgtgtgtgtgtatatgtatttatgtatgtgtgtgtatcatgtatatatatgtgtgtgtgtgtgtatatatatataaacttatgtttgcaaaaacatatctaaaacttatataaaatttatctagttgcaaaaacctgaaaattaatacacatctcatagttcctttctgaaaaattatgatctctacatccccatgaagaaagtaagacaaataaacaaagcactaggaaagttactccagttacttcattagcatgaatttgcaagaaagacttcagtctgctttctttaacagataaaatatatcacagttcaggcagaccttgacttacgctaactcgacatatcttgactaatgaatgacttatttacaactgggtagagactaggaaaatccccacatatgctgccaaatacaataggtatcgctggcaaccaaatcagaaccattcccctgcctcacaaaatgatacttaggttaagtgcaatcattgattagtgcaatatttctggtagatttggggttaatctggtttttgcatgctggatggggaatttaccactgttatgttctttcatgacaaaacaaatgtgatgttttaaacaaaaacattttctaatgcatttgtgtaatgtttccatttgaaaggtagagaatgactgtgctatatttgcaaaacacaagacctctcagggacagcataatacttgcacttccaaaaagcttttcccctcaaaggaagacactgtgcccttgagaatgactctcgaattaatcatagaggaagaactttcatttataaattactactcttacatttcacagatgaaagaaacagaatactttataatatttaaaaaaactatctggatatggtggctcaggccgggtatggtggctcaggcctgtaatctagcactttggaaagccgcggagggtggatcacttgaggtcaggagttcaaaatcagcctggccaacgtggtgaagccctctctactaaaaatacaaaaaaatagctgggcctggtagtgggcgcctgtaatcccagctactttggaggctgaggcaggagaattgcttgaaagcgggaggtggaggttgcagtgagccaagatcatgccactgcactccagcctggacaacacagcgagactctgtctccaaaaaaaaaaaaaaaatttaactgagcataagatgattaaaatatagtcccttcacatgtctttaactgcattatattcaataaaatattcattttaaaatgaaaacttgaaagtaactgaccattcaaattttgaacaagctgaagaagcttcaaatagcagataattaccaatgttttaaacgtagtatgtcctggagggaatccaacatcaggataaacaaggcaaagtctctgttctacagaattcaatgcagtgctggagactgagatgcaaccacataatcctatcatctcaaactgaacttcaaggagggagtaactaactatgccctgaaaatgatggacaatttctaagagggcttgatacttgggctctgtcttgaaggatgcaaggtccttccttatgaagaatctaccatacataatagtgcagaggtgaaaagaaagcacattcaggaaacagtctgtgatggcttcacccagaatagagggcattcaatgacctggaagatgttttaagaggttattcaaaaatatttactatcaactcaatgtttgtcataggaaatgattttgtatagaaattatttccccagattgtgaagagctctacgctgcctactttggagtttattttataggtaatgaggagttatcagtggcttgtaaacaggagactggtaggatcaatttctttttctttatttaaggaaggtaactggagttggaggcgagggagactggtgaccaagagattagttaataagcaactataatgactgaggtgagagatgatgaagggtaaaatggggcagttaggcagggtgaacgcaggtgaagaaattatcaccatacacaatggtgtggcgaaacaaataggtggagagacacaagaatctgcaataacttttaagaatttataacttaaggaactgtttgggcatattaaccaataacaatggagcaactagagatgatcagtgggcagttttgaatactaggagagatgtcaagagtcatcacaggacaggttgtagttgaggccaggtcaagagtctaagatgccactgtataggatatagcagtaaaagaaagaacaggaaaacaagagacctaagcagaggaaagggagacatcaaaccactcggtatcactcgagtgatagagccaatgaacatgggctacagggagtaggacacaatgtcatgaggtcgacagaagaaaatacataaggactataacagtctttagaggtagcaataaggaagtcattggaggaaaatttgagagtttgtggggttagaagccagactgtcatgaaatcaggaatgggaaataaggcagagaaaaaaggtcgtttctgaaagttttgatgatgaagacgcagaggaaacaaggacagttggttgagggtaaggtagagttgaaaattaaggtaaagggaacttaaacataactgtatgacctaaagatggatccagttaagaaatcaatgatagaagctataattgtgaggcaaagtaagacagaaataacctcggagatgaagaaaggaggccacccttttttgagcattcaatgtgtaccagatgttttgctgtacactttcagatgcatttcctaaattagctaaatattaccaataagtaggtatcagtatccctaatccatagtcaggaaatgatggagtagaaaggtttattaaaattggaatatctcagaagtgaagatctctatgtgaaataggagacaaatcatatgttccaacagcattaggaatcaagtagtgaaaatggcagagctcccatattgaatgagaaagtgattcttggcagataagacaagaaaaaaaatattcagagtgcatggtaattattgaataataacaaaaagttaacctggaatgattgcattattttcaagcactagctcaaccataagtgtattcttatatataaggtctaatgaatgctttaatgaacaatagcttttcattttgccaaagatacaggaatatggttcaaagtaatgttacctacattaatcctcactagagtttaaccttaacccagtgaaggttaataaggttccctatttctataaggaaactgtactaaaataatgtctcgtactattttacaattattttattatgtgaaaactccatgctgggaatcactaccaaagactaatttaaaactaattatttcagcattaatctggataatgatccataatgaatgaaaaatgaataatctgacatttcaggggttccctactgccccaattcatatacaagaaaatgcttttgctatgcctttcatacatagattaaaccacaatctaaaatatcccaaagtgttgagatacttacaaattatattttagttatttatagactagaatgcataaatctaagtttcaatgctgagttaattaaggaaagtccaattttataacattatttttgcatgtggaaaaataactaatacataatgcttgaccatatggtctgttagtccttttgctaattacctacaaatcactacacaggttttacagctgctatatattattaactgtagcatgttttccccaaagattttattcctctcttcatacatttttgttttaactatgtacaaaacaagttcgtatttttaaaagagtcaattgcagaagactgaatacacaacatatatatatttaaaggaatgatgctttacatttaaattaatgttaattaattgataaaagtttcagcagaccaaaatattgaataattttcttttagtcaacattttaaaattcttcattaaagtctggtagcctacgacacgcaatgctgcagtcaggcattaaaatgttgtaataacagtttctgatatagaaagcaattagctgtttaaaaaaatgatgtatttcatataagccatatctaatttgggacatgtgctttaaacaatgttagaattaaatctgaattttgtcacagaatctagaataattattatgttttaaaagtataatgactgaatagcatgtcagagaaaatggcagaaaattaaaattgaaattgaagtatataattcccaataaaatgcttgcttctatcctcctcagaatactttcattacattctacttctttatccaattggataaactacctagctgcagtgtaaaatcctactgggccaggattatgactgattcatcacatgcgtcaactgtgcacgatggtctgcacaagtaggtgctaaaggtgtttgctgaaataaaagatccatacttttcgaatcaaacaagttcttactcttacggtgcacacattgatttaccaccttagtcatacagtaatagtgtataaaagccaaaaagattactgagtatataaaataattggtatctgaaaggcccttttaactaccaactataaattcttccctaagctttatactgtcctgccaagctaacaggttttcttcgtactaatgctgcacagatcttcagaaaagctgctatcaattactttgatttcccaggctgcccaaactgctaatggaatttagtaattagagttcttttgaaacaatcccaaatctgagcattctgcctgattacaagcagccatcgacattaacatcaatcgttgacaacgtaatatacattggatgtgccagaggtaatcattatctaaaatcctgtttctagaacatgacttctatctagtgaagaacatgtaatggggatttaagattcttctacctccaataactgattctatcatgaatcttgtatacagcattcacaatcagaagcaaagatatctttatctgtaatatttccagtcaatttcatagaaaagagccttgaattctgtcaccattttaagaggccattttgtccacatcttccctttcaccaaaaatgtaatcagatatcaatacattgtaagcatgatactgtcttacacttgtatttggaagcaggttcccaagttgatgatgagcattcagaataataaactttgcaaccagaattgctaacttgtaaagccaaaaatcaacaggaagcaaaatgagtctgaaaagcacaaaaagtaaaaaattttatagaaccatttgcccacagatcaaaaggaattttgatcaaattgactagtataactcaggaaattacagttattagtccttaagcatttccggtagaattctcatcttttccaaagcttcactcaaatacaacaggtcataagacctcacaatcttctcggaacactaatggagctgccacagtatttgaaggacatggtcatctactgtgtacaatgtttctggaggaaaataaaacttttagagcagagtcatctgtattaggtatcaatgagatgtcaggccacctcaggaatgactgttccactacagtccatgtgcactcaaatatattaaatagtctataaattcaatgtcaaaattaaattgcaactgtcaataaacacaaatagaggactggtttattacttctgttatattaaccagcttttccaactaaaaactgcaatactaactctgcgttctgcctggaattccttataagaagggtgctttaagaattgatttttagtgatgctgagcattttttcataggtttgttggtagcttgcatgtattcttttgtgaagtgcctgttcatgtcctttgcccatttttaaattttttttattgtgttttgcttcttgatttgttagattccctataaattctggatattaggcctttgtcaaatgcatagtttgtaaatatcctctgccattctgtaggttgtctctttagtctgttgataatttcttttgctgtgcaagctcagtagtttaattcagtcccacttgtttatttttgttcttgttgcaattgcttttggggacttagccaaaaaatttttcccagagccaatgttgactagagtatttcctaagttgtctttcagaattatgatagtttgaggttttacatttaatctttggtccatttttagtttttttatatagggtgaaaggcatccaggttcagtcttctgcatacagccagttaatcaacagataaatgcaaatcaaaaccacaataagataccatcttataccagtcagaatggctattattaaaaagtaaaaaaaaaaaaaaaagatgtggcaaggctgcaaacaaaaggaaacgcttatacacttacacactgttggtgggaatgtaaattagtccagccactgtggaaagcagtctggagatttctcaaagaacttaaaacagagctatcatttaacccaacaatcccattactgggtatatactcacaggaaaacaaatcattctaccaaaaagacacatgcactcacctgttcatcgctacactattcacaatagcaaagacatggaataaactcaggtgtccatcaatagtagactggataaagaaaatgtggtacatatacaccatggaatactacatagccataagaaagaatgaaatcatgtcctttgcagcaacatggatgaagctagaggccataatcctaaatgaattaatacaggaacaaaaaaaagaaatactgcacgtttcacttataagtgggaactaaacattgaacacacctggacataacaatggacactggggactatgagaaggaggagggagggaggcatgggttgaaaaactacctatcggctactatgctcactacctgggtgataggatccataccctgaactatagcataacacaatattcccatgtaacaaacctacacatgtactcctgtatctaagataaaagctaaaattaaaaatataaattaaaaaaataaataaaaagaactcacttttgtgtaactgtaataagaaacagaagtaggtagaaaagacaaaaataaaacttgaaatgatacagaaaaatatgcccaagacaaaaatccagtttgttacaataatatagcaaatgtccttagatacaaatgtaattggtaattctaatataatacaaaataatcaggctaacttctccattacaagtatattttataatcattttcctgctggaaaacataagcaaagctgaaattcaaaggatttgttcagtacaatcccttgtgaaaatattttttcatttaaaatattaaatagtgttaagtttcaatacttgtcatatttaatttatactttatgcatgtattaattttgaatgtatctttagtacatatcttttaggattcattgctattccttacaacctagatgagctataaaatcaccaggctaaacctttaaaaaaaaaaatgtaggccgggtgcggtggctcatgccttaatcccagcactttgggaggccgaggtgggtggataacttgaggtaaggagttcgagaccagcctggccgacgtggtgaaaccccatctctactaaaaatacaaaaaattagccaggcatggtggtaggtgcctgtaagcccagttatttgggaggctgaggcaggagaatcagttgaatccaggaggcggaggttgcagtgagctgagatcacaccactgcattccagcctaggtgacagagcaagactgtctcaaaaaaaaaaaaaaaaaaaaaaaaaaggatccatttagtcactgggaagggaggacttataactcctaaaactccagtttctagagaaattcaattatgtataaaaccggatttccagaacttcacacatttggctgattttctagttgagaaatcatgtgaattcacacaaacctggaggttgcagattgcctgagttttgtcccacttgctgaatgcagaggcccagtgcaccccatgactggtgtccccagaacagtctctttccgtgggaccctgaatgtgcctgggatgacagaataacatgaggtgggggaggaagggaggagagtttgtgatgtgagggatggcaggatgaagcgagggagggaggaacgtgtgtagctagatgagctaaacaagagactaacgactggaaaactatttttcaacattgccctagacattctaggtgtgagggaatttaaataatgtttaaacattaatcacttctaaataattagaagtggaaaacagtaaaggagaaatgagacagttacagagactgctaagtacatgaaaaatataccacacggtcttgtgtcaacaaaactaaccagcattttacaaaagggctccagtggggatgccatttctttaaaatagtgactcccctgaaacaaaaaagccaaagttcccagaacagcctgtgcattcacctctccatacctgggctttggctgttctccagggttggaatgcatctgcaggtgtggacatctaccctcacaggcctccctgtctaacccaggggccagcaaacattgtctgcaaagggccaggtggtaaatgtttttggctctgtggcctcctgatgctgctggtttctccctcctcctcctcttccttccccacccttaaaaaatggaaaacccaggccaggcatggtagctcacacctgtaatcccagtgctttctccaaggcacaccctgaggactcaaaccacagctgctaggaagctccctgttctgctgtttctaccatagctgtgatcacttcccacagtaaggatacagtcccatacactctcctgcctctctcctccagcatgaatgcacacttcttcaggcagagctttgatgtcttatttagcttgtatcaccagccactagtgcaatggctgacacgagaagagtgatggacatttgctgttgttgctgttattgtttttaagacggagtctcgctctgtcaccaggctgagtgcagaggcgtgatctcagctcactgcaacctccgcctcccaggttcaagagagtctcctgcctcagtctcccaagtagctgggactaaaggcacacgccaccatggccagctaatttttctatttttagtagagacggggtttcaccatgttggccagcatggtctcgatctcttgacctcatgatccatcggccccggcctcccaaagtgctgggagacatatctttatttaattaaacattcttagactccagttttctcacctgtaatattaaacatttatgttccttttaatctctaaaattccctaatttcacttttgagaagttcaaatactgtatcttacctcaagtatttaaataatgagtttaattcttaattctgcctataccaaagaacaaagtatctttttacttgacttgatttcttcctttcatgcaggacagtcctgggtgctcacaagagtcaagtttcacacacaacagctcacggggtaacagccttttatatatttttcacatgtggaaaatgaacatagacatgggtcttgagaagggtaatcaactgcattctgagctaggcattcaatttccaaaataataaatttcctctatctttagtctctgttcccttcccctctttctcattctgggtattttaccagaaaattagaagtctttaaaatcaaatcagtgcaatgaaatgtttggcttttagggtgaaatcaccaatgtgattatatggcaggatcccacatactcaaaaggttcaaatttgactttgcttgattttatatgagactgttagtgtttctgatgccatttttaccctgaaattcaaatattctccaagagtagaccttatgtcgtagctttgttaacattatttcatcttgttattaagttttcttattttattataataatattattaattttcattactctaagaaattatttcttaatttggttgacatttaggtctttcaactgtcattatgatttaagagtttgttgattctcagtggtaatcatataaaaaacagttccaaggaaaacaatttggtgatgattaacagcctctgatgattccaccaataattgtacacaggcagatctgtcacttgacacaagtgagtgcctcagtcacatgattcgcttccggtttgggggcttggtagcctggtctattttgtgtgcactgctctcaaccataatggcacgaggcatgtttggagaaaaagcctcccaaatgaaaaccattatggcatgaggcacgtttggagaaaaaggcttccaaatgaaaataactacttacaaatcatccttgggttaaggaattctgtaaaaattaaaatggttctgttctcctgagtgctgtgactgaaaagtagtggaaattataaaaattaaatattctgaaggcacttgccaaatatcagcaacagctatatattacttacatagtaatataatttgcccacaaaaaagttaatgttaaattgctctaattttcatatactcttaatcttattattggacaatacatttgttttttcttttgcaacaagtcagtagaaaaaaaaaaaatcttagtgacataaatttttgctttaagcccaacatgaaataaatagcaccaaatgtttggctaaaaatagctttgaaatttttgagccatctccacctcctgtggagcaatgtgggggagaaataaaccaaccaataaataagatctagttctgtttctaaccttcccattttacaaatgaagaaacttggcacaaagagggtaaagagatgactgaaggtaacatgccttgttaagggcatcttaatggaatatattagatgaactcaggcaaatctatgttcctgctcaagatcactagagaagttttgtttctgttctccaagttttcacattaacaaccaagagacagtgacttgtgtaaacagtgacacaaaatgcagacatttggtgaatgaaacggaaatgaaataaacacccataaagaagcaaaacaactgggcatggtggctaacagctgtaatcccagaactttgggaggcggaggcagaaggatcccttgagtccaggagttcaagaccagcttgggcaacatacagagactcagtctcatctgggaatggtggcatgcacctgtagtaagtcgggaggccgaagtgggagggctgcttgagcccaggagctcaaggctgcagtgagccatgacagtgccactgcacatcagcctggcaacggagcgagattctgtcccaaaaaaaaaaagatgtggccaggcatggtggctcacgcctgtaatcccagcactttgggaggctgaggcgggcagatcacaatgtcaggagttcaagatgagcctgaccaacatagtgaaaccccatctctactaaaaaataaaaaaaaatagccgggcgtggtggcgggtgcctataatcccagctactcgggaggctgaggcaggagaattgcttgaacccgggaggcagaggttgcagtgggccgagatcacgccgctgcactccagccctggtgacagtgcaagactccgtctgccacctcctcccacccgcccccccccccaaaaaaaagcagcagcaaaataaagttagagacatccaccatcagattgagatttcaggaggtcaaacttgcaaatacacacactggtgcatacacacaactccagctgatgaggagcacaaccaaatattgcttaccattctaaaattctaaacagtagggagagatcaaagtcttacatgagaaacccctgagcacagctgacaggagctggacatacaggtcttcagccagtacggaagcagggctcgactttgaccttcactttgagtcccatggacattccttctatccacacagaatttctagcttgaaatcaggaagaagtaaaaactttgacctcatatttgacttctgtattctcttttccctattaactctgactatcataaaatacaattaaattaaaattatatcttaattaaaacaataattttaccaaatccttgtaaatttggatcattagatgaatgagaaacttgcttttcaccatttagtttcagaacttctttaaaagtcactatttcaaattacttattcctaaatttactttgttgatactgattttcatgcattcatttccaattatggttgaataacaggaaatacaaaaatttttctgcataaaactatggccctaaagcattgaacgccaatgaatgattgaagctccttgaagaaagcatctctaaaagccctcaactgtcaatcctacaatataacgaaggcagatgacattctcagattcctttatatagtttctttcatagtttcattttttaaaaaaataaaagaaatgctgaaatgtgaagttccttttcagcatgcaatttgttctaatgataatgtaattcctctatgtaaggagttccatattatttctttttctccacactgaactgtaagacaataatattatccctatgtttattactaccccttcaactttatgaagcacaaaatgcctcctttcctgttttcttgacgtacagaattttgcttcagtaagcctaagagtttttttccctagcctgtatacgcttgttctgtgccaactcattgtaaaggagccggtttgaaagcttatcaccattaattctgtgactttccaactctgtctccctggtaacagaagcctacaattacgagacaagaacacaaaggatttgccaaattatctaaattctaatactctaacattttatacccttccgcctcccatccatgcatctattgtttttcccaagtctaaagcaatggtcttcatgttagcttctctatcttcagttttcctctggccaagtcatctaaaacacgcattccagttgaatcttttggaaaccttaggactgtcattcttccataaaaaactttcactgcgccccaaaactctcagagcaaagtacaagtacttccgtttggtattctaggatctctatgactgctaactatcccttttttttttttttttttttttttggcagagttttgctcttgttgcccatgctggagtgcaatggcatgatctcggctcactgcaacctctgcctcccgggttcaagcgattctcctgcctcggcctcccaaatagttgggattacaggcacctgccaccacacccagctaattttttatatttttagtagagacggggtttcactatgttagccaggctggtctcaaactcctgacctcaggcgatccacccacccgcctttcatacatatctctatgcttctgtgactttggccactatacgagctaggtcaagtttgccagtcttcctgtgtcttgctacttcacattgctataaacattcttaagtaaacaaagctctgttttgaattaaacatttccaaagcaaagtatttcactagcttcctgattcaccgcatgcttatccctaacaagtatgcttattccttaggattctccacagtcaatggcgccatttccccagttgctcaggcctgttaaagtacgagtttcaacaaagcaaaatcatgattcctatgtaataaaaatcatgtctcttatgtaaataaaaaatgaatgtgtgtcaaagatcttatacacttagtaattaatgaggaagccagtaagatgttaaaaccagttgaaattaaaatttgaagaggtaggtgtttaaaggcaattttacaaagtaattttatggtaagatcacctggttagatatattaataaaatgggataatgtccaacagggcaataaactataatttttaaatcatcttttccaccagatagaaattatctgtatctctactagacaaaaatctgtacattcaccccttctcctacaaggttttacaacacccaaagcaacagaaaatcaaaggtaaaagcctacactgaacggaaaaacactcagtagttgctccatttttgtttcagaaaacttttctgatattctaccccttatgattataaataatcctcaaagattatctttaaagaaaaagtctagcctcattaggtttggtctaattattcacatggatgcaaggcaacaagagtcctaatcaaacacacaggcctcgagtttgatctgaaaatctagagccttatagtattgagcaactatgaaagattaagaattttctgggtagatttttcatcagaggtctcagatttgatttttattatagtcctcatatttttttatgctgagtgtaggagactcagcccaagacgttttctccagcagattttatatatacccataaatctgggtgaattcttctcttcttgatgacttccaaattctctaaggcctctgatctggtaagaaatcataccttctgtgaagctgatgctctgtaagccaagtaccaagtgccaagccagggttcttgggagactctgtaggcactgaatccatacataactagtcttgagaacaggcttccaactaagaacttgctctttaatagggggcttttcacagctgattaaatgagaatcattctcaaatgcgatattgcttgcacaattgatgtttccaattatgctctgataaaaagagagcaagattcttattgaatcttacccaaataactatattgccaagtcaagtcacaaatcttagtaacatagctgtttctgaattctaagggatgagtgagaatgagataccactaaaaatgtttcactgcagtttaccaaagcatagtctattaaactgaggcttagagacagcttgggaaaaaggagaaagggtttcctcatacaaccataaataagagagcattccaacaacagcaacatatctaaacaaataaccacaattaaattagtctcatcagttcatttagtccttagtaattaagttttattctgctggatactgctttcataaagtatgtctgctgctggactgaaagaagtcctggaaatccttagtcactgatacagtctgcaagttgtctaagcaatacctgtttgtaaggctgtgcttgacaattccctgaaggggcaatggttcataatgctggtacaggcctttccacaggttctgaactcccctttgctaaaggtataaactctagcctgaagcttatagcaaagtcaccaggcaaacatcagaagggaaaagagctcttgcttgatggtaagactcatggcgaaggtcatattccaggaacagtattatcacagcaggcaagagtaaatttcttttttgggatagaggacataactatttcataagggtttcccctgagagagaagacatatgatggatagcagaggcactgacaatttccagggtcttctcaaaatgtgtacactctataaaatatttaaaaaaatgaataacattttacttatacaaatttaacctagtgaaggttaagcatctttcctgatttgacaactatcttcatacagttctcacaatagtttgaggtaattaagacatatggaacccatgaaacaaacccaattatttctagtattcttttacttataaagtgaaagaataatctttatgaggccccctcaaaacacaaagatagcattagatgtaaaagacattttacactgaaattttttttttctaaatttgcaatcaaattgtagaaggcaaaaatcaaagtgttgtcagaggaaatttgctcactgaattaggatggaaccatgggggcatgagaaacagtatctggttacctatttaatcaacgtggcaaacagaagaaggcacacaagtaccaggaaacttcagttctttactagtgaggaactttggctcactgaacttcgtgtttgtttacatttatttatcttgttttgtttttgtaaataatcaaggacatgataaggtccacacaaagttgagatgcagaatccttgctacttaggcagattactctgcaggtaaagaatgatcttttgtcactccatccgccctctgttaactctaaggccaatttatcattttaacatagagaagtcattttctagttttgttttaatgtgaagtttggcagtaaagttttcatgagctccttttatttttttatatcttgtgaataattctatcaaaactgaacagaatttaccaaaaaattaacacgtttcattatttctttacagattcagatattataaaaacaaggcaaatacaatttgtttcctcaaacactctatagctagctctccacactcattattctcttcatatgctggaatacactaatacttttctttgggactagtcttgttttttatttgtttttgttttcttacacaaatgcacttacacagttgtgttccttgtcataattcctccttgtgataacagtagtcctaatttttagcagatattacaacttctatttcatagacaaagctgggtgggagataactgagaactgtcatagacagcattttagcagactagcaaagctcaaaaatacacaacacataccttcctaaagccacattcatcctttttgcacattcttaaagtgacaaaaaatgaacacgtttaatgatatgatccataaaataagaaccaaaaatattaaaaaattaacatttgcttaatgttagttcttataatgttctatcttagaaattattcagggatctaaaataatactgattaattagctcaatttaattttaatccaaattttgaagttactctgggccttgaaattatgtttaagctaacattctataaaacataatcactgttataaaatcattggtcaaaactgtaattcaatatatttgaaaacatttcataatctcaaacattatttagaagtaatattatctttttggttagcaaaccaatataagtatagtagtgtcgaaaactcagactaagtagttgcttcatgagaaaaatttaaatcttatgaagaatataatatagtatattatacttaaaattgaaatatcatagaaaagttatataacttttttcttaagaaaaatgattaaaccaatctaatcaaaaattcacctcatgtgaagtcttaaattgtttcttttttagtagtttctgtaagaatattttaagtctagtacaatattaggagatactctgaattttctaaatttcttatattgaacataatttaaatatgaatatttactgaattcattgtaagacatagtatgattgaagaatataggatatggtggattgcgacattttaaattatgggtttaaaagttttgtatatccttatctattttattttctaagacctaaatattaatgcactgacacaataactaatcagaaataaaagttgacatagacataaagacaccacgggtaataagaaagaacaagcagccgggcgcggtggctggcgcctgtaatcccagcactttgggaggctgaggtgggtggatcacctgaggtcaggagtttgagactagcctgggcaacatggtgaaaccccgtctctactaaaaatataaaaattaaccaggcatggtggcgcatgcctgtaatcccagctattcaggaggctgaggcaggagaattgcctgaacccaggaggtggaggttgcagtgagccaagatcatgccactgcattccagcctgggtgacagagcaagactctgcctcaaaaaaaaaaaaaaaaaagaaagaaagaacaacaagcatatttttcactatgtgtaattattttaaatgagctgtcacattttaaatttacctagaaattagaccatttgcaggcccatttcggcggggaggcagaacgacagaaaatcatacacattttccattaatggactcttgctgtgggaaagggtgagctgtcctgaagacctctatccagtgttcataagtttatcactcacctctaataaaaagcaatcactatgtgaatttatagaaaatattaatttcatgtttatttttagcctatgaatatagtggctttcattaatatacaatgtatttttatcatttctgaaaggtttttatccagtgttttgctgaagctttttgtcttctgaagtacactaaattttcaatttaataatttagttcagttaatactcattttacttcgtgtagtaataaattattcaacttattattaccttgtggacttccataatttttcaaattgtagtcagcaacactgtctgcagcagattattaagtaaaaccatatatagaaaacatacatttaatctttcttagatactgtttcatgtcttgctaaacagcagctttggggccaagcacagacggaaattctcccaagcccagctctacctcctctctgactccaagtaggttgaacgctcccactttcagcacattcagtcttttggcaatggagatgcacaagttgcctggaatcataaaaggctcctcggcttgcctatctttctagttcccaggaccctgcctgtgctcctcctcctcctgccacccagatatggctactaagccccaccctcacagtccacaccatcctccaggcagagtgcaccccccatggaaggctctgagctggagaagcacacaccaccagtccagaccacacttggcagtagcaatcagggtcaaaggttaacatgtacttgcaggataaaaatggattctgtcttatactcagtatctaaagatagggctggtgatcaccatcactggagccatcatcactgccagcccgcacagacctaatccctccctgggagaatatgtatctgcagcctaaagtctgaagccttttcccaaagccttaaccttccataaaaaataaccgttgaatattttcagaaaggcaggcactccccacaaaaaagaacaagattcccataaatacggtggtgtatcccctagctggccctaattatagagccccaattttcttagtaaacttgtagctagctaagtaccactaggcaatgctaacctgatgccatttatgaaaaataaatttcagagatttattctgtatgtgtgtatttaaaaatctgaaagcaatacggtatactgcaaagaatatggtttggaaatcctatagatttggttgaagtccctgcactgacactaaatagctgtatgttattggaaaactaccaaaagcttatctaagtaaggcttagaaaaaacagtcaagttattttcatgattaataagatgcatatagagaacttagcatagctcttagaatatagtaatagtcatagtttattgagcaattgctattaatattattgaataccatttcagtgtattcaacttttctttccgtggcttattaatagagtatctacttaactgcatattcaattccatgtctttatttttcatattataacattgtccatattaaaatggctttatttacaattttgttgactactattctattgaatactgacagcctaattttatgaaggtctgtgacctttgctatcttcctaacatgattctttacaggaaattacataaaatatcaaaaaaaaggaaaagaaatattgtaactattgcagcctcattcatggaaaagacagggtacccaaactaaaaatccaagggatgaaatcttcaaggacaccagctgatttttgtgcatcaagaagcaaacagtcactcagttatgcagctgagctatggcaaaccttacctgtcttacagaagacagctaagagctacaataaaagaggtcaattgcagctcttctttcatagagttttctctttcatagcatggaaaaaacaaagtcagggattccttaattatttctctgatcctataaattttttgctggcatagttgtttagctgtatgggccactacatgaaatgctaaggaagaaaaaaaaagtgctttttgaaatactcaaaaattgtcttttgaaaactaaattgtgctttcaaggaaaaagtattcacataaaagtaataatcaacaaatcggatataactgatgagattgtttgatagccaccttgcttctattcacgtactctacgtgtcttctcaaaagactcccaccaaaccccattcttgtcatttccagaatgaaaggagacaaattctgaccctgagccacagtgcataaactttctcttttttttttttttttttttttttgagacagagtcttgctctgtcgcccaggctggagtgcagtggcaagatctcagctcactgcaagctccacctcctgggttcatgccactctcctgcctcagcctccccagtagctgggacttcaggcgcctgccaccacgcctggctaattttttgtatttttagtagagacggtttcaccgtgttagccaggatggtctcgatctcctgacctcgtaaaccgcccgcctcggcctcccaaagtgctgggattacaggtgtgagccaccacacccggcctaaactttctaaagcagattccagttttcccaggtaaaatcacacaaagaaaccaaacatataaaataaataaaaggtttttaaaattaaaatacaaagtttttttttttattttttcatagacagagtctctctcttctgcccaggctagagtgcagtggtgtaatcatagctcactgtggccttgacaccctgggctccagggatcctcccacttcagcatcctgagtagctaggactacagatacatgtcaccatgcttggctaatttttttattataaaaatttttttgtagagatgcaggtctcgatatgttgcccaggctggtctcaaactcctggcctcaagcaattctcccactttggcctcccaaactgcttggattacaggcatgagccaccatgcccagctgaatttattgtttttaaatagaaagtacacttgtgtagcacttaacattgcagatacattctgagaaatgtgtcattaggtgatttcatcattgtgagtacgttatagagtgcacttgcacagacccagctggtatagcctactacacacctaggctgtatggtagagcctcctgctcctgggctacaagctgaacagcatgttactctactgcatactgtaggcaactgtaacacacggtaagtatttgtgtacctaaacatatctagacatggagaaggtacattaaaaacacagtcttataatctcacaggaccactgtcacatatgcagtctgtcattgaccaaaacattattatgtggcacatgattgtattataagaaagaaaacaaaaatggctcataagtccacagccaaggacaaaaaatacagaagtaaaacaaatttaactaggaagctgaaaccatacataaagatacaaaataaagagtaaaagcttcttccccttccctctgagccctctccacaaaggtaaacactgagcaatttctcatcattctctctcttctagagagaaagaataataatataaataataatgtaatataatataaagagagttctctttctagaataatgttgatatattaatccaaatacatgcatcttaaaggtagtattttgctaaataaatttataaattaaatttcaaaatatttatgtgcaataagtaaatcaatgagaacaaacaatctgtttttggagaaaaaacatattaggtcagatgtcatggagggctattttagacttaacaaatcttaacactcattttatttgggtattttaatttggttacttaatattacaaaattgtgattcaaacgcatgagcagatgcactatggaaaggtcttaacagccttaaaaatctaaaatccaggaatctaagtgagaggtagttaagaaagtttggctttaaagctgaattattaataatatatagaagctacctgaatcctttactcatacttatatgtcaaacaagaactattcagggctttctggaagtattaaggtcatgtttcaccttcactttttgtggtacaattaagaaagcatgccagagtttgtagtaattcctgccactcaccaaggaagcagaaagtttgtttctgagctcagtctgatcacaacctcacaattttccctactttatattccttttcttgtctctttcctctgtcaccactttatctatcactcctctattgcaaacaatgaagaagtactttctttctagctatataagatcatgttagagctcccagtgctaggtcctagaaccatctctatatgtccacagtgcaaaaaaaaaaaaaaaaaaaaaaaaaaaagtctacggggcaaaatttgttgagtactagaaaagttcctaaatattcccccacatcacccattcccaactaattacagaaaggtcacaatttattataaatcaacaaatatctgaggaaaggtgtaaaaagacgagcgatgtaaaatggcagtattatataactctactgtattaaatatcacatgtaactacttgacaaaggaaagacagacagccttctccagcaagcttcaaaatgctctgcctaaaaaatagattttataatcacgtttttgtaatatctctctgtactgtgattttacattatactaaatgggattccaatggtcactatgtgtttaaagcatggcagcattctttctatatgcaactcctctgaggtaattaaatccttggtgttctttctttttttatttttttaagatggagtcttgctctgtttcccaagctggagtgcagtggtgccatcttgactcactgcaacctccgcccgccgggttcaagtgattctcctgcctcagcctcccgagtagctgggattacaagcatgtgccaccacacctggctaatgtttgtatttttagtagagacggggtttcaccatgttggccaggttggtctcaaactcctgacctcaagtgatccacccgcctcagcctcccaaagtgctgggattacaggcgtgagccacgacagccggccagtgttctctcttttaaatgtcatcttgacagtttgtgagtaagctccttttaccaacaggcactgatctcatagagtgtgcacaaacatacagccttatatgttatgtgttaacttagctgggctctggtgctcagttaggtcaaacactcacctagatatggctgtggaggtattttgtagacataattaccatctgcaatcagttgactttaagtaaataagtttaccctaaaaaacttgggggtcctcatctaatcagttgaaggtcatatgagcaaaaaccacgtttcttgaagagaaggaattgtgcctcaagactgcaacacaggaaccctgtctgagcttccagtctgccagcctgccgcacaaatttcagccttgccagccgccacaaccatgagccaattccttaacatatatgtatataaacatttctttctctggagaaccttgacggatacacatactaaatctccgtcaatataataatcaacaagtatttattgagtgcatttacatgccaaacactgttctagatgcaggtaatataaccatcaatgaaacagacaaaaatctctattttcatggggcttatagtttagtggtactaagatgactagcaaattgttagttaaggtaaccatataattcatcatacaatccagagcacttttaagataagggtgaaataggatactggtaatgattttgccagggcagcatgtctaacccagagccatctcgacaaaccaggatggtacacatcatctaagtctctagtgaaactgaagcccatctcccccacacgaccatgcatctggctaactgtagaaagtcaaaggtgtatgtcattaatcaaagttgaggaacagacttgtagattcagagagatttgggttccaattctcggttacacattataaaaagtattaaacttttactccagcctgggcaacagtgcaatactctgtctcaaaaaaaaaaaagtattaaacttttatgagtctcaatcatgccatttagaaatccatctaatgtgagaactaatgatacacatatgtacagcatatacagaaagaactggaacctgccagcccttcagtaaagtgcatgtaaagtaagtgattaagccgagcagggctggggattaagtggtgcactgaaaactttggtacatgaatataagtctttctctactactttatttttttaacatatgtgaatgtatgtcattggttttaacatttttgaagaaaagacagaaatctgaacattctgcctgggaattagacagcaaagtgcaccagaaatgatgaaatgatggcaaggctataatttagagcacggacatacgtgactctcaagcggccatttatcactgttaagattgctaaaagtgactttaggtttacctttaaaaagtttcatattcattaaactgaattctacaccaatatataccgaagtagaagctgccttaaaagcaggtccaacaatccttctgccctgctggaaactgttgctaggagacgagagtgaagagaacacttcctctccagtgtgaccacaggagctgcaactgctgcacaccctccacaatgcttttgaagcaggtttgaaaactctctgccggccgggcgcggtggctcacgcctgtaatcccagcactttgggaggccgaggcgggcggatcacgaggtcaggagatcgagaccatcccggctaaaaacggtgaaaccccgtctctactaaaaatacaaaaaattagccgggcgtagtggcgggcgcctgtagtcccagctacttgggaggctgaggcaggagaatggcgtgaccccgggaggcggagcttgcagtgagccgagatcccgccactgcactccagcctgggcgacagagcgagactccgtctcaaaaaaaaaaaaaaaaaagaaaactctctgcctatggctgaaacctcagagagattttaacagtctacaaagtatacagatatccctaggtatgatctcaagagtgagaaaagcttccctttgtctcctaatgtttttctccattggcttatcctagagtccaataatctttgtccattctcttggagtcttcctaacaaagatataaaattaagggaactcacagtgaagatgatctattaattctgtgggaggaaggatgaggttactcacatgtaaggacagcatgggtgtgacaactgtttcagaaagcaaagtcccaaatgccccaaaattgtatttatgttcttttgtttgctggtggagagaatgtgagggaatgagaggtcgagaagatctaaggagaggaaagataagaaacacattgccttttctagataggataggccagagcaggagttcatactgaaatactttattatcctgtgagggttagtcaactgagagcaaccacaatatggctttgtttgtttgtttgtttgtttgtttaaactggaaagaaacactgtgtttccttctgattataaatgtaaggctcattacaaacctccattctcctggtacatttttcagaaaacagagaaagtgaaaatctctcaaatgacactgccactgactacattttgatgtacatcttcatcgatgttccctttgcatgatcacacatacacacgtgcacaccgtaacacacttacgtggaactctgtaagtctgaaaataagacaagttccctccatcactataactaatctatccttctgaaaaggagactccatctattcctgtcttcacttcaccagattaccaaatgctctctcaattattgcattttgaaggagaaagtagtttgaggagacacattaacctgaaacaacctcctccgtaccgaattggtaattatttcatactagttacacctcataaccacaaatattaactcctgtaaataagctttttaaggatcacttttagaaagttatactgtgctcacactgacaagatcctcaatatatgcccatgggaagaaggaaaaaagcaggcttctcaggttacgtaagtggatttagagagtgctctaactcaagcaactttaggcagtgctggtgctgacatatgtgaaaagtgtgaataaaattatttcatgataatgataaaaataatatttctaaattgctatcttttttgtatagttgattttcattcactaataaattaattgttataagtagatagttgacttttgcatctttatccctaaaatttcatatgcataatgtgggccacatacttttaaaaataatactcagatatttagcattaccttatgtcgagatttctcaccctcagtactactgacattttgggtcagacagttctttgtcattgaggtagtcctatgacttgtagaatgctcagcagcttaccagacttctgcccactggatgccagtagcacccctcaatgtaacagccccaaatttcttcagatatcatcaatgtccactggtggcaaaaccgccccagttgatctttatatttagggtcacctcatatttgggcatacgtggtgtctagcttgcctttacaaagctggatcctaaggacacaattttataacctgctcttccagctgactgatatgtcatagcgatcttctcagctcattatgtacatactttcagtgtgttcttaactgctgcactgtgcctcattaacaggttgtgtcacaagtgttgtatcagttaacaattgtttccaatttctcagtaccatagtctctatcatttcatatataaattcctttaaatatgttcaattagttccttatattttaagaccaatagtatccttagaattcattttaaatttagtttaaatatacctgaagtcaaaggattaaaaaaagcaatacaacacaatataaggtcaaaacaaatatattttagattgcttattatttatggtttctacccatgccactcttctattagaattgagaccagccaggtgtggtggctcatgcctataatcccagcactttgggaggctgaggtggaaagactgcttgagctcaggagttcaaaaccagcctgggcaacagctgactgacacttcctctttattaaaaaaaaataagaagaagaagaagaaaaaataaatacaaagaattgagaactaaccccccgataagatttattaaaaattccttctaaatgactaaaagctttgctttttcatcagtattctgagcatctttttcaaatacaaaagatataaaacaggcctttcagagatccatatgtaccaaaactgtatagcttctagcatcttttcctttagaaactctatgtgataattcaaaaccaaaaccaaaaatctagtcaatcaatgatttgaagatattttattactagctgtcataaacaattttaagtgaagtctttgggtttcttgctctagagaattctaactgagtttaaaagatttaaaaatcgatgattgcattgtttttggattcaggaaggatatacaaacagtttaatgagactggaaagaggtccaaagcagtttcaactgtacctatagaacttcttgaaagcatttgctaaagcaaatatgtcaagacatgaagactgattaattcagaatgggagtttgtgtttgtgtgtgtgtgtgtttgtgtgcgtgtctgtgtgtgtgtctctgtgtgtataagcacgttctttgaaatattttaaggatttttcataataattttttaaaaatcaactcataatttaataggatgttgcaaataatcttctcatagaaaatcttagaaaatttctctggaattagcgttaccttttcaatagacaaaatgggtaaataaacattattttggtaaattttgtgtatttggaatcttaggtgatagaatttgtttccagacaacctgggtctgatcctcaattccttacattcacattgaattatttatatggttatttaatttttttctgcctaagttttcccttgcataaaagacaaatcgttataatatctacttcacagtgctactgtgagaatagcagaggaaatgtttataaaaattaccttctaaaatataaagccacagtattctaactggttgccaacagtatctaaatattcttcatagtagttaaaacagattaagaattacagtgtattattcctcagtgttgagcatggccccttttttatcttagtatttataaaacaatttcaatgaataaccatttatacacatacaggcagaaacaaaaactgctttctttgttcaacaagtacctactcactggcactctttttgaaggcagagaggactttaggtacttcacataaagtaagtggttttgtatttcacattatttgagcctatcaaaaaccacatgctataggaaagaatgatcttactaaatctatttcagatataggaaaacagaagtgtcgaaagttaagagacttgtttaaagtagtgataggatcaagtctaacagtcgagcttccacatttgtgacaaactactttgctattattgtagctctccttctggcccactgtgaaaagccatgttcatacacatgtttttaacagttatcaagttatggattaagaaatatcatcctatgagatgcatattaccagtatccccatttcatacaaaggaaaactgagggatagagattaagttatttgcataaaatcacacagctgttaagtaacagtggcaggttttgaacccatgttacctgcctgaggagcccgagttcccaaccacgatttgtgccacacacattcaactggcattagataacaacaatctattttactgtatcagaatatgattaatttatctttcttcataatgataaaagattatccaatagcatcttctaaattgacatttatccttcaaaatttattttcaaatcttctgattcattcaagagaaaacaattttttaatgtttactgtattagtccattctcatgctgccagtggagacatacctgagactgggtaatttattaatgaaagatgtttgattgactcacagttccacatggctggggaggcctcaggaaacttacaatcatggcggaaggggaagcaaacacttctttctaaacaaggcggcacagcaaggagaagtgcagagtgaagtggggggggaaatccccctataaaaccataaggattatgggaactacaattcaagatgagatttggttcgggacacagccaaaccatatcatttacttaaaaaaaaaatcataatctttcaaacaaaaataatgctctagtctttttaattaaaccccaatatgattttctaacaattctgtatgcatagttataccaatgtcaattttaataattagaaaatgctattcatctttttcataaatttcatactttaattccacaaaaaataaaaatatacataatttattattacaatatattaatgattttggcattctgatctacaatatagttgttatgctttaaatatattatcacatttgtattgaataaaaccctgagctttatccgccatgaagtctataaaaaaggaaaatcacaattggattaacccatgagtatttaagaatttccttggtagttttttgattcgtaattgtattccaacactttcacaagtaaaccgtagggatttttgcctccagaaactttatctggcagcctagtataactgtgtggtcttccagaaacaatcgtgtctcctttatttttttaagcgtatatacaaagagagagtatatacaaattaacactaattagcaagtcagaaaagcatgtttttctccctagctcttatgagtgttcatatataatttgctccaaaagaaattttagtaagttacagtactgccagaattactttaatttgatggttttaacagggaaaaaaaggaattatggaaatcccctttggaattcaatcacagaaaggaaagattcaattacttggaaggtctttggcactgtgagatagatatacagaaaatgagagccacacttgggtcatcattaactgtaataccatatggcatttcctcctctgagcttctgctaccatctatttacataaaatatgagctgcaaaccaataattacaaacacacatacacacataaatgagagataactatgctgagtgaaatgtaaactgacttttaattattcattaatagtaatttagaatattaaggggcatgacacaatgttatcctcagggtccctatacaccaggaattcacctcatttcagattaacaacccagtataaaaaggcctattaggcccaaattatataaattattcttgaacagaataggtccaatatcaatctatatgattctaaatgctaatctacattcaaggactaaatggcacaaagtagagcgtacatttacaacagtaccaagcacataggtggcattcgctaacaagagcagttacagaaacattctctctactggcaacttttcagctacatatgtattaatttaagagcaagaactaattcgggatatagagaaacacaacccactctcagtacttttaagtcaaattgttgatcatcaaagattctacaatgagctttaagatccttctcaatctgtggccctacgcagccactaccaactgaatggagctggcaggcaagatggaagttatctgacattttatgatctgtgatctcatcttctcccagaaatcaggatgctagtgaatggcctcaccctccatcccattatttaagctaaaaggtgtatgtcatacttgaacctctctttcacatgtagtccacattcaatccgacaattgaattgcctttctaggcattgaatctatcccattagcactgtctctgccatagcacatgaatgcaagtctgtaattacctcctaccattctttcctgtcccctctaacccttgctcctcactgcaatgagagtattagttttgaagagcacatataatcttatgaccaccaccatcccaacacaatcctgaaacagctttacattcctcttgatcttgaacacagacctttatccttaacaagaccttccaacagctggccttccagatgtattccagcataagacatactccttccctctcccccttgacactccagccatactcctctcaatcccaggcacccaccctccaggtactctcctagcacaaagccttagttaggagctttcctcttctctctgctttgttaaacatctactttcagaactcagctacgctgtcccaggacttctactttacagatgcctgtcgtatcctgccaacttgccataagtttaattttactgacccttgaggacaggggctaaatatgtggtgggcttgttcatattatatgaacaccacctagtacatggcctagcaatggtagatgctaaacaaatcctgcttaaaagctagaatgaatgaatgaaaaaatgaatacattgatgcaattatccatagtagattattatatccttgacagagccagtgttacagaagagttggctcctaattaaacagacatattttgtatattatatatagtattctattcatttgatactattgcatttgttcagtattgcagataaattacaaattaactgcagtaataattacatgtgggtatgatcaaaatccccaaatctatattaacaaacttccttaaaatcaaagttgagtaaatttatatcaactttccatcaatatgtgttttattacattcatttaataattccaacaattactaaatttaaaaaaatacaggaaactaagcaacaaaaagttctcttaagagttttcaggacaaagaatacataatgtttcatctgctaaagtagcaccctggcatccaaaagttgtttttgccatattttcaatgataatttttaaaaattacacttggtaaattcaaatggctgaaagaaaacacctgtaataaatctttctcatggaaatccacactgaaaattagtggaagaccctccatattgtagtcagatgtgaacacccctgtcatgactcatgactgctgccatttcagtatggtctggtgtcagaatatagtagggacatgagggttccaggcctagcacaagcaccaaattactggcaaacactgtcactggaggcttgttggaggcttgtttctgcaactcaaaacctaaaatgacatctctgcctcagaggattataggaagaagatgacataggtattttagaattcttaaaaaatataatactataaaatgtcaccagaacaattctgagattttagagtcatttatgacaaggcatgcaaccagattgccaactcttgtggcaaaatcaaacctctgcatggtacaacatccccaaattccacataatttaaccagatgcacttaaaaatcactgcattgcattggtgccacagttttttgttcctatacatttcttacaatatattctactggtcttaaagaagtttgtactgagcaagcatcatatctattcaactttctttctgtagagtctagctctttatgcaaagacatacttaataaaatgcttgtgaagagtcatacaacgagataatatttactcaaaataagacaaataatattctgcactcatagccatagtaacctatgatataagaaagtgtgttagccgggcatggcggctcacgccagcactttgggagaccgacgcgggcagatcacctgaggtaaggagttcaagatcagcctagccaacatggtgaaaccccgtctctacaaatataaaaaaattagctgggcatgatggcgggtgactgtaatcccagctactagggaggctgaggcagaagaatcgcttgaacccgggaggcggaggttgcagtgagccgagacagtgccattgcactacagcctgggcgacagagtgagactctgtcaaaaaaaaaaaaaaagaaaaaaaaaagaaaaaagaaaaagaaaaagaaaacaaaagaaaaaaaaaagaaatagcctgaagatctgaacttaaatcatctacacatcccattctaagcactaactaggtacttacaatgccaatatcatataagtcatgtgaattgcaagtacaactcaagacaaactatattttaaagatatttaagaaggatttttaaatgggtgcatgtattttaaaatgttatgacatttaaaacaagtccacgtcttaccgattttttagtagtaaaaagaagaaataatacattctatcaatatatacctttggaaagaatcaagctgtaaaacactgaaaactcttcaattttcataggtaatagtggctttagggctttcaaagtataactttttatggattaatcatttgcaatctttcagactttgatcatatattatgaatgttaaatgttataatacctttcttagttacatgaattcaagcggctgttattctataattctaaatacaattcatttctggctatgcctaattttacactttatgccttttttcctttaacttaaatatgttgtttggccaacttccagctttggatttttaaggtttatattggaacaagtttcattccaatttgatttgtgacagataacattgtaagctacttttctatattgcctctgaaaaagagctatttccattcctacacagtatacagattaagaaagttaacataagtaatgtaccactataatttgaaaatattcatcttgttcacgttctctagctcttactaagagatttataatgccactgaaacaagaattgatgaattcatcactgtctgggacattttgatcataatcaataacataattttacccttaaataggatttcaattaatgcatatttttcaaagcaattttcctttaaaataaaatgggtttttgtaccatgagttattaacccattaggtgccaaaaagaaaattattctgtctctgaagttctacatcagaaaaaaaagaaatgaaaccaaactctgttctattatacatttcccacaggtacatttcataaaaaattacattattatattttcatcatggaaaatgaaaagtaatatactttcgtaaaatgatagaaccatgaaagttttattagataaaagtgaggacacccaaatgcattgctactgcttggacagagtatatttatcagcaaagaaaacattttcatctaaacaaaatttatttgtcatatcattatgaaacatcaagaacaatattaaaaaccctgtgaaacttatgccaggcatacaaaatacactctattttatgataatcctcctatcctagccatttcatccattattttcctgttctcactactagaatgttgaaagaacacagatttctctcacacacaatacaaaatagcttccttcaacaaaaataactcaaaattcaaaaattattttaaatgtatagtataatcattttattataaagaagtcaccctcatttttttaagcttcaaagcatgtcctctactttactactttctcagaaataagcctaagtattttaccccttgtttcaatcacaattagctggttcttgctaaatgattcagtccagctccttatgaaagcatgcaagaggctcacttctcacctttccttatgcagtgttctctagttctgcccactaaatctgtttcaccatcacactgtgtctttgtatgcaatttcctctgcatcttctccccttcccatgtagaaaatgtgaactgatccttcaaaataaaaaacacacactattttctcgtagagtcttctatgacccccttggataactgcttccttccctatgattccatagctatttatgcagacctctgagacagtgttcaatttgcattctaattatttatctacttgtttgtccttcctacaagagtaggaggctcctggaggtagaactcattggtccttctatcactagtaaccctcaagattcggtacctaagacattcaacaaagtaaagagatgggatgagtgattgctgtccacatggtctgttcattgatcttaaaaccgtcagccccaaagtagggacttgccaattatttagaaatgcctatctaatctttctactgtattcaacttgtgtaggagagttcaagttcctgggctgggtactcaagatgtttgattttcaaattaaagagatgaaatttatgacactaagaattctgggtgctgagcaacaacattcaactaagaaagaacaagggagggccgggtacggtgcctcacatctgtaatcctagcactttgggaggctgaggtgggcggatcacctgaggtcaggagttcaagataagcctgaccaacatggagaaaccccgtctctactaaaaatacaaaattagccaggagtggtggcgcatgcctgtagtcccagctactcaggaggctgaggcaggagaatggcttgaactcaggaggcaaaggttgcagtgagctgagatcacgccattgcactccagcctgggcaacaagaatgaaactctgtctaaaaaaaaaagaacaaggggtcagggagcaattggccaccactgacttcagtatctcaagttgagttaggaacttaaagaacaagtttctaatgtaatttctgtaaaaattctaatgcctaaaatgcagcaggaagatacagagattaaaatcaggttaaagcaaaactataaagacaagtagtaatgaggatatacaaggtgcaaagacatacagttcccacggacaatgaggttagtaggggttggtttgggagacctggcggtggccttattaggcagggtggggaaccctgagcacagaggtttctttactagaagtaaccaaacagattctaaactctgctctctaacacttgaaggttcctgtgtcctggaaatctttattcaccaaacgcagtttgttgctttgttaaatatgacagggttatggctgaagtaataatctacgcgtatctatgtatttaacatattctttagtccctcacacttttcttgaagcagaaaaaaaggcacagagaaacagttaaatgtgaggcagaaataattttttcttttaaaattaaattgtttattaaaatatatcgaggggatacaagtgcaggtttcttacatgcgtatactgtgtggcgctgaagtctgggcttttgatgtattcatcacttgaacagtgaccactgtacccagtaggtttttcaaccctcatcccctcccaccttttgtattccctaatatctattattccactatgtccatgtgtacatgtttagcccccatctgtgagaacatgcaagcttatatatatctgcaataaacatatgaatgaaggtatctttttttttttaataatttctttccctttgggtacatatccagtaatgggattgctggatcgaatgatagttctatttttagttcttacagaaatctccaaaaaggacaatctgaaacctgaaacggggcaacctgtttggaaaacagcatggagatttttttaatgaggttacttttttttttttttcttgttgagttgtttgagttccttgtagattctggatattagccctttgttggatgcatagcttgcaaattttttttccattctgtaagttgtctgtttacactgttgattgtttcttttgctgagaagaagctttttagtttaattaagttccatttatctatttttgtttatgttgcatttcattttgaagacatggtcataaattatttgcctaaacccatgtccagaagagtttttcccagtttttcttataggattttaatagtttcaggtcttacatttaaatcttcaatcaaccttgagttaatttttgcatatggtgaaaggtgtgagtccagttttcatccttctgcatatagctacccaattttcccagcaccatttattgaatagggtgtcctttctccaatgtatatctttgtcaactaggtcaaagatccattgcttataggtatgtggctttatttctggtttctctatcctgttccattaatctatgtgtgtatttttataccagtatgatgctgttttggttactatagctttgtggtataattgaaagtcaggtaatgtgatatgaggtaggaatgattctgttgcacactgtagagattttctgttccaaaggcttgggttgggggaaagggaggcagaagagcgattgaagctgaagggaaaggtgtgaaggaaccaagagccttgacaagatgaaggcagggggaagcatcttgcactgggagaacaagggagcagagtagaacccgacacccagctgctcccaaatatgcctccaccctacaaaacatcaacccattgcctgtgcacaacccaccagccgatggtcctacattccttatcagctaattcttagcagaaagccttttatatatcagggattgctcaaaaatagttcacatggattaattcttccaatgctcacaataaccctgtgaggcaggcaccattactatctcatttcacagaaaagtgtggcagggaagagttaatatcaaggccacagagactgacactcttctaagcaaggaggtgataacctgaccactgtatgtggggatgagcacgtaaggggagattttgtgctacccaggaagaaactgaacaggaaaaaaaaaaaaaggaaatttccctatgagttgggttagttgcagacatcactgtaaagtttagtaaaagccatcttgaaactgctgcatgtccagaggaaacaatcacaaaacgaagagcattttaaatattgttttaaaatgttttttaagacaggtgttaaaaattactatgattagattagaacttgcactggttccttgtagacagaaaataagtgtgtacttccaggaaaagagacgacaagaggagtaaagcaacaagttagattggggattaagtgggcttcagtttcctcacttataaaaaagagaagatagaattgaaacaaaaccaaaaacaacttctatctgaaacctacccccaactcccaagttacatgaaactaaaaagaaaagcccagactttggatggggagaatgtagctgaattcagttatttgctatactggtgaagccccacaatactttttttttcattttattttttgaatttttgaatattttatttcctctaaaaaaaaaaggtggggggatatgtgtgcagaacatgcaggtatacacgttctggtacataggtatatgtgtgccatggtggtttgctgcacctattgacctgtcctcgaagttccttcccctcaccctccaccctgcaacaggccctggtgtgtgttgttaccctgtgtccaggtgttctcaatgttcaactcccacctatgagtgggaacatgcagtgtttggttttctcttcctgtgttagtttgctgaggatgatggcttccagcttcatccatgtccctgcaaaggacacgatttcattcttttttatggctgcatagtattccatggtgtatacgtaccgcattttctttatccagtctatcactgataggtatttgggttggttccatgtctttgctattgtgaacagtgccgcaataaacatacgtgtacatatgtctttatagcagaatgatttatattcctttgggtatatacccagtaatgggattgctgggttaaatagtatttatggttctaggtccttgaggaatcaccatactgtcttccacaacggtcgaactaatttacattcctaccaccagtgtaaaagtgttcctatttctccatggcctggccagcatctattgtttcctgactttttaataattgccattctgactggcgtggcatggtatctcattgtggttttgatttgcatttctctggtgatcagtgatgttgagatttttttcatatgtttgttggctgtgaaaacttttgagaagtgtctgttcatatcctttgcccactttttgatgctgtttttttttcttgtaaatatgtttaagttccttgtaaattctgtatattagactttgtcagatgggtatactgcaaaaattttctcccattctctaggttgcctgtgcactctgatgatagtttcttttgctgtgcagaagctctttagtttaattagatcccatttgtcaatctggcttttgttgcaattgctaaaaccacatgattatctcaacagatgcagaaaaggcctttgataaaattcaacatcccctcatgttaaaaactctcaataaactagatatcgatggaacatatcttaaaataataagagctatttatgacaaacccacagccagcatcatattgaataggcaaaagctggaagcattccctttgacaaccagtacaagacaaggacgccccctctcaccactcctattcaacatagtattggaagttctggccagggcaatcaggcaagagaaagaaataaagggtattcaaatgggaagacaggaagtcaagttgtctctgtttgcagatgacatgattttatatttagaaaaccccattatctcagcccaaaaacttcttgaactgataagtaacttcagcaaagtctcaggatacaaaatcaatgtgcaaaaatcacaagaattcctttatactgacaacaggcaagcagagagacaaatcatgaatgaactcccattcacaatggctacaaagagaataaaatacctaggaacacagccaacaagggatgtgaaggacctcttcaaggggaactacaaatcactgctcagagaaataagataggacacaaacaaatggaaaaatattctaccctcatggataggaacaatcaatattgtgaaaatggccatacttcccaaagtaatttatagattcaatgctattcccataaaactgccattgacattcttcacagaattagaaaaaaactattttaaattatggaatcaaagaagaccctgtatagcctagacaatcctaagcaaaaggaacaaagttggagacatcatgctacctgacttcaaactatactacaagggtacagtaaccaaaacagcacggtactggtaccaaaatagacatacagactaatggagcagaacagagacctcagaaataacaccacacatctataaccatctgatcttcaacaaacctgacaaaaacaagcaatgggaaaaggatctcctattcagtaaatggtgctggaaaactggctcgacatatgcggaaaactgaaactggatcccttccttacacatcttatacaaaaattaattcgattgattaaagacttacttaaatttaaaacctcaaaccataaaaaccctagaagaaaatctaggcaataccattcaggacataggcatgggcaaagacttttaattattctcagtttattctcaatccagttttaagatgtctataagaaaagaggagggagtagtttttgtttctatcatgtgagatacactgtggttagaatgcggcatgctttataagtctgaggatcattataatggtatataaataacaatgagactagtgaataaatatcctggattttccactgatctggggaaaataagtaaatctgcaaagaagctataattccttggaaaacagatgtgaactaaaatatcattttttaaaaatggcattgtatatacaaatgctctgcaattacttttaagaaacaagttacaggactcaaatttcctatctccacagagcgctaagatattagtcctaggagagcgaaatgtcctggaagccaagaaaagcagagaaaataagaacataaattcaggaggtgaattaaggttgttcacatggagtaacattttataatgcttttatgtcaaaaataaatttgagattaatcattttcccacaaaaaatgttgtacaaactcccatttttaaattatgtcaaggtttaaaaatagaacactcatttttaggctatgttggtaattatgttaaagcactacagtacttcaggaaaataattaatacaatgaggtttcttggtactatgagctaccttggtatctataacctgcatattaaaatttaacaagtaagagcttataacaatcagagtttcaggacaagcaaattgactaattcttgtttccattataaacaaacattgaatttacaaggtggaatacagatgacgtattcaaatgagtttacaaagtacttaggattatgaatataaacctacattaataagaagactgaacacatcaggttactgctaaactctaattacttacaaattaatcaagtacaataaagaaaattatcatttgaaagacattcttgataatactactaagaactgtcaagcttcaattatccatgctaattcagaaagctggctaatcctaaacagtggataatttaacaattctttctattggcacagattatatttctgtgcgtgacaaatttaccttagcaatttgtttttcttagtttaatattaaaaacaagtcttgcttccttgctagatcagaatgcaaagccagccagaagattttttacaattttaaacgggttaattaccaagtatataatccacatatacagtatataaaatctaaatgctgtttaaaatattttagttaagctttcaaccacatttaataaatgcatgttaaggtatgtagattatgacaaaaatgataaaaaggatgcaaatttttttctatcactttgaaagtctgtcaaaatttaagtcatataaagtaccttgtgagttattatttcattttacagataaaactatagaaccttcaagaagtttcatgtggagtgactccattatggtaagtatattggtgtcctatatatatatttaaaatatctatcgcaaacatagatcttttgagttccctctttctcacttttctaacagaaaaatatagcatacacagggcatagtaaagaacatggatactggagcttgaatatctggattggaatctcgattcaccacttagagctgagtaaaaataggcaaattatttaacttcttagagcctcagtttcttcatctataagatggggttaatattagtacttatctcttagggttgttatgaagactaaattaaatgatacatgcaaagcagttggaacagaacctggcacatagtaaatactcaatgaatgttaggatttacatagcattaataagcacaattacttattttcaaatagataactcatagacaagagaggaaaaaaatctatttttctttaagagaagtgtcatatacatttctcaatttagcttataattatgttgattaaaacaataacaaaaatattctttgaaccattagagtaataattttcccctggtgtcaaggttaaagtaaggaagcagatatatcctcagtaaactcatcagagtatttcatcaagattttcacagttatatttagaaaatgaaaagctcataattgtaagattaaaatatgaaactttattataaaaagggcacagattttaaaagataagcagagagatttacatgagaaaagtgcagtatcacatctagtaatagtccaacatctactttaccttgtcattgttactctcccggtggaataaacagaaccatgtcacctcaggagttaatgctggccaagtgccaaaggccagcaatggcaagaaaggctgtggacagaggacctgggctatggctagaagagaatgccagagacggggaaaaactgacagggtaagagatgagacgatgaggacagaggtgctgggccagcagttgaaggagaggggagggagcaccataagtggctgtgtatgggggcgcagcagaaccatccacggtcagaccaacacagtgacaaacagccactcaagaagttcctaaagaactcaagcgttgacacaaaaggatgtgatgaacagcactcattcaggctcccactgtagcatcctgtggcctcgatgagtgggtgtggcacctggtcatgagaagtatctaataggtaggcccagggacataaagtaggaacaggaaggacagacctttcagctgtacttctttcctatatttaatggcacctgctttctaggcatttacttcattctgagagtggatgataatgatgatggtggtggccctggtggtggtggtaacgatgtatcttgacttacaatcatggtttccttcccattttgagatagacacaatgattcccgtttgagaatctgaagtaccaagacctagagaggttaaacaatttgcctaaatggcacaataagtaacaggaaagattgagttttgaaatcagtctctaaacctctaaaatccacagttttttttattataccatctactatttcccagtatacctcaccacagaaaagccaccatatcattgacctaaaagcctgaaacttctacttgtgaaacttaaaaagcatgaggacatcttttttttttaaaggaaacatgttcttatgctcttcacatctgaatagattaatagcaacaaattagaagtaaaatgattatacagacacaacatagttgaagacattaagtgttgtatcttcttgagtcacgattgcccccattaaaaaccactatgttttaaagaggactgtttatttagagatctggatggtaagctaaactttagaattaaggaattcagatttaaccctttgttacttgaatacgtttacatatatatttttaaaagcccttcctaattcaagaacgttaccccatttgcaatctctttgccagtctatgccatgacaagcctcatacacagtttccacttttatgtataccagtgactttctggatgccaataattcatacttccccaaaacagatacttgagaacatgaatcatcctagactattaaattaggagtgcactatcgatttaagaataactgacatgagctaatttgcagctattcctctggtatttggccctcagttggcactacaaagttagaatcctaaatattccaaggactggaattccataatctcttacaaatttccaatcttgtaagagattataggattgagggatggcatatttggcatcaatagaattcaaacgtctcaaatattttccaaattgaaaaagtgtccacttaaatactacacctggacaagaaattaataaatcaccaaggaaagcaaatatatcactttagaagcacatttgcaatttttaagttaaactaacagaaaccaaatttccttcctttgtgctgctaaacatttgacaaacctaaaagtatccttggtaaagtggctaataaactaacagaattaaatatcccttttgagtacaactgattacatgtatgcaagtacacactcagaactctatcaatttcaaactgctgtgaaaagtgctgaattccattctttcagggagatagaaaacatttataacagcaacagccctgcagtcacatctttttgtaactagctctaagaacgaaaaaaatctttatgacaataacaagaaaatgaattttcattttaaaaggcagtccctgtgccatcactggctgtcctgccacccagctcctctgaaggcattcagacccttcactggaatgtctcaaaaatcaatagcaatttattctctctttggaccccaagcaacaaaagtaaataatactgtcacctccagtctgcctgcagaacatggtcacaaaacagccttgccactaaaatacaaccttacgcagctctttatctatgctggcgctactgattgtattggctttcgtaggggacaaatacttcagcaaagccacacaaagaggtcaagctcttgtacctcagccagaaagaatgctgggacctgaattaaaaagaagacttgccaccacctaagcttcctgcttcaacaatgtgggttttatggaagaaaaacaagaatatttattttccaagattattaaaactaaggggaaaaatgtaagattaaatataccatatttacaattttttcctatagaatttaagaaaatcatcagatcactgaagcaattggttgaaccataatattttgcagctaaaatctataggtaggcaatttttatactgtctgataaaagtattaatccataagcaaactacgacttaagaattaaagttctactttgataatgtttaaccaagtaggtgatatcaataccattcgattgttgaagacattatatacactctggaatatataaaatggcattttgaagcaacagaaggaatactaggaataaccaagtataatcttatctatttagagaaaaaaggaaatcaagctctatatgtaacaccagaaaaccagttaatggaagaagcaggactacaatcccgtctaacattcttttcactatactgcttattgatgaaaaattacttataggcatactaaagaagagtcaggccaggcgtggtggctcatgcctgtaatcccagcactttgggaggccgaggcgggtggatcacaaggtcaggagatcgagaccatcctggccaacatggtgaaacctcgtctctactgaaaatacaaaaattagctgggtgtggtggcgcgcgcctgtagtcccagctactcacgaggctgaggcagaagaatggcttgaacccggaaggcggaggatgcagtgagccgagattgcgccactgcactccaggctggcaatagagcgagactctgtctcaaaaaaaaaaaaaaaaaagagtcaaagtcattttgatgacaataagccatcatccctcagggctacaaattactccttaagagaaaaagcaagtactttgaaacatttgtgcagtaatcaaaaattccgaaatcatagaagaatttaccagtcaatcataccagaagtatttactgaatatctgctgtgtacttctcactagtaggaaatacgaaaaatatacatacatgtttaggaaatattaaaatattgaatataaaactattaaataaaataaaatattaaatataaaaacaaaaatattaaaatattaaaaataatcagatgtcaaattgtacagtcaaagaataaatggaaatcaggcaggtgctgagaggaggagagaggggaggtaggttggatgagggacagggaggaagacaggtgacggaggcagacaccagggctgcagactgtgagtgctgggaggtgctgcggggaggatgggcctggcagagcagtggtgcccatgaagtaaagtgaagacagagagtggggccagacactggaagctccagaaatcaggcagaaggacttgaacttaatgtggtagagactccagataatatagaattaaccattttaacttggcaacatcactcctattgttttttggctcactcctagctcaaaaaaacaaaaaatacactaaagatgttgtcttattggtcagaaaaatatgacttaaaaatataacaattttttgaaccaaaaaggtgcttcctggaaatttcatttaaataacaaaaaacataccattgtgaaaaaacttcactcaaaacttacagttttctgataaaattaatatcattaagctaagggagaaaacaaatctctgaatccctcatttttattcggtaacattaaccactttggcaaaaaaaataaatgaacactaggattgggaattttgaaaaatcatgtttaacttttgtactttaaagaagatacaatgaagttgatatactctatcttctataaaactatgaggcatctaaggttaatcattaaaactgattaaatattatatttaaaaacaaatactcatttatgttttttcaaattttagaaagtttgtaaattctgtagtaaaccaaaattcttttctctttattttatgcattcattatagaaagttttgggggaaaagtgtgtgtgtgtgtgtgtgtgtgtgtgtgtgtgtatgcatgtgtatagatatacagacacacatgaataatcatgtgaaaacttatctgccagaggtctactctaatatttgttacaggcctctttctgattttaaaacaatctacagcagagatataaatattttacttatcactgtcaatacatatcaaatgtcttgaaatgactatgtcaaggtaacacagtaactacacttataagaatatatcttacagaaaagattgtggatgtggacagtggtctagcaacaggaatgttcaatgaaatattgctggaaagatgaaaatgggaaacaagtttaatagccaagagcaaagcattcaatatgtaagttataaacatattcatactttttcatttttatacatattaaatatagtcactgcccatccatttatttctcctattttcctaattttgaaaaagagttcccagaatatttgcaaattaatctgtaaacactgaatgatagtgcctgccctgaagcccacatgaggtgcttcgaggcagaaacggtgtgtagctggtgcccagaacaatgcccagaacagcacctgccacagaggacacggtcaacaagtacttaacggagtgaaaataaaaagttaactaaggatttgtaacttacactcactcactttgaaaaaaaacagaagcagtttacaacaaagtatgataaaatgtagttttcttttttaaaacagggtctggcttgcaatggcaggatcttggctcactgcaacctccacttcctgggctcacaccgtgctcccacttcagcctcccaagtagttggaactacaggcgcacaccatcatgcctagctaatttttgtattttttgtagagacagagtttcaccatgttgcccaggctgatctccaactcctgagttcaagcgatccacccacctcggcctcctaaagtgctgggattacaggcgtgagccaacacgcccagcctagattttttttaaatgtaaatcaaagtaagagaaaaaaccaaaacatccaaaccatacagaggaagatggaaaataacagaatcaggaacctgagctcatgccaacactcaatcatacgttcaaactttctgtcaagaaaggctacagcaggactgcaagtgtggcggaaggcggcagtgtttaaaatgtaaaacttcagatcaagccagcaggagtcaaagcctgatttcaccagttgttagcactgtaggactctggagaaatcaatgactttttctgggcctccttttcctcccatacagaatggagctcttatgagagcatcaccatagggttctgagattgacaccagccaatccgtgcacagtgctagttgcatggtgtcagaacacattaagagctcaatgtatgccaaatctgttatattcatcattacagctttgactgtatgcaaaagataccattcagttcttccaagctgcatttatttcatagattcaatatttattgagactaaatatttattttaaaacttggttggatgaagccccaccaatgtcttcaaaagcctaacatggaaatggaagaacagaaataccaacatataacagtgactcaggtgacatgcatagaatagagatgtactcaatgttccctgaagtaagaggaggaaatgatggattactgaggggtacggctgtggggcaatatcacattaaaagtgatgtaggaactaggacatgaaagaggagtcagagtacaaccaagtagggaataatggtattggaaagtcattccaggcagattggacaacataactaaggaaactgaggcatgggaggacacgagaagctgatggtggttgaacactgtgtgataggatgctcgtggaactgtgacagaaaacaaaatggcaacattctgttggggtcaatttttgaaggccctgttgtgcaatttggactttaacaagtaagcaaaggagagccagtttgggctgataatgacatcagtgttttagatactaggattatcatggaagacagattggatttagagagtgggaagaaagaatagaggctaaaacatcaatactccaggcaacaactaatgctaggtaataaataatacagactggaaacaagacaagacagtcgagttggaaagaaggaaacagatgccagcaatattgctgagggacagtcagaagaattagcacacaggaaagtcaaaaacgatttcatggttttgaccttatatggctagggcagtgacaaaattaattaaggatggtaacatagaggaagcacattttggggcggcagagaaagaagactttattttatttatttatttatttatttatttatttatttatgaaacggagtctggctctgttgcccggctggagtgcagtggcgcgatcttggctcactgcaacctctgcctcccaggttcaagcgaattctcctgcctcagcctccagagtagctgggattacaggcacgcaccaccacacgcctggctaatttttgtatttttagtagagatagggtttcacaacgttggccagaatggtctcgatctcttgacctcatgatcccccccgcctcggcctcccaaagtgccgggattacaggcataaaccaccacacccagcccatttttaaatagattgaatttgaggtagctctggaaaacaaggaggtgatgatattcaacagaaagatggaactaagacacagaagctcagaacgtggattgagaggtcatctgtgtaatagatgacaggcaaatttacaacaccagggaaaatttcaaggggacagcatttgaagtcagaaggaaaccaaagtaatgacacttactctatcactaaaaagtatgatatctaaaataaccagtatgcaggacttaaaacaactacaacctacactaaaagatagagagaaacactttaataaatgtagagagatactatgtgtctggatgggaagaataatttgtgtagtcatcaattctctaattaatctgtagatttaataaaattctaataaaaaactgtaatatacttttgggaagcttaatgaaattattctaaagtcatctggaaagagcatctgagaataactatttttaaaagagtaatatgaaaggcaaaactgacctagcagatattaaaacatattgtaaaaattcaataatggaatactgacttatacacaaaaagattactaggttagaaagtccagaaatagacaaaagtatgtgtaattattcaaagcataaaaacctgcaatttcaaatcagcaagaaaaaagataactttaatcttttagagaagcaacatgatgagaaagctttttcttctgagttgtgttaaggatgatggaggtcgtctaagcttttcatacttagagaggaagacactagtaacagaaatacaaaagaaagtgttcagttatcacaaagtcagaagtaaggaagttgtggattctagtgaatgtttactactggagggaatcatggaagaaaccaccaaccataatgaaatgatgccttcagaaaggaaagcgccaagaaggatgacttgacaacaatgctagagacagctcttaagaacagatgttttgatgagtttccatacccaatttattggaaatatcaaaaaaaaaatagcagaggtgaaaaaaataaaactttattgtcagagattgggcttgccaaatttaagatttctgagttgtcagttcagagaaatggcataataaatcagactgcagcagcagaaatgtctggccaggatttgggcaggtcaataacatagatttctgaagttgccaaaagaagtgcccaagaattaaggcagatggggacagggtattgaatgatagcttcctccattactgtggaggcatgacctgtggtaaacagagggagagaaaagaaagaaagagatttagctaaatattttgagcttcaactaaggtaaaaagttactgacaacagaatgtgaggctgagatatgtttttatttttctctccacagtgcctaacacacagtacacatattgtaaaagattatctaagaatggctggacgcggtggctcacgcctgtcatcccagcactttgggaggcaaggcaggtagatcattgaggccaggagtttgtgagcagcctggccaacatggtgaaaccccatctctactaaaaatacaaaagttagctgggcatggtggtgggtgcctgtaatcccagctacttgggaggctgaggcagaagaatcgcttgaacccgggaggcagaggtagcagtgggcagagacggtgcaactgcactccagcctggccaagagaggagacaacatctcaatcaaaaaaaaaaaaaaaaaaaatgacctaagaatcaatgcatgtggtaggaaatgctggaaaaaaaacactggagaacttaaagacaaccccaaattctgatcacagggcataggagataaagcagaatgagtagcagccacatgaaggcatcaaggtaagcagcatcaccaaaagaaagcctggctcagccaatgacgacaggtaaaaaggattaataaaaagacagacgggcaagggcagttcaaggaccataacagctgagctagtgatggaagacttccttttgcacctttcgaataaaattatttcattatctccacaaagattcacttccaggtacttggttattctggcctcccaccctctatatccattagtccccaccgtgaaaagcactgtggagaaaaaaaaaaaaaaaaaaaaaacactctttgcacctgaaattatcatatttaatagggaaaaaaatggaaaatattttccaactgttgtttatttctgaatttcagattttgttctcaattatactggcctggaactctgtcagaggtgaatatactcagacccatatgactgatttacactagaaagctagtctgtcgattgctagtatgtaatgcaattgtcaagctgacccacgtttgtataatacctgcatcaactcaggaggtgttggctagcttgcaaattttctttgaaaaagcgcttacctaggcaaaggacaacgtattttttgaaagctctattgaggtctgacacacaataaatcacatatatttaatgtgtacaatttgacatatttggacatatacatatacccataaaaccattacaacaatcgagataatgagtacatcacccccagtagattcttcctcccactttgtaatctcttccttctgcctctccctgacatcctcccaccctccactcacccatttgaattacagattagtttgcattttctggaatttatacaagtcaaatcacacagtttatattcttttgtctggtttctttccttccacacaatgattttgaaaatcatttcatgctgttgcatgtatcaataattcccttttattgttaaatagtattccattgtatagtatacaccaatttgtataaccattcacctgttgatggttattggagttattttcagtctttgtctattacaaataaagctgctatggatacttgtatgtgagtctttgcatgaacatatgttttcatttctttggggtaaatgtctaaaagtagaatggctatgtcataaggcagctgtatatttcactatataagacactgccatactttttcccaaagtggtttctccattttccattcccatctgtcatgtatgagatttccagttactctgtatcctcacccgtacttggcatctttcaaatttcagaattctaataggtgtataatagcatttcattgtggcttcaacttacatttccccaatgactaataatgttgggggtatctttgcatgtgtttacttgtcatctgtatactatctttggggaagtaactgttcagatctattgtctatgttttattgggttgttttagtatttattgagttttgagagttctttaaatagtctaaatataactccttttatcagatatgtaatttgcaaatatgtttctccaagtcctgacttgtcttttcattcttttatcaatgtggttttttactcgtttgttttttgagatggagtctctctccgtcacccaggctagaatgcagtggtgcgatcttggctcactgcaacctctgcctcctaaattcaagcaattctcctgcctcagcctcctgagtagctgggattagaggtgcccagcaccatgctcagttaaatttttgtatttttagtagagacagggtttcaccacgttggccaggctggtcttgaactcctgacctcaggtgacctgcctgccttggcctcccaaagtgcgggattacagacgtgagccactgtgcctggcctttatttatttatttatttatttatttatttatttatgaatgaatgagacagtttcgccctgttgcccaggctggagtgcaatggtgcaatctcgcctcactgcaacctccacctcccgggttcaagtgattctcctgcctcagcctcccgagcagctgggattacaggcaccctccaatgtgcctggataatttttttctgtacttttagtagagatgggatttcaccatattggccaggctggtcttggactcctgacctcaagtgatccgcccacctcggcctcccaaaatgctagaattacaggtgtgagccaatgcacacagcaaggtgttttgaagagccgaatttcttagtgttgatgaaatccagtttataaattgttttatttatgaatcctgctcttggtattatatctaagaaatctttgactatttcaaggtcatgaagattgtcatttggaagtcttatagttttaacatttaagtctattgtttgaaaaaggacattttttctaaatatgtcttaactgacatattactgacagaagtaagtaaccacacctattaatgaagttgcagcatcagcatctcaactattctgggagacaatgtaggccaaatgttccctgatattatgttgataataaccccttctcaaaagggcgaatactttacttcagtatcaataccaaggaaggaaaaactgtggtgtgagagttctgctccctgggtgccctctctattttgcctctgacccatgaaactttaaaaatgaagattatgaggaagaacaggccagtgaggtcagagtcatgggttaaagccttagggtcagcagtctgaggatcttcattttaaattttcccctactgtaactcccttgctcattgtttgggtatatttcctattcaatgttaatgttaaaatatcactgccatcttgttttttctctttttgtttctgatcctatttcctttcattaaaatgttattttctgttttcccaaaattattaaatacatataacacattttcttttcttcctcaaatattattaagtatagatacatatacacttaatatatacttaattaagcatatatatactaaataatatttgaggaagaaaagaaatatatgtttatatgtactatgtacatgtatgtgtgtatatacagatacatatatacttaatatatacttaattaagcatatatacttaatatttgaggaagaaaatacagatatatttatatgtactgtatgtgtgtgtatatatatatttaatatttgagaaacaaattaaaaaacatatatactatatatatgtacacacatacaggtcatgagatcaagattattgtcatagaatccaaatctagctagaaaacacaaaatttaattcccactgcaattttaaccccacagatgagccttgataaagtaatgagagagcaataagtagcttatcttttagaggtaccagatctgtttctagtcctaaggcatttcagtagaatgcttatttcaataaactcacttaatgcaaaagataagatcataaaggcttgtaaatcaattttttttaaaaactaaaacataaattcactagtggagctcactatttaggtaataactctattgaaaacacttttatagagtaaataatcactccttctcataaattcaggtttacatctgtaggctttctttaaagcaatcttcagtgaatcattttctgaccactgtgtccaaaataattttttaacactgcacaaaaggagatatttaatataaactgttttccgaattgtccttattattgttttcacagcagccacaatgtgattaatattggaaaaggcaccattatattcaagcctcactttcaagtagataatattttaaaacataagacacaaataaaacaaagttattgcaaaaagttggcaaaatatagaaaatctctcgtttggcctctcactttcacacgtgtttttgaaaaagattccaggaagactcctctgtgctcaacagcacagaacagcacatgcactctgtttccttttcttcatgaaaaatcgtaagaatgtggaagaaaaatagtttattagcaaaaaatgcagaaatgtaccaaagaaaaattcttttgtaggacttctaactctataagttattaaaatagatacaactcaggaaaaatttatcatgaaatcaaatatgacagaaattaaagaaaacttaaaggtgtgttggatgcctgaagttggtgttgggtgatgaaattgaggcaggagaatagagtctggaggcagggaacctaaagctgtttcacactgacttcctaaaactaaattgaaaggaaaaccctaactttccacacctaagtaacaaaaggaccagagactactccctttgcaaacccccaccttgtctgcatggtagatgggaaatttaaagttacataggagtgtgacctttgtaacttttcccttcagcccctgattactgtctacagccaatcaaaatgattgtgggccaagccttcatttgcatagaagtgcaactttgaaactttagcctctgattgattgcataaagcataaagcaatcaatcagatgtttgcacaggtgtgtgacctttgtaacttcatttcagcctctgaatggtcgttttccaaggtgaacaccaagtggccaatgggaaacctctagggggtatttggacccaagaatattctctatttgggtccaaatagacccaactcccacccgctcccaccctgtggagtgtaattttgttttcaataaatctctgcttttgttgcttcattctttcctttctttgtttgtgcattttgtccaattctttgctcaaaatgccaagaacctggacactcgccactggtaacaaaatgaatatttttatatgtgacagtattttagaaaataatgtgactatacatattcatatacatatacatagccttaaaatgttcataccctttgactcagtaaattttatttatctgaatctaccagagattttcaaaaacaatcctaaatttggaagaatttcagccatacaagtgcatatagtagtgctgtgttggattgcagcagtgaaaacatcccagctatgcaaccacagagaactggttaagaagatatggtattattatatatcccaaaggaatataaattgtcctaccataaagacacaggcactcataggttcatcgtagcacccttcacaatagcaaagacatggaatcaacctagatgcccatcaatggtagcctggataaagaaaatgtggcacatactatggaatattatgcagccataaaaaagaatgaaatcatgtcctttgaagcaacatgcatgcagctggaggccattatgttaagcaaattagtgcaaaaacagaaaaccaaataccacatgttttcacttataagaggaagctaaacattgaatacacatagacacaaagaggggaacaacaggtactggggcctacttgagggtggagagtgggaggactgtcaggactgaaaaactacttatcaggtactatgtccactacctgggtcatgaaattatttgtatatcagatcaacaggcaatcatgagtgcaccaaaccaacatgcaatttacccatgtaacaaactggcacatgtacaccttgaacctaaaataaaagttttaaaaattaaaaaagaagaaaaaaaagaacatatggtagattctattaatttggtagaccattatgtaggtaataagggtacatttgcaaacagaagaatcccaaaatgaaattttcagatacagaactatacaaataaggtatacagcttatattaaaaatgattcatagaattaaaatgactgtgagaatattcagtatcactaaaaattcaaacagtagttttattggagcaacgacattacaataattgttatttttactttcttgtattttgcaaatgttatttaatgaacacgcattattatgaatgcaaaacagctgctatttttaataagagagccaagaaatacaaatatgttcatgcttcttcaacagtgaagcggggaggactttatcttattctaggcctatgctgtccaaaagagtaatcactaaccacagacggctatttaaagtaattaaaattcaaactttagttcctcagtcatactaactacattttaagaggtcaattgccatagtctactagtatcagacagcagagagaacattttcatcgtcagaaaattctactgtgaacgagctgttctagataattggcatgggatcatagaagataacctacaaggaaaggataattcataagatgcaagactctgtagttagtctacactaaaccagcaaccttagtctattaagaaagcctgttctacaagatggactatgctatataaataagtgactcacagatcattagcaaagtaactataagtcattaggtttttggttagtttcctggggatgttattttggtatctgataaattcatacaaaaatcacgtctgttggaagtttatgaatgtaaaaaaactataattactctaagatggaacaattcctccaacatgcagccttcctacagagtaaacaaatttgtctttgtcttataataatcggttgtcttgaggaggcagaaacaggaaacaaaaagacaactttggaaataatactttttaaaacttttttcttttaaaaatttctgggaaaaaaaggcaagaaagaagaaagaaattcatttgaaaaactagctcttcaaaagcagtaccaaaatcacttaggtggataaatgtttaagagtgaaaaaacgtacacctttctttatttgagaaagtagaatagtatgaagaaataagaatgcaattcaccaagccattattaatgaagggcttatctactagagtattttgtgcagttggtattccattacatataatacatttcccattagaatgtttatttaattttcttgatttaccctcatcattgtacgaagatgttccaatccattttaaattaataggctgtcttcatttcaaacatgcaggctggattttactgacataatgtgaacactacaaaaagctgtttatctttgttgaagtatgccaagatcctctgattttttttttccagtgttttctacccttgagatttaaaactgaactcttcagccaggaaaatcaaggcagcagaaagtgtaactattaagatgtaagttgcacttaaaagtgtttcaatgccccatagctttccatacagttcaaaaattatgtctagtttttaagattattaaatgttacttagaggtgggaattttatcaccacagcaattaatatcagtggaaaaccctaatacagcataagttgaatgacaacctttacaatgtatccatttagagagggtgggaaactcaggaaaacaagctgagtatttggagtcagaagttttaggctgattgtcaatgttgctgattctcgaaacttctgtttccttatctacaaaatagagacactgagaatgcataatacatggggttactgttgtcttcatggtacaagttaggacacaaggagcaggttacttattttaaatctgttcactgttagtgaggtaaattattcaaaacaaaaccagaaaaaatgattatgattaaaaaacaaatcccagcaggccagcctccctttaaatatatttaataatatgaccaaacagatctgtaaaatatacaaataagggaataagtattcatttaactaaaaggtgttgttaaatagaacttcatcggacctttaaaatgtaacttaaaagtataatttaagcctagtgtttttcataaacatgtttacggtgtaaaaaagaaaatttgtaatttatatatattgcatctactgtattaagtctgcagcaggactggacatgttcctaaccatgtacaaaccagtcacactgcttaccagctatagaccttgggcaaattactttacacctctgagtattaatgctctaatctttaagatgttgatgatgaaacctacttcatagtgctgctgtgatgactaaattatgccacgaagcatgttgcacagatgtgtactgcaataaatcaatgtacgtttgcagtcatctttacagcacagctggtcatgaagactctcctgagtacatttttgactagagatatactgtgttttaaaacttctagttttaataaatttaaccattgagtagaactgtgctacttcttcaatattcagaaaagtatatatttttcatacaaaagtaaatatatatatataactattaatttcacattagaaatatgaaaagcactccaattcctggaaaatgtcgtagtacaaaggggaaaaattaagatagatgaaaaccagaagtattcctctacacctttaccaccgacattaaaaagtgaaaaatcaattcccttttcctctggtataagcaggtaacaaatggtaaacagtttagccagaaagaagaaaagccaaggaaatccacttactaaaagttaaattcagtgactaaaattatctttcgtatgctcaccactaccaaaatctatatttctagctatgttctttcctgagatccagatatatggacaacttccaagaatcaaactcaacatttctcaaacagagctgagtatttttggccagcagaccctcccctgccataatttgccttccctgtttttccctctcagtggatgtcaagtgtgaaggtcagtctgcgtgtgtctctcttcgcccatcattaacgtgtgcattcaatattataaacacaggaacctctgctttgcatgcaatagagggtaagcaagcctgtttatagcgaacgtccattctgaagggagagcgcacaaattattaaacagataggactcctttcaagccttttaagcactgtctgggttagggatgtggtggctacagcaacataaaaaaaagttaattttaaaatattaaacataatacaaaatggtgacatgatttttctctaaaatataggaagtgatcaatcaaatgaaaaactatattttaagtaaaacttcaccataaatgtcatgatttagccacagctgaaaacttaaagggtcagattcttccagctgaccctatggtgcccagctggctgaacattctgagaataatccagtgcagtggaaacactggacatttaataaatgataactcctgaggaagaacaaggaagtcatgtccacaccagaggtgggtggtgtaacggctgattttggaggagaagtttttgttttgttttgtttttcttttgtggggtgggggtttgttttgctttggcttgagacaaggtaggaaaacccatttggaaggctggaaatttgatatttgatataagagtctgtctggctagaaaataagttcttccagacatcaaaaaggaactaataaataatcagaataaacaaatattggccatgatatatatttaaaaggtagcctagctaggcatgatggctcgtgcctgtaatcctaccactttgggaagtcaagctgggtaaatcgcttgcacccaggagttcaagaccaacctggaaaacaggtatgtggagaaggactaacatatactcctgagaacatctcagaatacgcagagcatgtttttgttaactttttcaaagatcagctggcactccgtagatatatggctttatttctgggttctctattctgtttcattgatctatgtatctatttttatacaagtaccctgttgttttagttactgtagtcttacagtatagttcgaagtcaggaaatgtgatgcctgcagctttgtttttggttgttgttgttttgttttgcttaggctttgcttttttattttttatttttttggttccatatgaattttaggactgttttttctaattctgtgaaaaatgatgttggtattttgataggaattgcattgaatctgtacactgctttcggcaggatggtcgttttaacaatattaattcttctgatctatgattagagttaaaagagcctctttttctttttttttttttttgagacagagtttcactctgtcgtccaggctagagtgcagaggcacgatctcagctcactgcaagctctgcctcctgggttcacgccattctcctgcctcagcctcccgagtagctgggactacaggtgctcaccaccacacccggctaatttttgtatttttagtggagacggggtttcaccatgttagccaggatggtctcgatctcctgacctcgtgatccacccgccttggcctcccaaagtgctgggattaccgtcgtaagccaccgtgactggccacaaaagagtcttttatggagaaatagagaatggaataaagccagataaattcaatttactgctcataaatggccatgcttcttcttaacatggtccccttactgcagaggctatatatctaaaaatgagagaaaagcaatcacactgttgcttatgagcaatctacatgaaatacaaaaattccccttctgaaaaattataacaatttgttattgaagatgtgtatgtaaattttcccacctgtgttacttttttatacaagccaaacctagcaggaatctctaattatcataccatgaggatggcttaacaagggtgttgccagcccacaaatgcaatttgattctcagcatgaaggcaagactggcaatttacaaactccagcaacaagtaactatgaatattaagatcttaatttacacaatggagaactcattgctcttagaataaaaaaaggaacattttgaggatcctgttgctggatgtggagtaaaaaaaattatggtaatgattctgacaattgttgaagcacatacatacctgaatatcagggtactttttagaattattctgctcacaatggggaaatattttacttaaataagcagcctgaatttgaaatcaagtcataaggtaaatgtctcaattacaaatggtactgctttatatatggataaatctcatagacataacactgactgaaaaaaacagacataaaacataatgcatgattccatctatataacgttcaagaacagacaaaaataatctacagtgatagatgtcagatggtggtgactttcagtgaggatattgatgggagggtgcctgagggagtcttcatgacttagaaatattctacatattcatctagatggtgagaacatgggtgtatacatatggaatattatttaacctctacatgtaagatttgtacagttcaatatttgtgtgatatactgcaataaaaatttaaaaataggtcaattgtattagataactaacaaaattgaaaaacagatcaatagtactagataataaatatacaatagtctttatctttcctaaaacaaaatttaactgttactttagtgagtaccaagagtgcacacattcagaaggttttggaacccatctccttgtgtagcacagcattacatattttacatttcaacgtggctacaactcctaatcctcctgtcaagaatcccacatgagccaggctattgataaaacaattgcttctccagtaaagagttttatttgctctctcattgcctatcagcttaatacataggagaatatacttgaaaaggatcaagttctataaacaggactaaatgattatggagcaggcatctttataattgtgtttttacttttttccccccagttgtttctcaaggaatacagcagaaattgaaccataaagcttagcttgacagaaaggcattagcctaccatgctaaaccaaagataggagagacagttatttatgaagaaacactgttccctattatccttctgagattctaaaaaagggctaaatattgatgcatttcaaagtcaccttttcccccacttcttgtattaacaagcaggagtatgttttagatgctcctaatttgtcaagatcaggtgaacagaactgtcgtacagagcacactgctctcattcctacaagggctctgcaaccctgtgggttattaataattcatcggtctttcttagttcacaacaggggcattactcagagggcatcattcttactgaaagaagttaacagcgatgggcagataaacaatgcacaagtcaaagaagaagaagcctcttatgaatttgtgaacactgaagatctgttaaagagctccaactactataggaaaaaaaaaactgctaggtattctttacctaggcttctattgcctgttaggctaaattcagccatctttagaattatatcagttgtattaacacagaaattccttgaaaatcatttaactcttttgtgtgttaacacaggttatactactgggtacgattatgttgtctttattgaattagtttctccaaactaatctttttggcaggaaaatgatgtctacttttgggttccaacagtatttatttatcaaggaaatacatgaagcatcctaatgtcttaatgattgaaaacaagtctccaggaaaaggaacaccatcctttatggtcctcctcaatacacgtagaccctctgggtgaaatttaacacaggtattccaaaaaatttaaataacaggggcaacaggctcagaagcctaaaggcatgaatcacgcaagagtgtaaaacagtagagcgaggcagagtctgcagcctgtgactgcatgccctgcttaaagaaacttcaaaaacaaaccaaaaaccaaaaccaaatactgctaggccaaacatgcctatgtggggtgaccaatttcagacccatagcataaatcagaagtctttattctgaatatatgaggactcagaataggatgtattatgtcctctaaataaaagatattcatgtgggttaaataagagcattgatttattttcttgaagatatattgttattagaatgtactccattatttagaatgtactccattatttagaatgtactcgaatacaaattaagcctctgatttctgaatatcagtaacgagtaacctcgctttagctaaaaacagtaacataaaatttactgagcacttactaggtgccaagtactattctaagcactctgcatgcataaacagacttgaaattctcacaccgattctatggagaaaccaagcaggcacagaatgagaaagcaatctgcccacaaaaacacagctaatgaggctgctgttcaaactcaagcaacctgctttcagagtctctgtttccttgtttactgctcgcttcctcttagttaagagcacagctcatttactccacatgaatgcatcaagggaaagcggtagctttcactcattagcaagactgatataaaataaatagaaactcaccaccaaaatcactacatatactatacctcctaccttagctacaaagcagaggagtttcagggaccaagaaacaaaaggcttggagacaatgagtacagttcctgataacagtagataataaatatcactaggctgagaaagagttaagaggtcaaaaagaggaaaagatgattctataacaacatgccattttcctctcgtactagaaatggacatcttcagagtctttgcttcctttaagatactaactaggtcagatcagatgttcctctttttttcttttactaatggaatgccctaagacagaataaatatagaaattaaaggatctttgaaaaacccttgggtttttctttactgataatttcaaattttaaatgctacagattctataattacagtgacctcactcttggcactgaatgttatgccttcatgctacagtaaatacctttggttatgaaggatatgctgtcctaaaaaatggaatctttactagtaatgttgcaattttttatctgaggtgtttcccattcatctttttcaaaatagaatttcaccagaattaaagttaacatattatttattcatcatatctgataagcatccgatgatgataaggaatttttttcataaatacataaaaatttctttcaacaaatgcccctactatatctaaatatatagttggaaatgtaaagcaaaagcatttcaattagataattataaaagtaaacacattttttcaatttatgcacacttaaaacataaaatgttttagaacaaaatatttcaactaatttgttttaattagttaaaaatacattacaccatctcatagtagagacagctacataacatgctacataatggattagtgtcagaaaatgccaactttttgcataatttcaagaatatattccaaaaacacccccacttaccatcaagatttcaaaataataatagtcaatatttatatgtacctcccattctgtgtcccaccaattatctcattggatatccaaagaaaaaaaaggttctacatctcaagaagtttgaataacccttaaaggatcaaaatgtagtttattttatgaaaggctctgagaattcttgctttgaaaaaattaactttcggtgaaatatattgttttccagttaatgacatacttctcatactcatgcacgattctaatactttcataaacaaatacttagaaaaaagttccatcaaataaccagtgagaaataaattcaacctacatcactagagtcaacatgattcattggttagaaagggaaaggaagacatctctctcttactgaagcagcagtagcagcctggggtaaatctgtcacgcaaatacgttgggctatttcaatgttactcttgttagatcttgcttttatcaggctttcatgtaaataggtagtaaaattttcaaaaaggccatgtgtccatatgcacagattaaaaaaaaaaatcttttgttgtgcagaagctctttagtttaattagatcccatttgtcaattttgtcttttgttgccattgcttttggtgttttggacatgaagtccttgcccatgcctatgcctgcacaatgtgcacatgtaccctaaaacttaaagtataataaaaaaaaaagattagaaaattaaaaaaaaaaaaaatcatggttgtccagacagttgaactgggatttcatttccctgtgtatcaagagacttgtgcagtaaagggttaacttagcagtcttgaggttttcaaaccacacacattctaaagaaaagaaaagattggctcttgacaagctcctgggatataacctctaagtgcttggagtatcctgcctagtaagagtttgcttttctacctggggccttgggccacactagacagttttatgctaacaatgtgatttatggcaaacacccgttctagttcacccagggccctaggtcacactgtatcagaagtttgactacaggaggggctgcagactgagtaactaaagttacccacgtaggtgttccacacctacaagacagaccccccccaacaaaatccttgaccaccaaggctcagtgaccctccgggttgacaatactccatgtgtgctatcacacatcattgctgggagaattaggaactgtccacacaaatccaccaggacaggacaaccagaaactcattcctggtctctccctgactctgttctatgtcccttttacctttgttgatttgaatctgtatcattttgctatattaagccataactgtgtgtataatagctttttataatagattttatgatttctatgagtcctttcagcaaatcactgaacccgagagacaaactagattcttcccattggtatctaggattcaaccagccttattatctgactccttggtcatgaccagtctctgttcagacacctaatatctatcgaaccccttaagttaaatcagcctccagatttcagcagaaataaatgcacagaaaaaataagcccatataatttgctgtagaatgtaaaaagcaacttttgatatttaggccaattacagtaataaacattaaataaaagagactgaccaactgcaaactggactattttcaaacttgttgccaatgactatcctctaggtaagagatgaaggtgcctcacaaattcaactgtataagatgtatgtgcccagcagggtcgtgcctgaagtagccatcctgcctttctaacctatcttgtcccatctatcacctcacaacattggccactaatgctgcatcctcagtagagatgggatcgtgacctacccaaacattcattataaaggtgtaagaatcaaagaagcatgttgtcagctctgcttttggcaataaaggaaaggtttttctcaggttttcctcttcacatggttttgggctgacagtgagcagtgagcaagctgtacttaagagttgtccctaacagatgtgagggcggggacagcattgaatacaatcaccatctctgatggccccctctctaaatgcattaaaggaactcaaactggaaaaggagaattatccagccattaaatttcattctttatgagacaccaatagctacctttttttgctttcaagaaacttgggttatgggcacaaagatccttcaaaatattcaaattatccatcttgaatctcagacaatttttgtgcataataaaagttcaattgaagcctcttttaaagagtcacttgaagaggtacatagtgactaaaataatcattcaaacaggagataaacaggaataagtgaagctaattcaacctgcacatgcatatttaacatgatacacatatgttacaaagcatactataaatatctctgtgcctattgaccttgtgcagctctaggaataaatgctggaggaatttggtacttaaaatgttgaagaggtcaggcacggtggctcatgcctgtaatcccaacactttgggaggccgaggcgggcagatcatgaggtcaggagatcgagatcatcctggctaacacggtgaaaccccgtatctactaaaaatacaaaaaattagccaggcatggtggcgggcacctgtagtcccagctattcgggaggctgaggcaggagaatggtgtgaatctgggaggcggagcttgcagtgagccgagatcgtgccactgcactccagcctgggcaacagtgagacaaaaaaaaaaaaaaaaaaaaagaagaaatatggagtgctggtagacatttctgtcaatagcagcaatcagtagcttaacctctattgcttctctcattctacatggcagagatagcagtgataactgtggcaatccagcagaatgcgaggccttcagaagcagagctaaatatgaggagtagcacacacagtatgtgtctttatggcagctcttaggaaatctgtccatttgcacaggtgctcctagaggcaaatgagcagacataccttgaaccatagtgactctcttaaggttattcaaaattaaactgtgtcactcccaaagagacatcacaatcctggaagaattcagtcacctgtgactaacctgacaacaattaacatacttgaaaattgtataaaactcaaattaaattttaatctttcatacttaagaaagaatcagtaactgataaagaactgtttaactcaatttgaatgtgatttcatgaaaggatacattttttaaagttattcatctggatcacatattcaacagttagagttttccaaaataattccaaagcaggtttcatgctgacatttttaaatcgtaaaagctttagcacagtaggcattgtccttgcctggatgttctgtgtcggatctacattcgtgtttatactgtgctgctgaacaaaacttagcaccacaataattatgtgaatcaagttctagtcgactttgtcagtatgcttttcatctctaaagctttgaagtcaaatcccagtaaatgtcaatatgctcctatcatgtccacacctgtcatctgcagcacaagtcagtgtgatctgcagatagaaatgaggagaaattgaacatattttatggctgttctgcttgaggcaataagaataaagtaaatcaatacttcatgtcatttcctgaaaatactgtattctccaagacatttagccagcacttgcccatttaacaaggacaaaaacataaaaagaaagtttttaactcagaaaattagcacatcaatatttctgggtcacagaaattcaagatgtatcatgcattacttcaaaatctcagttaaatacactctcaaggttggttgctcacaggaagggtaagtatcattaagaaaatctaaaatttcaggaatgaaggctcatatttaatatcctattattcctactaaaatattactaaatttatagccccattaaaaaatgtcaagacatgactttctctgtaaaatgagacctgcaaaaacattatatatctttacttacatggtatatttttctaatttttctatcaatttctatcattttccatcattcatttttaaaaaactctttatactttactgttcaacactatttctgacctttggaaatggatatttcttgactatctacccatactgtatgtacacttaagtagaagaatgtacaagttcagggagcctctgcaatagtcttttgtaatttaagaaataatttccaaatctgagcaaaaataattgggccttggttggaaaatgtaagttacaagtatataacttaaagaatattgaaatcatatttgggaaaataaaaagtatcaatagtaaaatatggtagaactcttaagtacatagagtttggagtccgagaagctagagtccaaatattggctaacctcctattaactactgatcttggggcagttttcacttctctgagccgaagattcactgcttgtacaatgggaacgcacacaatgtacagctgctctgaaaagtaaacgagctctgactacagaaagtgcctggaacatggtactcagcaaatggtattttcttggaatcctataaacaaattggtaacaggaaacatactaaaaaagagagagaaaaacagtgaatacagggcaaaaatgaaaatcattaaaaaggcaaaaaatgtcccggtagcaatgatttctaagtatcataaaagaaaacaactaggaaaatataattagaatgctatatcactaaaatccgtttttgagaccaggatgttcaattcgaaatcctaagaatgatgtgcttccccctgcctgagaaagtgccacgctcaagaaaggaggaagggaaggaattccagtccttctttgcttgtgggttttctcttaaaacttctgtttagaggaggtaggtgtgttcctgtccccttgacttggcttcaaggactagagacagaaagtctactggaaaagcatgtatttgtttgtgaggaaattagatactggattcgatactggattcactacattgtttgttcaaatgatttgtgtcaggaaaaacttttttttttttttcttttttttgagatagggtcttactctgtcacccaggctggagtgcagtggtgcaatcttggctcactgcactcccaggctcaagccatcctcccaagcagcagggactacaggtgtgtgccaccatgcccagctaatttttttaaatcttttgtagagatggggtcttgccatgttgcataagctggtcttgaactcttgggctcgagggatccatctacctcggcctcccaaggtgttgggactagaggtatgagctaccgcacttagccaggaagaacttttaaaaaacaaattgttaacaaatccctgaggttacattactcatccataaatacatcagcatgtatctccaaaaaagtaaagttatttttaagcatactacaatataattaacatatctataaatattaacaatgcttccttaatagcaaattaatactcaaatatattccactgtctcataattttctttacagtttattcaattcagactccaaatatttgcttccaaataatctagttgctgagggataagagagtgggtaattgaggatatagatgaaaaaggtcacatataagtaaaattgttaaagttggatgactggtataacagagttcattaagttattctccctgcttctgtataaccttcaagttttcagtaagaaaaatgttttaagttttccgtaataaaaaattatacagacatacatcaatgaaaataaaaagatagcaataaatataactcacaggtttgagatttttttaaatgacattttaggtcaaaaaaatgctgaaactcagaccttcctagccctgtagcctcaataaacacaaagtaactgagagtagaaagttaatttactttagtaaaaaaagcaagttttaacagcatcaaaatatgagttgaataattaatttttaaaatcctgtattaatgtgtttatgtcaggttccaccagatataggcataaaacaaaccaggtgctgccttttttggagattataggctaacagactcagtgcctgccttctatatatgctatggcgtcaaaagttgggaagcatctgttcaaacaatagtttaggattttattgaaggtcaattaagacttaactgagaaattttaaaactattaaatacatttatggaaacaatttttgcatatctaaccatttttacattatcaataatttgaaaataccattttttagagcaggagtatttattaaaagtaaatatacctaggtctacttcattagtaaaaaaagtaaatattcctaggtctacttcttaacatattcaattggataagcaatgaataaggagtactgagttgaagaagtgaagtcctatctagacctcaggaggtatggagaatacagaaatgacagaatatacaccacactaagctgccttgcctgtttcccttacaaacagcaattagaggagactccttggggacttaacatatttactcctacatatgttaactaaaagcctatgctaatgtacaaaggatggatctcctcctgcctgaagatctcagcagatgtgacagcaggttctggaagaggatcagcatacaaaggcatacgtgtccactggcagatcctgctggttgcctagtctatcaatattgcttttcctttcctccttgctaacagaaccttggcattactgagggtggcaatgtgcctagattttaaccactacacttcccaacttctttcacagccaggactgaccacatgacacagtccttgttaatgaaatttaggtgggagtcactaggtggattgaaaatcctttataaggggacagtcaggctggtttgctactttttccttttacccttttcttcctctttgtcttcctccctatacctctatgtgctggctagagctcaagcaccatcacatgagcatgaggaccccaaggatggtggcttgcaaagtcaaaaggcttcattttcctctttccctggctggagagactgcaagtttctccccaggtgtgtggaccacaggtgctgcagttggccccaggctaaaagctgcagagataagaactgacttctacagctctccaccttttctcctccatgccagtatgcacacccaaccagcatctctgcttctcttcacaatccagtaccttcaagtagttgtttttgtgatatgtccaggtttttattttggagggacatgcattccagtagagcctaagtcccttagtttttagaaacaaaattatttaaatttcactactgagccccaaagaacttctaacatctagactattaataaatggcttcttgatcagagagtgatactcaaaaagccagacccaacaatagagttcacagaaacaacagtccttcaacattttctgaagagctcttcatttccattaaaagggttttgttaatcatttaaaaaatattgttaaattactgccatgtgtgactcatggattaggtgatagctggtactggctttatatagctacagaaacagaaacaagtctatgggtgtcttacatgtcaatatgctttagatcatttcaggtaaagtaattaagcagatacatattgactatttggtgcctaaccttatggtgatgagcaaagtgtggggaagctattgaagaatatgaaatcactcttgcctttctataatcttattgaaaagaaaaaaagactaacaagaaaaaattaatccaaatcaatatataatcaaatgctgaaatatggggaaaaggcaagccaaaaacatctaccaaattatgacaaaatatacaaggctaagactagattaactgaatccactcctcctagatatgctgaagctctgaatagataacatctggtaagctgtgaaacatgaaaagcatatacagttcactggaaatcaaaagagcttaagcttactatgtgagatataatcaagaatatgggttttaatctatgacccattgtttgccaggttctttttaaatttttcattcaaacatcatatattaaacaaaagctaattttaagaataaaagtgtctccaatattttaagtctcaatgactgaaagaatggtgaagcccttcttgggactctgaagacaataccccaaaatatggtgctttggcatactgaaccaaagcaggagccctagggtctctgtgaccttcctctcccggtctctcaatcatctgtctctcccaaaccagaggatgaggctgttctctgaagttctcttgtctacctagaaaccagacccaccaaagagaagtacgttacctttgatctcttcagtgaatttcattaacaagagaaaattaaaactcatatcctagaggaagagactgaaaattaaacaccacacctagaaccctgatgaacttcatcccaaaatgaatattgaatgaatattcaagcacttcacacaaataatcattgacgagctaacttctatcttccatgttcattaaaatcatttagtacaccccacaaaattgcctcatttccctcctctctcctttccctatgaagaagggtatacaagcatctggacctcgttgggttattgggtaatcattctcctgcaattgccccatgcttaggcatgttaaacaaatttgtaagtcttcttctcccattaatctgcttattgtcagttcattttcagcaaactttcagagggtagaaaagaagctttgtccccataccattaataaatatgagtaggaagaaaatgatctgagaagaaaagagatgaggagctatgttccgagcatgctcaatttgtgtgaacagcaagacaatccctcttgtgcccactgtttatagtatgatacaggtgaagtagcgaaggctttgataacacaaacacttcaacattcacatctcaactccacccacttcttagttggccttcagcaagactatgagatctagctcccaagactgcaaaattgggatcacaatatcaaactacaggaatacattttgagaattcagtgacatgattcagttaaaacacctaaccaataataggtattaagtgttaacatctttctttcttgtttctgcttgttctttttgaatgccaaatctgataagcttatgaatctctacttcaaattgacccatttcctaactatcctcaacatcatatgcttatatctatcgcacatcttttactcctattttctatttctctcaacttaaaaaagcactataaaagcacttttatagtattaaaaatactatacatccttcaagatccaattcaaggcctgtccttttggtacataagcaatcatttcaatctgcattaggttttcctttacctcatgacatactttgctattaattaatttacatacatgtcttgcctccccagataaaacataaacttttataaagcagaatctgtgtctaaaattggttttgtttgtaaaggctcggctctggactccctctgagatcaacaaaaacttgctgaataaaggaatcagtggtgctgaccattaaaatctgaggactaatgtctattcagatataccagtcaaagtcaaatttatgaaatgtgatttttgtctactgccaactgctaagaaaaccaaaattcaatgtgattataattgtaatgaacaacaacaaaaaagcagctgttgcttcggactaaaaagcaatgcttaaaagagataatgtaacgagggacttctgtaaaagaccttaaataactattgcacaagaagataagaattaaaattaaattaattaagataatcaattccactattaaaatggaaatgaacttttatcagaaccgtggtagaatcacaagtaagatgtttcaatagttaaaaagtagtttttaaaatttgagatgcattgcaaaaaaaaaaaattggctcatgggtcagcactggaattaaccctataacaacagtaatttacatgaactattaatcattttaaatgtgattaaaaaaatacaagtccagcacacctgttcaccaatcaaaatacctagggcttgagacaatgtagtaagacaacctgtaaagctaagggtcaacaagcttccaagattggagctttcttcactctcttttttttttgacatcagtgtacaactagactcaacattcaacatgtcaattatgtcatcatcactaatctttcagtattagcaaaagtataacttcaaaaactcatttccaataggaacacacacacacattcacatacatacacacacacacacacactcacatacatacatacacacacacacacacacacacccccccgacaaaatgaaaccaacagaagctcatgaaagcatatagggaatagtttcatttatgaataaaatgtttccctgtatcttctattaaaccaagggttttaaaaatcaaattaaatcaaaatacaaaaaacaatagtatattgtttttgtagaactaaacatctcctttaaattgatatgtctttaaaataggaggtgaaaactatcgtgacaattgttctacaagattaaattaggagaaataacttaaccaacattttatacattaacatttatttaaaatctgcatattaatgaacttcaagtattgcaaacttggcaggatgttgaaatcaatgttttcagatatctatcatgatatattgagtctctggtttacttgacgtttttcctttaaaaataattttaagtagttaagcaatgtaattcctcttattttcaaaaaaattcatattctacttccttcatagatggtcactgtaaagaagtttaaactctaattaacagctaataatatgcagatagcagatacacacaaaagcttccattaaacaaaacggacaaagaaaactaccatttcctgattttctccctcagccctccctacctactatcttgattctgcaaacagcagaataaattaaagttcctttcttctacatcaactcctttgtcctctcaaggttgcctaatcatattcatctcctaaaatgaagtaagaaacatttcaaaagctgtattcacattaaatcaactttctgattcgtgcattgcaggaataaagcaatgtaatcacatcttaaattggtttacagcaggctgtctaccttatcctacttctcaggattgatgaaatgaatagttttaaaatagcactttttgaaatgacaagagaattaatagtgcataattacctcagtgttgacaagtgagagatgtttaactccttaaatgagctctcctaatgaatcagtgtcagagaaaggctccactgcatgtacatggttgattgatatctaaggggattgatttaaccataaaggaataccgaaagccagtttttaaagttatttaggcaaaaaattaaatgaatcaatttttacttaatatttggaatatatttacttaagactttaccataagctttgatagtattctaggtgttgattactaggaaaatcttattttacattgtatgagtccactaaggaacatttaaccttttaatagagtggcaacaaaaaaaacttactttagtattggactccacactacataaaagtgaaaattaagctattggatttaaaaagtagtacagagagttcatttctgacatttatatttaaagactgtaatgaagacaactacaatacaatgacgtaaatctccattttaacgaaaacttttaatacatgtaaaatatgtataaaatattaccataccatgttgaacttttaatatttatatacattctctttctaattcttgtcaattaacatgtgatactgttccattctattttaaatcctgtgggtaaaaccaaaacagattgatatttctaaacacctggaattgagaaaactgaacacggtctcagcagtagagctgtgcagttgaaatgtaacacaagccggctccaacttactcttcatttttccatgtctttcacgtataccagctgcctagcttgagtgtgtgtcaggcacggggctaagaactttctatttaattctggagattcctaagaagtagatcatactatccccattttgtagatgaggaaggctgtgcacagggaggttcctgtcccacagtcacagagggtcgtgagtagagcctgattatgcactaagacaactggaatgcatagtccacacacacactggttggcaaatatatttccatgtagattatctttaccggattaccactgttttagctatcagtgaaggtgttagattgtgttgttattcctttatcagttcaatatatttgggagtcaactaaatgctagtactttcccaggtgctgagactacaagcgcatgacagagatgaggcccttctcacgtggagaccacagacagcatttgcagggagggggatttgctttgtaattaagcgccttagctaagagacacaggtgcaggagatgcacaatttggacacttagacaaacattcttgacctggtacccgctgagcctcagtgaaagagtgagggtaaagtgtgaggacaatggcagcctgagctcccagcactaacacaatagctggagctggccatgccctccacctgggcagcaggggactataccaccaggctcaggtggactgcgggggggttgtaggcagaatgtgcagcctgggagtgtggcactctatgggaacgtctgccttaaccttcctttaggaagccaaagcctctgtgctggcactcctccccaggtactaaccctgtcacctctcccccagactccttagaagattgagcaccagggatgaaaccaggtcatcaccaatcaaattcctggcttcactgttctatcttgggtttctttaaaaaataattagatacatgaatgcctcagtctgttctattaggtgtacttaaactatgtgtcaaagctcattggaatatttcactgatgccttaaaatgtctttagcagaaatgcatttgagttgcaaacatgcaccttaaatgtgacttcccagggacaatcagctaagaaattttagttaatgttacaatttataaatatttgtgaataaaaatgtgttctaaattaaaaaaccaagtcttcattgactcgtctaagaattagggatgatgaaaactacttcttaaggaatactgaatgagttattgtagctagatgggtccggtgggctctaacacacagcaggtgtgcccgaggatggtcacatctgaatcgtgaaacaaatggacttcggattttgtttatattataaaaatctacaagaaaaacagtatttttcttaatcagttttaaactaagtcaaataattttgctgcatttaccaagtgtgtagagatttatattttaaaaatataagaagtgtagcttcaatggtaaacatgtattttatatattacttcgtaggtaatgttcctttgcttttttaaaaaaaattgctatccttagctcagaaataaaaaatgttaaaatagtaagagactttagtaataactactaaaaactggctcttccaactttccaatatctatgatggaaacccttcacacctgcctgatgtgtcagacagacacaaattggttgtttgaggggtcagaccctttcttagactgcctctcccctcctcaccccttaaagtgatacccttgaaaatcccctttactgtttcagaagaacactgttttagaagcagctataccaccacatcatttacactcacaatgccatagatgtaaatgtgagacctcagggccaggccaaatactccgggcctgaaatcctactctttccatcaatatgcccttaatcaagaggaatctggtagagcttctgtgagaatacaagttcttaagtgtaaaatctagatgtcccattaagcaaacgataccagtcaaggaactggcttttttgagctcttcctaaaaataatgagatttggaggacagccatcagtcatggaaagacatcaaacactgcatgaagacctcttgaaacctggttccacaagaaaactagaaattaaaataatgcatttaatagctcataaagtttacaagattcttatctgctctgcaagacagaaagaatcaaatgattttcttggccagggagaattcaggttcaatttttaagcccctattctgtaaccctcagtcagccctgtaggaaggtaattatcagggctagagggatagttcctgctgtttcctataagtaaactcaggagctaaattaaggtacttagaggtaaactctcagggtgtgcagagcttggctgtttgactcccgtggattctggagcaaagcactaaacacttctatttattcagagagcaggtagagaatagggcagcagaaacacggctttctcagacacctccgccagcccctgctaatcaacgggagtcacacagctcacaatctcttgctatggttttaaaatgcaacttttaatgttatttcattgtggtgtccttgtactgaaaagcatttattatgtagtttcaaatttacctgaaggttaaaaaaaaaaaaaaaaaagaccacagcaggaaagctgccattgtgagaaagaaggacataaaattcaagcaatgaattaaagaggcaaatgaaggaactcttttcctctattagaaatagaagaaacagattgtgctcgtcttgcttagggccaacaggcgcactgcatggaactcagccagcttcagtcacaaagctcacttaggagttctggtctgtgaaaagaggaaaccagatgggctatttactttcaacaagataattctggaggaaattgttatatgtcaaagaaactttttagcttcatctgctattttagcctctaaactgattcaggaagcagaggggagggttctgttaggaaagaaataagagaattggggaaataaaagcaagcgcagtgcaaaaggctgggcggccatgtcgtccaagtgcataagcttcctggactcatatcctcactctaaccttggacaagcgatctgacctcttggtgcttcagtttcctcctgggtaacatggggaccacaatagtgtcactagaggttgtaaagattaagtggtataaatatcagtacttaaaatacaacacacacatgagcactcaataaccatcaggcattgtttttatctatttcattttctcttctatttgcaaaacataaagggaatgtatcatagatatagatcaatgactaaacaattcttaagaagacactaacagctaaatgttatattggtctactgattatattgaccatataccactgatggaatttgtttgaaaacaacttctcttttgtttggctaccacaaaaagtaaaataatccagataattttattcttggatcaaaaatttcaaagagattttcttacctcaaaattaagaaagatagcttttaagaaaagtagctgtagagtgaatatagaaaagttaattaaattctaagttaaatttctaatacatataaaggatgctttctaatgagaaaaaagcagagtttccccagcaaattgtaaataacttggaccaaaatcaagataattcttatatgaatatactgtggaaaaggtatctagcaacctcatttttaggatgtacaatatctaaatattagttattaagcaaaaactgaaagtattcaaattaagttatgtgaccattaggcatccaacttaacctacttttattttacacttgtactattgctaaataataactgatgattccaagagaataaacaatactctcagaacagagtaatacaaaatatgttcagtctactgtatttaccatggcaggaaaaaggacacacattgttagaaggattattcagcatgaaggactaaaataaaaaatagttgcctggttatctttgtattgattttaaaaatttcacaaatattctatttcattgtcacattagagaaacagcatcactattttttttttttttttccgagacacagtctggctgtcacccaggctgcagtgcagtggcacgatctcagttcactgcaacctccaactcccgggttcaagtgattctcacgcctcagcctcctgagtagctgggactacaggtgcaagccaccacgcctggctaatttttatatttttagtagagatggggtttcaccatgttggccaagctggtctcgatcaaactcctggcctcaagtgatccaccttgccttggcttcccaaagtgctgggattataggcataagccaccatacctggctaatatttgtatttttagtagagacagggcttcaccatgttggccaagttggtctcacactcctggcctcaagtgatctgcccaccttggcctcccaaagtgctgggattacaggcatgaatctgccaccactggattttcacttttttgtgtaacacattttctttctgtaaggggaaaataaacaaataattcattaatttaattttcaaaatttatttatggctctgataaacataaaagccaacagcatattttaaagctattttgaaaatataaaaagaatggttactatgtttgatttttcatatggctagtgactcaatccagctgtgccccaagaaaactgaatgaatgttgatgataaaaatatctgaaaactgtatgagaaaccacatagacatatatgctaggaacttacagattttatgtcccaattaaggcctgtgaataaacggagatgagtattcaagataatagaagtagaaatcatatctttgtcttaattaccatttataaagttaatataaaataaaatttccctaagtattgcagaaaagcaaacatagcaagacaattttacattgtcaataaactggaaatgggcaggaaagctgcttcctttgaaacaacctaacacggctttcatgacactgattcttaacagtgatgaaacattaaatgaaacatgaaattgattagcctctttctcttctatactccaaattttctcccactttgaaaatatctattatttcactaactcaaaggccaaaaatctaatagcgtttgttactcattttcgaccactggcctaaccccattccaggcaccttcagaaataacactgcctttctgccctgacatagagtcagagacctaaagagccttgttgggagagcagtcttccctgggcctacatatcttactgcaggggcccccaagccgcaggccataggggtccgtggcctgttaggaactgggccacacagcaggaggtgagtggtgggcaagcggagccagtaaaccttcctctgtatttacaggtgctccctatcacttgccttaccacctgagctccacctcctgtctgatcagcagaggtattagattctcaccggagcgtgaaccctattgtgaactctgcatgtgagggatctaggctgcaggctccttatgagaatctaatgcctgatgatctgtcactgtctcccatcacctccagatgggactgtccagttacagcaaaataaactcaggggccccactgattctacactatggcgaattgttatttcattgtaatatataattatttcattatatattacaatgtaataaagggcacaataaaggtaacgcacttgaattacacttgaaaccaccctcctcgccctgatccatggaaaaattgtcttatgaaaccgatccctggtgccaaaaaggttggagactactgtcttactgggtatgccaagacatcaagggtctgaacacttttttttttttttttaataacctgggctacttctcaggttgctttcgcaggtgagagatgaggcaacctctccccttggacaaacagcagactgacttactgcttgttataaaagcagtgaattccccaaactcagagttccttagttgcaatgcaaactcactcattcatagcatccatccggaccataggaattgaaagcaagggcaattgatgccaatatgctggtgctcatgctgcttattgtgccaagggtaataaaacgttttctttctgacccggaagtctcatgtcttctgccagtaaccatgaaacagtaactggctaaaatgtatgagaaacgatacacataccattagcttccaaatagggtaagatgatatctcagacctgacagttttggtgaaggaacatagctatctggagaaggaaggaaaagtgtccagagattgggtccaggaatataaaaaaatctccctggaatctgagagcgaatgctcttgcctaggaggtggacagtggggtgtggtgggtgggaataagggtccctactgtcctgtgtgctaatgaggctaagagaggcaagattgaaatgagtatgtaaacggaaccgtggatattgctcactcattctcctccacgggttggggtgttatcatgacaagggggcagcaagaaagacaatgtgggtgtggctgctgagccaggggtcctcaaagctgacacagtgtctcaataataatgacctttttacctgatataggtctttgtgcggaccatcaactttagaagtctggttaagcctcacataggctgctgcttgaaagccacagtaaatgtgccttgttgattaacacggagctgctgtccctctcatactacctgatccctcccttccctctattctgaactcagctgctttaaggagaaggatgactgggctgggtttaagatctccctatccccaggggacagaaagcccctggcaccccctacaaacacacacacacacacacacacacacacacacacacacacaactgtttggtatgatgaggaagaaaggaactcaactgttatgagtccaagttcccattcttcctggcccatggaagaaaggcacactgaactctactaatggggtttagtgcttcccagtgggaaaggggaggtgaactagccttgtaaaggtgccctctgggcttattcaatgtggtgttgtggtagcagctcccatattcaattctataataagaactgatgtattacacatttgcacggcctaatccctgaagtgtcagaagggcttttcatgttccagaactgctgcagaggcccctgcccactataatagcatcacctgtttgatggagctacaaagtactttaaaaaaaaacaaaaaagcagctgttatcctgcaactaagctcttgtggagaaaaatgaacagctgaaatcccattttcaggtgaatctccctaaagaggtgggaagggcctaagaggccttcctggtcaaatggaaatggtatattcaagggcacagtgcatccagccctagcatcacccagtattaaatgaaaataatggcagctacttctttggaggaaccatatcccccactccactactggaaacagagctgctggttcaagaaggctctcagaggttcccatcacggatggcctggttcactgacagtttgatgaagctaaaagccgatggtggtctctgaccagcagcagccaaaaggaccagtcagcacatttctctgtatgagagctctgacccttgtcagacaatgctcctaaagaccaggcatttcatattttacagactcttggactgctgtaaatgacttgtctgctttgccatttggaagactacagactggcagattaaagagcccctctgtaggactacacattttgaaaacaaatcttggctgctgattggtctgagtgtcactgatacagatgcctgcagtaagtgcttattctctgatgagaccaactggaatcaagctgttggtcaaaactgctatttaaaaaaaaaaaaaaaccaggaaaagtcatgtggacatggctggccctgaactattccgctgtgccgatgccaccaacagcatctcccaaacgtggcccttcccctcagacctgtgcaaacacagattgcttcaacactgttccaacctgacatacaaattcataggcttctcctgcctcccaagcagccgtagctaatgccatgtttagcaatctagattgcagcaactcagtgacactatgtggcttaatcaaaccagtgtaatgctgattccaatcaagtgtagcaacaaattccaaactagagtggcctgtgctctctatatgggggaaagtaggccacagaatgtctctccattaggcatgagggttgctttctgaaacagctattatcattgacaatgagacccaagaggggcaagtcattgcaaactttcttgcgcagatcatattaggtagcagacttgtcttgcaccgtctgaattaagacctactggtctccctctgggatttattcatagtaggctgaatcagagattctggtcggggaaggcagagagactggatgaagtcaatactgcaggttggcttcatcctgctgcttaggattttattgattgttgccctaattaaatgctggtatgagacaagttgactagtttggttccaacctctgttggtccgattaatcagagtgactacaggtggcctattcatgtaaaaatttaccaaaagccaagatggggatggatagagacagttttccttggtcttcttatactccctgcatgtcttgttgggataccaagactgcattgtcctgactgctcttttacctgggccatttctcaagactgcattgtcctgactgctcttttacctgggccacttctcaggactgtttatacatctgataaccttaaataatgaagtaatgtctaaccccagacaaagagcataggtactgcttgctataaaaatggaagattccctaagctcagcagtcatcatctgcaatgcaaacctactgcatgcacagcatccatctgggctgtatcacatcaccccgtgagattcaggggcaaaggaactagagtaaatatcatgacgcttatacaacttgccatactatgagtaataaagccccttaatctctgacccatgtctcatatcttttgccagtctccatgatataaacaggctaactcattagtttgtaagtagggtaaaaagcaaagcccagatccaacatgtttatctctggcttgcaccacatagggcatatgatagaaacctagttaagacaatcatccccatacttaatgtccaaacatgaagttacatagctgtcctaaagttgaacctgtcttctgagattatttcatggaagcaagagaaaactattaacatatgaatgtaaaaaccagggtcacttccccattttccaggcctaacaaacttatgaaacctccacataaaactagggttactcacttcagttccggttcctccagagtaaaacccctctgaaggggcactattaccaccacttcaccacactagagtgtggaggagaaatactaagtatatgagatgctgtaatattatagtttgaacggaagggtgatttgagatgtgaaagaaagtgaataagaagtgctactagacatgggcaatatactttttaaattccaaacttgatttcaaaaagtagaatcaatcagtcaaataaacaaaaaacctaccttcaaggaggtggaagaatggcaagaaactggtatttataaaattaggtctctttggccaggctcacgcctgtaatcccagcactttgggagaccgaggcgggcggatcacgaggtcagaagatcaagaccatcctggctaacacagtgaaaccccgtctctattaaaaatacaaaaaattagccacgcgtgctggcgggcgcctgtagtcccagctactcgggaggctgaggcaggagaatggcgtgaacccaggaggtggagcttgcaatgagccaagatcgcgccaccgcactccagcctgggcaacagagtgagactccacctcaaaaaaaaaaaaaaaaaaaaaattaggtctcttttgctacaagggagggaaggcagaaaaagtatgccagattcagggaataaaaagtgttaagaaatatcatagtgttatatcccattatcaaaaatcctacaattagggttcaaaattcaccttcagaaatttaataaaaagactcaaatgtcaccaagtgctttatgtatgattattggcaaaatatttgtctgttagctatacttatactgttttgtaaaagcaaaaaaaaagaacttaaaagacaggatgaaataaccattcagaagcagaattatagaagctaattattaaaataactcagcattatatccagacctctagctgagcagatatcaaaggcaaatcagtaaatattctaaaatgactgctctgtaatgtatatgattaaaacaaactgtgctaaaaattaagaaaattcacattgcttcagaaatttcacattcacttgtctccgtaattcaataaaaataaaataaatggtttttcagaacagccaccatcaggaatgtgacgtttgatcatttctccgccctgctgtgagcaatgaggtaaaggtagattttttattcacaccactctgcatcctcatgggtaagtgaggctgtcggcatgtcccgtgacttaattatgtggtggccctgctggaggtgtgcttgcttaccgtaaacagacgcaaatatctcaaaactacccctgatttacaagaaaaacgttcaagtttaagccagtctttaacacaaaagaacatctttagaacaattgtgaaaaaaatcagacttccttctttgctttgcgtcacggggcctttgtctaaccaggggctgaggagatgcagggacactggtgacagggagggaggggccctgagagcaggcactgaaacaaacctgctcttcccattttttaaaaaacccttcggaataatttaaatgagctcccacccaaattaaattgccttgaggttttccctccaaggcttttggcattataaataccccctgactttggcctgccatgtttcctccatcaatcacggagtagcctagaattaaattgaaatgattggatcaagaaaaatcaaatgttttaacatttagtttcagtaatgtgattacgaaccttttagtgatattgtaattactctgaagctttgagcatatgtttctactgagagcatttcatggagaaaagctgcattagggaaacaagtaaatacagaccccaatgaagcaaaagtgcatttgttgtaaagttaaaagctaaaggtggaaaagagacaaagcatctacgtaatttacaccctaaacctgctgcatagagtaaccacttttaaaaatctctacttcttccaaaattcaaataatttaagcacttccctctaagggcaagcattaaggaagcagtaagaagaaacaacagtaaaggacaagggaaaaaaagaagaaaggaaaaagtcatcgtccttgtgctaggtatttgcatggaaaagatgacagacaaagctctctctcttaaaattaatgaaccatctcctcagatacttaattttcaccaaagtcaaggcatatagttacttcccctatttgttaatttttttctcccatctcaacacctgatgggattctgctaggctaggagccccaaagataaatgaagtggggccccaccccaaaggttaatatcaaaagagactggattcctcaagggacatggaagaagacaaaccggaggcaaggacaaaggtcttctctcctttgaatcacactttcatttaggcaacaattatttattaagtatgagcacgcttattccctcaagaataaggcaggtaagtaaagatacactataaagatggaatgaaattcggtttttaaagtttagaggaaaataactctgtcaagacagtctgaagtacacaaaccttttgaagggtttgtttcttctgattatattaaagtacagctaattgccctaatagtttaaagatcctaagtgggaagctgtgtaatagctccaagtgcttaatttggctactggcaattttattttatatttcaaatttgaattcacatctcactttcagcgacaagacacagccacttcctactgccttagagttcctagcattaagattgagcggttcctcattactcagagcaaaacctgaattctccagtatggcatggaaaactgcactgagctggtcctgacaccctaatctatcatcacctcccactccatgctccctgtactccatcccgtcaactactcatccttcccaacacagcctctgctaacaagcctgccatcttgctggggccagcctctctgtttcaaacgcgctttctttcttggcctgctcaggagtccagtctgttgttaagatccagctcaaataaattccacctctgctgaaggttcccctgctttatcacacaatgaagcgtacctccatgataacatctattattgtcaatggttactttccatgtgtacacagcatcttcactaactgtgacttcctcatttagatacgcacgcctagtgcctatcataaatcctataatttaaggtgtcaataaatatttgccgaatttaacattttcttttttcagcaaaaaataaatgttttcttctttaaaaaccaaattctgcattcatctatttaaaaaatttattccatattagagtttctcctaactgtactaacaatgtataagggaatattttccaaatgtttctgttaaaactgcctcaagaaaccaaattctatgctgacatctgtgagaaattacaagatttcgctctttcgtccttctcaacttaataatttaaaattctaactgtataattttcaaccaacccatattagttattatttacaaaggacaggacaatgttaaactattccagggagcatgaagtgtctaacgctcatagggaactgtcaaatcagaaagcaatatacacataatggttatttgcttccactttgcctgatcatctgttatgtgaagtggtatctcctgtccaaagcataacaaaacttccccttctctacaggatacaaattagcaacctggtacatatcaaattacccagctgcaatgcactatgggagtccaggagaatattcacaccttcttttgccacctgagaaaactaccttgaaaagtgagttatgtccttggctagcttcatcaactagtccatacaccctacccgcctgcgcgcgcgcgcacgcacacacacacgcgcacacacacacacacacacacagactcctcatgtgtaacactactgcattacctttaagtgacctcacaataggcaaaaatcaagttgtagctctctgtcattcttccttcataaggaagtacctaaccatacgttcaaatggtgaagcattactggtaactgtggtggctgaataatgcctccttgtccctgaaacctacgactgtttcccgatatgacaaaagggactttgcagatgtgattaaggatctggagacgaagaggctatcctggtggctcctgaatgtaaccccatgtgttcttttaagaggaaggcagagcaagatttgatggcagtaaaggagaaggcaatgtgaccacagcagcagagactggagtgatgtggccaggagccaaggaatgccagcagcctccagaagtgaaagaggagtctccacaggagcttctattaatggaaggggctagcccagcgaacaccttgattttagtcccttttagtcactttggggctgggcacagtggctcacacctgtaatctgacaactttgggagactgaggtgggaagatgacttgagcccaagagttcaagactagtctgggcaacatagcaagatcctgtctctacaaaaaataaaaaataaaaaaattagccaggcaggttggcatgcacctatagtcccagctattcgggaagttgagcccaggaattcaaggttgcagtgagctgtgtttgtgccactgcactccagtctgagtgacagagggagatcttgtctcaaaaaaaaaaaaaaaaaaaagtcattttggactttgggcctccagaactgtaagaaaataaatttgtgtttaaaagtcactaaacttgtggtaattcgttacagcaacaacaggaactacacaaaaactaatacagtaatctggccatgccccgatagtgtataatattaaagaaagtgaaattatggttctaatgtttgttttcctgaaaacactacttttatgaccagaacatgagcatagtatgctaccattgaaaatttatctgacataatttgacacaaaagtagaatccgttttaaatgtattaccacaatgcatttgtcctgaagattgtgtttataacacattgcttttcagtatttccaaaacattatacgcttaacgctgaagatctgaaaaacacaatcataataaaagaaaacatcccacaacccaaagatataatttgccggtatacttcctgatatttttacatatacaaatggcccctaatgctatctagtttccagttatggtaactaaatggtcacattaacactttttaaaaaagatctttcccaattattaagaactcacacatatttgtccatcttagatcacttaatcatcctatcatcactgttttaagacaaaaaaaatcttattacttctaggaacttcatctcaaatagcatccccatcccctctctgactgactttacctgtataacttgcattctattaagcataagatgattaaattggctgcaaaagccagaagggacttttaatgaatttacacactaagaattgtgacaactatgtcttgatccaatatgaaagtttcttagatgttgaatctccattaaaaattattccagaggccaggcgcggtggctcatgcctgtaatctcagcactttgggaggccgagacaggtggatcacgaggtcaggagatcgagaccatcctgactaacacggtgataccccgtctatactaaaaatacaaaaaaaattagctgggcatggtggcaggcgcctgtagtcccagctactcgggaggctgaggcaggagaatggcgtgaacctgggaggcggagcttacagtgagccgcgatcacgccactgcactccagcctgggcaacacagcaagactccgtctcaaaaaaaaaaaaatttattccagaactgtcccccacaaaacaaaatagagttctaaaatgggcaacaatgcccagaaattgccagaacataaaaaacaagcacagagacttggtataaaactcaagacactgagaataagattatttggtgacttctttgaaatcaagatgatataaaagtcaatacctatgtcagaagctctgcatgtagtgagacacggcagatgccacacacacatacacacacacacacacgagaaagggacaatgaataatggagaaaactctagagagggacaaaaggaagaaattccaattccaatcataggttgagcatctcacagattcctaaatgaacaagagtggaaagcccacaacagatctctacgaaatatcactctctgtatcatatgattatgtctaaattgactgcccaataaaacacatatacttcccatctgatcctatgaattcagacatattcatgtaaaaacgtctttatatattgtcacatgtaattatacaaatttggtgaatatcaactggatcatgcagtctacatttgtctgtggtcaggagcccagagaagcagcacctcagagaacatgacctcacttgtgcttaaatctgtacctctcacactctgggaactcaccagagagctataaaggactttcaggagaaaggaggtcgaatttcaagggtggagagaagacccagggcacagggaatattattcttaaatctgtctaattctccaaggagcaaacctaacttgcccccatcctctagctgcccagagttcatcattcctcaattttgtttcaatggaaaaaaaaaattgtaatcaggactggatttgcctggaaggaaaatgcagagccagagactacaaagatttccattgcagacaattcccaatctagggaatgtctccagtaggagctgtggtgaagcctggtctgttccggtcaggccactcctgtgataaccctcagaaacattacaacccacagtcaagccctgtggcaacaagtaaggaagaaattcacctgttgttcagacaacagctgctcctttgagctgaagaatgaaatattaaattccagcttctgagaaaatcaaggaatgtgggtaagaaaaaaatgaggggacagaaaagagggagtgcaggtagatgtcaaaaaaaaaaaaaaaaaaaaaaaaactaaaggttgacctcagaaacacagatattacaaatgttccttcctatttctccattttattaatacgagcaagtttcaggtgtctacttcctatcatttcatgatctggaaaatggatctactctgcgggtacaataagctttaaaaatgactacgcagttacagagggcttcatcacaagatcttatttatgcactgaaactccaaaaatatctcacaataggagtaactggcgtattcaacaattatgtaaataaataataaaaagtctcaatcaggacaccaatattaactccctaatcaccaattttccccctcatttgatgagggtaggagtagagatgtgcaaaatgggtgaggctgctaactattgaacattctctcctccaaagttaagggctctcatgtgaaactttatgggggcctctgttcaggtcttacagtaaaagtaaattggagagaatcatcaagaagccatcaatactcttaaaaatacacacatctgtccatagatggtctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaggtgctgggattacaggcgtgagccaccgcgcccggcccatagatggtcttaatatgtgcctaggtatatgagtcatgcagatatctaagaggaagaaactattctgcactattctgggtgacacgatatccacagctctgatgacattgttctctccacacagagaagaaactataaatagaaccctaagcatcatgttccacatatcaaagaaggagatacaaactatttttggaatacaaataaagctttagtaacatgaaataaaacacctgtcaataagagacattaatctattctacaaaaataagaactttttaaaaagaaatatggcctttaatcagagatgatgtaatgacatatcaaatcaatgtcaacaccctgagaaaagccatctcctactgcacaattaccctgccattctcagtcgaagactgtcctctattaaacattatctggacttctttcctttgttttatggagtgagtttataaacgcttgttctccgtaactagtgatttcaagtattctgttttatctaagaagtacaatgaaggtcatgagaagtcctctattaacactttatctggacttgctggcactagtgtaactattttctacaacgttctatttcataactttctagtactgccacagacatctttctaaaatacaacctgttcataatgctcttttgtagataatggttcagtgactcctccctatcgccaactttaaacctacctccttgacaaagcttatctggtgtgcctgcagcctcaccagatacctttcattctattctcttctctcccctccatgcctgtctagaaggccgccttcacctagttaactcctacttgtcctgcaggaaaactggaatggctccactgggaaacagctggatcttccaagctctataggctgagttttccagtacttccttgtataaacctatattatgatacccacctttcaggtttgtaaatctttacttttctgtaccccttctagactatgaacaaggacctgatgaagggtagttactaaaatgttggctgactctaaaggaggtgctaattgcctcacactaaaaagagggtaagaggtgacatggaaaatttcacataaagttggtgccattggaactggatcttgagtgatgaacagtagttttgagatgttcaacagaaagaaagggcattcagatcaacgagaatcaaatgaacaaaagaaacatgaaaaatcacgtgttgcaggcatgtatgtgtgtgctgatatgtacatacatctttctaattactcttcttctgtggtggtgaaggtgcaatctataccaccaatataagcctaatcagcccaactaggccacaaacttattgggaagaaatggtcatttctatgtaccttccccacaggcaatatatagacaaatacaacctatgtgtacccatccctacccagcaccatctaatacatatggtataaagaaatgacactgaaataataatcataaatacctattcattcaaggaaaaaaggtttctatttggtgaaaaacagacatttgagttaatctgttaagagtcctaggtaattaggaaattactgggggaaaagaatcctattactgtaattccttttaaccaagattctatgctacaggatgaagtaaataagccagggaggtgagctgcaacataaatcagccgactgtcacatgagtctctttaatattacaaaattgagggagagaaaccattcagattactacgaagaaacatttaaaatgagctcattaaatgcaaattaaaacagaaacattgaataagcactgggctacaattaaaggctgcagaaacagcaggtaagaaacaattttcattgatcaaagaactaatagctaacagaataaagtattttgcattaaaactgctttcatgaatatgaagcatttcgaagtaagaactcttttttttgcatttttcaaagaaactttggaggtaggaatggatttacatatcttaatacaaagtactttcattgtatcattttcaggcaatgaaactatgaggtttcaaaaaatgcagacttcaaaaacatcctcagaaatagggccaaaattgtaaagggcaaagggtcattttagagcctttggacccaaggaagaactattatataattacataaaatcttctatgcaaaactttagtagagcctatttttgacacaattttacctcattataaacagaagctttggggtacttaggcatagagctggttttcatcaacttatcaaaatggcagggcaaagagcagtacacagtatattcaactagaaatataaattgagactttaaaattcactgcacacaagcttgaaaacaaatatgcagatgtgtagccaaatggtgaagtcggaatatacattcctgatggcaagggactttttctgttgtgttccctcgtttccctggcacctagagcagttaagggtacatagcaggtgctggaatcactggatctgcttttgcaaaactaacgcactataagatgagaatgagaagttttcttctaaattaatttgaaaagttaaaagatactgtttttcatctgtcaagacggcaaaaataaaaaatcttcgatggcacatgggaggaaatgggcactcttatacacactgaaagggagggcagggccaccaaggacagttgtgcagcttgtacactgaaaggcactacccctagggtgagagagaggtgggggaccggagatccaggaggcgttctgctagtgaaagctgagtcagtctcaggaaggacgtcttttggcaattttcagcccagaggggcagggcagctctttactaccatgttgtattagtggaggctttagataggcttgtaaaattgggcaacttattttggaaaaattttgaaatacctaggaaaatgtaaaatctacaaactctttaactcaaattgtcatacgatttttattttacatctatgcttacatgtgcaagtaaaaagatatggccacaaacacttctgacaacagttgtctgtaaacctaatgagtgcttatttattggtaaatattttcataattagtgtatcctataaaagactaggcaggaatcgctgtggagtggatctggacatgcagatatgtaaattctcaaagagatgctaagtgaaacaaggtatagaagagactatgttccaatgaatggtttttgtcaatcaaaaatcttcttaaaagtctaagacactgaatgtgtatttcaatactgacaacattgttgtatatataaccatgcactctaatatctgctgttactcaaatacctaaatccagttctacagaacatttagaacataccacaaatatccccactaacattccattttaaacacaaagaattgctcatttttaaaaaagtcaaaatatatttttaatagaggtaccaaaaattacatttttctaaattgaattcttttaagcttttctattctgctttatatcatcttgaagtccttctccacactttccacaaaggcacaatttttaaccgacttcaattaaattatgtttctgtagctgcctgggtcagggcattcaacacatcaatcacaatgcaggtgggaaatgtaagtacttttgaaacagtcctcatgccaataagggaatcttcggttttgagaaagtaaaaggaaggtacatgtcattagcagtgaggtcacagtcagtcctgtttactcctattctaccaggaaacccatctttacgtttctccttaaactaagccaggatttaaataaagtggcagaatattattcgcagtaaggttgaggcgggaaattaaagaacaataaaattaaaaagaaagagaaataagttttcctgttttaggctaacttgttccagaagcagcaacaggcacagcctagacccaggaaaagtcttgataatattatctaatatgctctggagactctctcagcactccctcaacacagggagaagaaaaacaaattttcctttgttttacagaatgagtttatagactcttgttctctgtaactagtgatttcaagtattctgttttatctaagtagtacaacgaaggtcataaaaagcctgagtaggcctgaactacagctgcctgggcaccacagagaaggttataggataagcctgtgcccaggcaaacctagaaaacgaacatctgggttgcttggcaatggtcatctgcaatcctgtctttgtcctgcctctgtatccctgctttcacgccactgtaagcttgcttcaagctagcccacctccgtttgtgaagtgtgtataaaagtcaagtactgtctttattctgggcccagtcttttggatgtgagtcagctgggcctgagtacactcaataaagattctcctgcttcaacctgaggtctccctcatactcccgaatcccgcaacaaggtgagtgtaatagttagagaaagcataggcctgaaaggagcaagctttgagaagcactcttacctttaacagaaaatcccagatacatactatttacattttagtgatcactggataaagtctataatgtctttcctggctctgaatttttgtcacaaaaacacaaaacccatcactccaaggcttccttttaatggttttcactttcacctacctttagcactgttcacgacacccaaatcccaaactgaccattcagatgtttactgaaatgtggctaatgaggctgggcgtggtggttcatgcctgtaatcccagcactttcagaggcgaatgcgggaggattgcttgagcccaggagtttgagaccagcctgggcaacattatgaaactccatctctacaaaaactataacaaaaaattggcaggcatggtggcacacacctgtagtcacagctactcaggaggctgagatgggaggatcacttgagcccaggagttggaggctgcagtgagctgtgatggtgccactgcactccggcctgggtgacagagacagaacctgtctcaaaaagaggaaaaaaaaaaaaaaaagacgtgtgtctaatttcagaattaggcaatgcaactagttgaatattttattgcacattgtccatgatcttatatgtaaggcacatttcctagggaaagcaggcatggatttaatcatttatgttgtactgcacacttatttgcactatgtaaaaccatggctggagtgagagaaataacacttttaaaaaccaaccttatattctccatgtcattaccagtaattgataactgtttaatcatcaactccaaagatatttcttccttattggaagaattccagataaaactaaacagaactgtccaaacacatttcatcctaataaagttatttatataatcacttattaggtcataacttataactgagtaatgttctttagatcttaagtgcttgtctttatatagctttacaataaatttgtttctcttaaaattatctgtgcactagattaagttaaattaaaataaaatgtatttaactgtcttcaaaataaggtataggctattttcttcctgtagactgacagcacagatattggaaaatctcttctacttggttttctgattcagttcaaacttgtgcttgcaagtgaatcttacgtaaatgtcacctaaaaagagctcaagaagactcataaaaaatatttttttcgtaatttgattaactttcaagtcattcaccaaaagtcagaccatgctagaaagggaagaaaagttggacaacattcttgttttaccacaaagaccatgccagttagctggcttgattctcccactgatggggagaatgtttacattttaacaataacttcacaaataaacagatgtaagaagtgttttcagtgcataaagatcatatactttataaatccacctctcatctttcttctggacagaccacatctgacttcgaacgtacttactgcaatcaaaagtgttttgtaaaggaccctcctcaggaataaacaagctcactaaaccctccatacataacctggagaaacctccacaataatgaaaccccatctagcactgtttttcaaacatatggtgcatttccattaattttcagggatagcccctaaagtaacttttggctcaacaaccctggaagagaggacctttgctcatcttacacatcaagtgttcatgaacaactctgatgccactaagtttcgttcacaaacttgcacctcggtcgttcttttacaaaaaaaaaaaagaaaggttattttgcaaaaggcaatagatttaatcttggctactatttactcttaatgtttctttcatctcagccctccaatgagaagtttaaaaggaaacatccgagggagcaagtttagatctatctggaggagtttctgtggagccagccaccctcaccaggtgccttccattagagtttaatgctttgctgcggtttcctgaaagagccccacagagagtgggtctcgatgggtcctgaaccgcaccacaaccggccagtgaggtgaggggcgaaggtgaggggcggcggcggggcgaaggtgaggggcggcggcggggagaaggcttcgggaccccacacggtccgggggaccgcgaacgaggagcgggggtgcggggccgcctggcgtccccgtcgaggcggtcttcatgagaacgctcagagcaggggcgggcaggcgagggcttcgaacgcacacactggggccccggacccgcgtcgctgagctggggagcccggcggcgcgggccggggacggcacgggcactttggccccgtcattgacagttggcaccgggggtcctggtcggccgaggcggggcgtggcgccataccggggcgtggggcggcgcagagaggctgtacctggcaggtacccacgtacctatcatggtcactgggtaggtggcggctgcgggccaggaacaggcccatgcgcgcagcggcgccagccgcgcctcccaccagcggctctcctgggttaaatcctccaggcctccccgcccccgcgcccggccctaggaat

SEQ ID NO: 121 - DNA, 1380246 bp, Homo sapiens; identical to SEQ ID NO: 120

SEQ ID NO: 122 - DNA, 1380246 bp, Homo sapiens; identical to SEQ ID NO: 120

SEQ ID NO: 123 - DNA, 59562 bp, Homo sapiens
ctcgggttaagaaatacctttaaatttaggtaaataaagctcaaggaggtggggctgtcatctgtggtgtcagtccttctggccccctggctgtcagtgtcgctccagggccttgacaagcagctcattcaagcggcccaccatggccctagggtcgtcaacaagtccagcagcaatcatggcgttctcgtatatctgaaaggcaagaggagaaacccattatgaggggcatggggcaccttttcatttttttttttttgagacagagtctcactgttgccgaggctggagtgcagaggcacgatctcggctcactgcaacctcaggtgatccccccgcctcccaaagtgctgggattacaggcgtgagccaccacgcctggccatttttccgtttttaaaacagaatttggctgggcacggtggctcacgaggtcaggagattgagaccatcctggccaagatggtgaaaaccccatctctactaaaatacaaaattagccaggcgcatgcctgtagtcccagctactcgggaggctgaggcaggggaattgcttgaacccgggaggcagaggttgtagtgagccaagatcgcgccactgcactccagcctggcaacagagcaacactccatctcaaaaaacaaacaaacaaacaaaaagacaggattttagaggaaaccgctgttccaccctgaaggcaggctggcagggctggtagcctgggtccctgcagtcatcctaagctgctgcactcacctgatccaccagcagctgagccaggccaggctcgcttgcgcgcagctgattcagcttcttgatgagcgcgtgcctgcaacacagaacccaccagaaaaagcagctcagtaccacgtgctgtgaccctcccttcatgttttgggattatcaggatatttaaagaagcacagtaagactgtctgtagttttttaaataaggtatgttaatgatcatttatagataatatcattatatacccagaaaacccaagagaatcaggagtgtcagtattagaaaatgctgtaaggtagccaaactccaagattaatatacactaaagggacaaaaggagcttagtacgtgaagacatgccttggttcctagataaataataaaagagaagggagtaagacccacatgttgaaacatattatagggctctagtaaataaaacagtttaggtctggaaagggggaaggcaaacaactccatgtaacgagggtggacactgagtgtctgatgaggacagtatttcacagaagagggaggagacagatcactccatccagcagcactgggatgactgggagccatgcagaaaaccatttagaccagagtaaattccagagggatcaaagatgacaagcacaattctagggaagaaatgtttcatcatctcagaaggggaaagcctttccaagcaaaaccacaaaccaaaaagtaaagaatgattgacatatttgacgtcagaacaatatttttttctgcataggaaaaagcatcatgtagtatttaaccttaacatgaatattataatttttcacttagaagtctgataaaaccgagggctctggggaactgtaaatttgtacaacctctccagaggacaactggagtcgggaaaaccacatgtggatgatatgctgagactcagccattccatttcctaactgcatccctttaaacacttttttttttagatagatagatagatagatagatagatagactctcactccttcacccaagctagagtgaaatggcatgatcttggctcaccgcagcctcctggtttcaagaggttctcttgcctcagcctcccaagtaactgggattacaggcacccaccaccacccccagctagtttttgtatttttagtagagatgaggtctcgaactcctgacctcaagtgatccacccgcctaggcctcccaaaatgttgggattacaggcgtgaggcaccgcacccaacctaacagaggaaacacttcaaatgcacatcctcacatttctagtctacgtagctggaaaaaaaggacattcttaatatgctaatgtggaggtcacctagttaccctaagggagaaaagcaaggcaaggacccactgcacagcaagttcccccttggaagcccacgggcgcagctgcccacaaatgcacataatctctgcagaaatacaaaagccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgggaggccaaggctgcagtgagctctgatggcgccactggtacactccagcctaggtgacagagcaagaccctgtctccaaaagtgaagtggcaacagacagaaacgagcacttctgcagctatctcacaaaactagtttgccaccaaaactagttaaagtgacctggtgtccgcctcactgagctgctccagcagaggcacaggcattctgcatactggcgctgctgtgcactgacagccataagccaagtcagcctttccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggaggctaaggcaggtggattgtttgaggccaggaggtagaagttgcagtgagctgagattgccccactgcactccaacctgggggacagagtgagaccctgtctcaaaaattaaaatactacttaggctacattgtggggggggtggtaagtctatggattttgatttcctttttgctgttttctatttttggtaacatgtttatgtaacttcattttttaaaaaattgctacattcaaaatttcccccaaaaaagaaacttcatatacaagttagttcatatacaagttagaaaatgaaattttaaaataccccataagacacatcaaagaataattctttaaaaatggtaccagaaccctacagagaatgtaaggtaccaaaggatgttaaagacctaaatagatcacattcatgggtgcaaagaagtgatactgtaaaaagaaagaaactcaaaagatacctaaaggcaggtgaaaagacatttacaacagataaagggcatataaagaacaacaggaagaaacgagggaaatcttacggctcagccactgtcagggctggggggttctcggtgcaccctggaagcagctcccaccaccggggccacagagaaacccacacaagccccagacacgtggacaagaatactcagagcagcctggctctccacaacttctgaccaagaaccaccggaggcccagcagagcagaacggagcagtctgctgtgccgaggtgggtttctgcagcggacattattcggctatgaaaatgaacttgtggcagcccctctgcatgggcaaccctcatgccaagtgagcaacgtgagacttcagcaaacaccaagatccacgtacaaagctcaaaacaggcaaaactgagcatgtccaggacacgcacaggtggcaaagccataaagcaaaacgaggacatggtcacaggctgggatgtggctaacctcccaggtgacacctggggatggtaaggggctggccaggttccatttcacatgggtgcagcctaaactgcatacagctccttatagttacccacatgtccacaggcctcacgcacttttcttctgtgtcacattccacaacaaaagaacaccacacacaggattctggggaatcccacaggctggaagagccaggagcgtggcctcacctggggttgatctccagcgtgggctgcaggagctgtgcgcgctcctcctgggtcttggccagctgctgcatgcgcaggaagtggcgggcagcccccatctccagcacggtgaccatggcagggtgggtgtccagtcggagggtcacctgtgagcaaagcccggggttgagggtgatagaggttcccaatgtgagagggctggcaggatcttaccaggggtgaaggtcacccagaccacgaggtagcaggcggggtctcaaggactcccctggaccagcgctgctccctccccattacccactaacttgtgggccctgagctgatgccccacgcaaagatactgtgcccgaggggctccaccaccctggtgccccgctgctgcctccaggagctgcccgaatccatcgtcctctgctccatgccagcccaccctgcatgaggccccttcctccaagtgaccatgcatgggacgctcatttctcactctgagctagacaggttggtggggggagtcttagctctctgaagcccacccaaaacccccgactaagcacccaagtgagcatgtgagctcctgagggctggggtagcatgtcccttgtttggaacccccacgtcctcagccattgcagctcccactcaggatgctggtttttcagttctcagttcacacctgctctggagcagggctgggagaaagacacggccttcctgcctcagcggcactcccgagcaacacgtgccgagcagggacccacagggtctccacctgacaccaagggcttctgctgctgctggaaggacacccaacgggccaggtactgggagccaccagctggccagcctgttagggacactgcggccaagtggtggtccatccccgggaaagcctcaccttcacgttggtgacacgcgaccccagcacatttctcatccaggccatgagctcctccgtctccttctctgataggcactcggcggctgcggaagagcaggcgacagggagctcaggcctgcatcccaactccccggcttccatgggggccacgcagcatgcttccagctcccacctcctctcccaccaggatggagacacaagctagcaagatgcttttcatctaaaagtaaaacctcaaaggatgcttcaggttgcctgaggcccatacaacttggttagggctttaaaaaaatacacagcctctcaagaagctgggccagctccagaagccaccgtggcaggagcactggacagacccctgatatctaaaccaggaggcaccttcctccagtcaccagggtgctcccacaaggctcttctcgggggtggctgagcccaggtcaactgacgaaaacccaaaggaagccctcgctgcggggcaggagaggcgtgcggggagtggaaaccagccccacgcctagagagcaggggatgccgacctggggacctgtcctcaaacttctcctccttgtagtgatccacgactatgtccgtctccacagagatcagcttcttcttgtcaaactcacgaaggtgcagcagggtgagctcatcaaactgctcaaagcagaagagaacctgcaggtggccaagagcagctccatcagaccccgggggcctccagccaccacagaagaaaggatgagggcggcaggagggctgggggagccaagcgggccacactggggaacaccggggcagttggggttcctaggcctgcatgacagttactacgacacctgggtctaaggaaggctctgactgccttcaaggcagaagcactccacgcataaagaaatccacatgtggctgagtgcagtggctcacgcctgtaatcccagcactttgggaggccaaagcaggcagatcatgaggtcaggagttcgagaccaacatggtgaaatgccgtctctattaaaaatacaaaaatttgctgggtgtggtggtgtgcacctgtagtcccagctactcaggaggctgaggcaggagaatgacctgaacccaggaggcggaagttgcagtgagccgagatcgcaccactgcactctagcctgggcgagagagcaagactccatctcaaaaaaacaaaaaacaaacaaaaaaaaccacatgtgacctccaagtgggaaacagccgtcacagtcggtccggcctctgtgcccgtgaccctgacccactgtgcagccctgcccggagtcttgggcaggttcacccagcacagagctgagaaggtcaagaccctccccaggttgcagcccccggagcccgccccacccaccgctcacccacctctgtgtctttcttcttcatggcctcatagtagggtgagtgctctgccaggtgacggttgggggcgcacaggtagtagatgttgcgggtgccggcccgcatgcggctggcgtattctgagaggctggttagctgcccggagggcagcgccgaggactcgtagcgcagcagctttgctatgtcctcctagaagggacggggcaggtcaccacttattccaggcccatgggctcaatgttgcccaactaactgggcgcaaaccctccgatgcccatggcctcctggcactccaggctggccctgacccgagggacggtagtggactcgggggttgtccgagagcaggccttgctctgcccatcaggccccttttgggagctctgggggcttaggaagcacctcctgccccaggtggcccaggggctctccagggagctacgcgcaccacgccctgggaggggaccccacccaacagcagagcccggcctggacccagcgtcttccctctgccctcagtgacagagtcagtctctggtgggcacacggacacgggtgaagtccacggttcccggccctcctcacagctggctatggcagagactggctttgcccagtgggtttcagtgggatttggagaagggcccttaggggaggggtttgccctcctccccatcagctgaacgcagctgtgacctctagagctcatgggagctgcagctggaaggacgcagggggaaaacagaaagagggaaaagcaaggagctggacacccaaccagcagggcccaggccacccctgcacacatggtgggtctgcattgataagacatgtcacacgtgcacacctacaaagacctagaaatgtctctgactcttacctgtgtgctgttaactcaaatgaagataaaggagaatgaagaggcctgtgtcagaagctgccgaagtcggcaaacaaccagaacacggcctccttgggaccccacacacgtggtcaccctcctcctgctgctggggagaagggacaccagcacgggatgggctcctgggatgaaatgttctggggttacagtggaggcagccacaccacactgtgaatgcactaaatgccactgaattttacgtgttaaaaggtgaattctgtgaatctgatgctatgtaagttgtatctcaataaaaaatggacaaaaaatgtttatggaacaaatgtttcgtttttcagccatccactattggattaactgaacgactggcccctgtagcatagtatttggagactgatatccagtacatgatgaatagtccctcaacagacactgagaccacccacttccccacccacgggatcggagtccttggcttgtcccacctgtctgtggctccccagcccccaacatcctctgaggggagacagtgtgtgcacgccctcttcctgccactccctgggctgcaccttcacacagcagtgaggctgagcccttcagagcacagcacagcactggtgggagggtaaggatgtgcctggaaggtgccagaggcccagaagcctggccttccatttcctgaccctggtggcagcagcagcagcagccagggtacccagctgcaccgtcgccacatcaggggacacctccaccagcttcctcagcagccccagggacaaggtggcccagaaaaaggcctggaacacagctcctataccttgacctcctgctcggtggcggtcacaatgccctcccgcatgaacaggccgtaatcttcaaaaaactttgcatacttctcagcatcttttttactctggtcaatgaagaatttgatcagcctctgctgtaaaacgtcccggagtttcctacagaaaagaaatgcatttaatacatacaagcagcctctatgaaatacaaatggccagagggtacgaaaaaatgttcagccccgctaagaatcaaagaagtgaaaacaacaaggtaccgttattggccaaactgaaaaagactgagcagaaagacagaaaccctgggcagtggccggacaggaggcagcagggtggagggcagacaccccctggaggcagtaggagaaccgatgcccccagagacaagatacccacgcccggaaaacccttccaacctttgagccagttgttccaattataggaactgcaccttaggaaacatgtgagcacaccaagatttatgtaccaggattttcactgtggcacataaaatataacaattatgaacaacctcatgttcaagaatataggctaaaattatgtaatgctaaatggccataaaaaaaaaaaactgcatcttttaataatcctcaatgacatgagaaagttagctgtgttgaaagaaaacccagaaaaatcccaatgtgggtaaattacagtacgtctatagatacaggcaaagaatgcacattctacatgtacataacaattttccatcattaggagcagcactgtatatactatatatgtacactgtaatttgggatttatactgaatatatgtatactctaatttttcaaaattgggattttagggatcaggatatttactgcagcattacataatggcctaaaattaggaacaactttatcactgggactagggatatttttattttcttcttaatatttagtctttcctttaagcaggtaaattacaatgtatttcaataatccagagcatgggaacaacactctctcgagttcatttagagcctttcctcccacactccatccccagtgactcagtccttcagccacagggcagaatgggacaggacatgccttcgtgcctgggagcggggggacagtagcccaggatgcggtgcagagcccagggaaggtgtctatgcagggccatggttgggaagagcctggtatgggtgtcagagcccaagaaccccagagaagggtgtccaggctgggggcgtgaccagcccaccgtgaagagtcagagcccaagtaggtgacagggacacccgcagaagagggcagtggcaatggtagattggttacatggagggggattggtcaaatgggtaaccgtgctaagaataatcaacggggcatggtggctcctgcctgtaatcgcaccactttgggaggctgaggcgggcggatcaccagaggtcaggagtttgagaccagcctggtcaacatggtaagcccccgtctctactaaaaatacaaaaaattaccagggcatggtggtgggtgactgtagtcccagctacttgaaaggctgaggcaggagaatcgcttgaatccgggaggcagaggtttcggtgagccaatacctcgccactgcactccagcctgagcaacagagtaagactccatctcaaaaataaataaataaataaataaataaaaataaaaaaattttattaatgatagcaagattataaactcttgaataaaacaggaaatcagcccatataaataaattataaatagtataaatataacacatcaatttttttttttttttccatccgacgaatcttgctcttgtcccccaggctggagtgcagtggcgtgatctcggctcactgcaacctctgcctcccgggttcaagcaattctcctgcctcagcctcccaagtagctgggattacaggcacctgccaccatacccggctgattttttttttttttttttttttgagatgagtctcgctctgtcgcccaggctggagtgcagtggcgtgattttggcgcactgcaatctccacctcccaggttcaagcaattctctgcctcagcctcccgagtggctgggattacacctgcctgccaccacgactggctaaaattttgtgtttttagtagagatggggtttcaccatcttggcaggctggtaactcctgacctcgtgatccacccgcctcggcctcccaaagtgctgggattacaggagtgagccattgcgcccagcctaatttttctattttttaagtagagacggggttttaccatgttggctaggctggtctcgaactcctgacctcaggtgatctgcctgcctcggcctcccaaagtgctgggattacaggcgtgagccaccgcgcccggccaacacataaatattttaagtaaataaatgaatgtattgagagtttcatgaagaatgtgacatttacatagcttcaaaatacctataacatctgttaattacaaagggaaggacatccttgtttgttggaaatgcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgggcactaccagtgggccagcatgcctgccacagccaggaatgcagctcccttactgagcaggaccacccctctgtgactcagtttccacaactatgagtgaggactcacggctcccctcacaggatgaaacacgtgtttatgcaggctcagcacagttctcagtggagaagaaatactcaggaaacacattcaggatggggagaggaacgcagccgcctcggcccgcagggacgccaggagctccctctccacagggcctggcccctgcctccacttcatccgtgagcttcccagatgaggccagacgtgtcctcagttcagtgggtgtcctttgccttatccagcccagggacattgtacctggaacctcccctcctgtggccactcctgggcagggtgatggggatggacaaggtggggacaactccagcaccagcaataataatccgggagtcagccccaagccctctcttcactgaagtgaactgaaacattgggcagatcaccagtaacccacaggcgcactcgaagtgcacagggtcagtacaccaaagagcacgactctaacgaccacagaacagtcgctgctgtggggcggggatgcatcctgttgaggtcagcacaactgctgccctgtggtcatgtcggcagcaagtcggggtcctgctgtcagaagccagcacggctgtgtggggaaacaagcactgaggcccccttttcattgattatataacatctctttagtcagcaaggaaaataccttttatatagttatatcttccgaccaagtaaccccacccctagtattctatcctaaggaaatacagctgcaggtaaagatttcagaacaggccaggcgcggtggctcacacctgtaatcccagaactttgggaggccgaggcaggcagatcacaaggtcaggagatcaagaccatcccggctaacacagtgaaaccctgtctctactaaatatacaaaaaattagctgggcgtggtggtgggtgcctgtatcccagctactcgggaggctgagacaggagaatggcatgaacccgggaggcggagcttgcagtgagccgagatcgtgccactgcactccagcctgggcaacagaccaagactccgtctcaaaaaaaaaaaaaaaaaaaaaaaaaaaagatttcagaacaaagataaacatgcactgcagtgtcataactgcagaaacactgagacagcccagctgtgcagccccgagggacgggatcagtaaactatggtacatccctgtgatgtcccatgatgtagcaattaaaagtgcttccaaaaaacaacatgggaagtggtgcaaataaactaggtagaaaaaaggaaacagtataagcaatatgaattcaattgcatgaaaaacaaaaacaggccgggcgcagtggctcaaacccgtaatcccagcactttgggaggccaaggcaggcggatcacgaagtcaggagatcgagaccatcctggctaacacggtgaaaccctgtctctactaaagatataaaaaatcagccgggcatggtggcaggcacctgtagtcccagctgagacgggaggctgagacaggagaatggcgtgaacctaggaggcgaaggttgcagtgagccgagactgcgccactgcactccagcctgggcgacagagcaagactccgtctcaaaaaaaaaaaaaaaaaaaaaaaaaaaaatctaagtggccaggtgcagtggctcatgcctggaatcccagcactttgggaggctgaggccaaaggatcgcttgagcccaggagttcaagatcagcctgggcaacatagtgagatcccaactctacaaaaaaatacaaaaaaattagccaggcatggtagctcacacttgtagtcccagctacttgggaggctgaggtggaaggattgcttgagcccaagaggttgaggctgcagtgagctgtgatcacaccactgcattccaacctggacaacaagaaagaccctatcagtcaaccaataaaacatcactgcggcttgcttggttgaaaaaagaaaaaaatctccatggctttctgcctctgaaggtgaggcaggaggatatcaccggcaggccatgtgacctcgcagggctgggcatggacccaccaggcaggaaaccacactgcccaccatctccccagacctgctcctgcccgcggcacaggacagaatctctgaggaccagtgcctctcggtgtgggcctctcgccatgcccacagcgcagccccaacacacaccaattacccagactcatcctttttccgaggatctgcttccatttcaacactggagagaaaccggtgggcagagaaacactgcaggcacgttgggggctccaacaaggcccgttccatggcatgctgcacgtggtgggctcttgagagacctccagggctccaaattccagctgaatcctcaccccacaggctccctctgaaacctgccctatgtggctgccaatctaccccaccctaaaccatcaacagcagtcatctctaggtgagagcacaggtcacttgaatgtgctctagtaaggaaatactacttgcattaggggaaaaaaagccagtaagcgaggttttgaataaagactatttggtgagcctggggccagagtggggaagtgatagctactgatggagaacctggagccagcacactggagtcccctccacacagggctggcctgctgcagggctgcagtcacaaccctggggcacaggtgggcaggtctggctctgcggcccctccccctatccagactccagcctcagccatgaccagccacccccaccttcttctggaccacaagcttcagaggccaggccagcacctggaaggctcctgagggcccccatgtgcaggccgggcttccccgaccacctctgctctcagctccatgggccacggctagggccctctgggggcaaaggagcaggtaggggccttgtccccagcagggtcctctccccgcggcccgaggctcacctgatgagtgcgctctcctgcagcagctcccggctgaggttcaggggaatgtcctcactgtccaccacacctgggagacacggcagtcagcttctcccggggctgcggccctccacaccacccaacattccccattaacctgccctttgtcttcaggcctggccttcaacccagcacgtgtgctaagagggaagcagggaggcggcactgccggagcttcctctacgtcctgccacctcccagaacagtgacctgggctgtgggtggccgggacagcctcggggtaacactcggaaaatgacagcctgggctttatgttaaaaatcacaactctggctgggcacagtgtctgacgcctgtaatcccagcgctttgggaggccgaggtgggcggatcatgaggtcaggagttcgagaccagcccggcaattatggtgaaaccccatctctactaaaaatacaaaaattagccgggtgtggtggcgggcgcctgtaatcccagctactcgggaggctaaggcaggagaatcacttaaggaggttgcagtgagccacgattgcaccaccgcactccagcctgggtgacagagcaagactcgtctcaaaaaacaaacaaacaaaactctatcagggatggttcgcacctctgtgtaccaaggcttaaatactgaagtctttcttaaactataatctcactcaaacgtaacacaactcacatatcaatctgaaactcagtatccctacatatggaaagacctcaatctgaacaccccagtgctccccccagatcagtcatgtgcgtagggaggtggggcagctcccggggtctgtaaacgcgactgacacacaggcagcgcaggccgacggcggtgctctcgctgcagagggctgctgagaatggaatcagcacggtccctcacagatgcagcgggcgacactgggccacgggggcactgctcacggactctgagcagcgtacctcggatgaagcgcagccacttgggcaggatgtccgtggccttggtctggatgaggactttgcggctgtacagtgcaacgctggagcccagctcccggctcacatcaaacatggacggtttctgggggtgaggagaacacgccatcatgcagcactgaccctccccaggcaggccctggctgggaggtgggggcggacacgatgaatccagagcccactcccgcctcgccctcccccagcgtctgctctgagttgaagcccagtgcaggggccccacgatgccccacactgtggctctgcaggggctgaaggccttctctggcagctgccgccctccccagcccaccccctaaggaggacacaagagagtgaaccttgcacgtacccctgaacacactgaacacagccaaaccttgctacaggtcagggatcagcaaagagccctccgaccagatccagctcactgcctacctctgtgtagcctaagagtggtttttacactttcaaacagttgaggaaagatttcaaaaaggatgatctcatgagacgtgaagatgaaactcaaatttcagtgtctacgcagctcatgggacccggccctgtgtgctcagagggcagcagggcagtgctgcttcctcacccggcagggttagtggctacgaaagacaccgggcccgaaacgctgggaccagctcctgtctggccctcgtggaacgtgcctgccaacacctgctccacactggtacttcccgaaccgggacccacacctcatcacgggatctggttaaaatgcggcgggtatctagttcaaatgttgggagacctggttaaaatgtggggcgacctggttaaaatgggggggatccggttaaaatgcggggagatcttattaaaatgtgggctcccacgcaggagccctgggtggggcctgagactctaacaagcccctggaggccacacctggctggctctttccaagatggatgccagctgtgcaggacattaggagagtttccaggcagccaaggacagaagagcctgggggcaggacgggctggctctcagccccgaataggtctccttacggcaggatttgcgggaacttcaatgtggtaaaggaaaccaggggaggtggagggtgtggaggaagcacacagagaggccaacggagaggcaagaccacaggcccttcccagagcgcctggcaggacagcatccactgatccacagcagatgatgtaggctctgagggccctccccaggcacaccccagtccacaagcctccaccccagcctgcactgagatgcccatcaatccttccctcgccatgtgtgacccctgagacagaggaaacctctgtggttacccacccagaggcatctgttctttttttcttttttttcagagatggggtctcactatgttggccagcctggtctgcaactcctgggctcaggtgatccaccctcctcagcctcccaaagtgctgggataacaggcgtgagccaccacacccagcactacctatgtttttcatgccctcacactgccatgttaatcatgtgacatctgcagagctgatgccacaggggacaacagagtcaccctgagggccgtgggactgccacagtgcctcaccatgtcgggcacgtagaagatgctgcggatgttgagcggtgcgtccgtcttatagtgcagggtgtagcggggcttgtcgtgagcctgcgcgacgtagcggtagaactcctcatgttgccactcacggacatccttggggtccatcatccagatggcctggaaacggagatcggcggggagggcgtcgtgttcaccacgcacgtcttctccaccaccgtgcaggcctgagccagtgcagcgcctggccctggacaggctcctgggacagacgggcggtggtctcaggcgtagacccctctccagccccaccgctgggctatgccgggtagtgcaggggagacacacaaggctctggggcaggagctcctcaggacaacatgtcaggaggaccagccgggacctgagggggcctgtgggagaggatgacgctgcccagcaggggcgagctgacgaatacagtgtgggccgtgagagcgatgacgacccacgctgcaccgcagctgagccgcgagggggaagtcagtcactgaggacagcatgccgtgtgactccatccaggagaaacgtctggaacaggcagcacaatggacagaaaggagaccgtggctgctgggactgggggaggggcagtggggaaagggctgctttttggggtgatgggatgttctggaattgatgcggggtggctgcacagctctgtggctgcactgaacaccatggctgcacactgatgtggtgagccagctgggatgggcgttacgcctcagtgaaccctgacccctgaccccggctgcccggtgcacaggggcagggctgtggtagagctgggcccctgtctcatccccacacccaggtctcatctccacagagcagctcgccctgtgactctgggccgcatcccctgggctcatctcttctccgctgccctgaaacgtacagatttgtctccatgtttgaccagtccctagaggaactcagggctcacctgcaaggtgttcatccgccttccattcaagtacaaggggaagctgacgaagttgctgtacttcgttaccacatctggaagggacaaaagaaaaaccacactgcatctacaatgcttgtggaaacgcaagctttgcagcagctccaggatgagcgccagcctgctgggaagggtcctccatgctgtgtacacttcacaggtacagaaacagggcacagtggggacacctgtcctccccccagtctcacgggggcagcagcggagcccacgtgagaaccagagctgtggaggccccggctgctgcgagactgcaatgtcagcttgtggctggaacatggctttctgggctgactcctgggggtactcagggcctccctgagtgtccagcaggacacaaagagggaaggccacgcccacatcctgggacaggactgcgccaaacccccaggtgcactaaaggccaagggccacgcagaggaaggaggaggaggtccgcctcagccaggccagcttcctcccagtcccagcaggagctcgatgctacgcagccctggcgggcagcccccctcccagtcccgcagcggctcggcccttcacggctctgcctgtgcaccctacgtgcaggtagaaccagggaaaatgcctgctgacctggtggcctccaggccacacatggatcccagagtgagcctgggcccgggctcccgctcacctcgcacccgggcctcgctggaaaactccttgcagtcggatttcaggtggatgatgatttttgtcccggttctaactcccgaagcttcggcgatttcaaacactccagaactaaggcaggcaaagaaaggaaaagccaggtggatgtgacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggcctggggcactgtgggggactggcccagctccaaatcgggtgccagatgcccaggggcaaaaacaaaggccagggggacaggcgccccctaagaagagcagaaaaccatctccgaagcacaggaggggggaatcccccggcagggccatgttgatgccttggcctaagtttactctgagccccgctcccatggaattaaacaggaatgttagttttgggagagtggggagtcaagctgagcacagtgcacacactgtggagcagaaatggcatcacggagggaggacgcctcggctggctggaagcggctcacctgctaaaaagccctcggagccaggcgtggtggctcacgtctataatcccagcactttgggaggccaagacgggcagatcacctgaggtcggggttcgagaccagtctgaccaacatggagaaaccctgtctctactaaaaatacaaaattagctgggcgtggtggcatgcgcctgtagtcccagctactcaggaggctgaggcaggccaattgcttgaacctgggaggcggaggtggcagtgagccaagattgtgccattgcactccagcctaggcaacaagagtaaaactccgtcccaaaggaaaaaaaaaaaaaaaaagcccccagcaggctcctcaccctatagaggcagaagtgggctggggagacaaagccaggaaatgccagggctgggaggaagcagaatgagctcttgcagaaggtcggtcacaggaggctgcatagtgtccaccaggcgacaggccagtcctgcagctcagccactgagaaaggagctcagcgcgggccggacctgccttcccgagcgcagtggtggtgaccaaccacatgggaccagacaggtgccataggccacctggagccacaaaagtcactaactccccaaaatgggagagtcagatttcatataaaaagcccagaaaatgcctgtgtacgttttctgagtccatccctttccaaactccatgctaagggctccagctcagctttgagctgcctgtcaggcgacattcgtcactcacccatctgaaagccactggtaacccaggctccccggggctgccgagcgggaatagacctccactctgtcagccaccatgaaagctgagtagaaacccactccaaactggccgatgatcttgctgctggcctcagcctggttctgcagagcatccaggaaggcctgtggggcagaggccagttagtgaggcagcctcccctccagagagcagacactcccaacaccgtggctcttctgcgagcaccgctaagaccccttcatcctgaaaacagccacaccgagtacttttccaccccattctacacgtgaagagctaagtcacagagaggtgacacattagccctaggacaaccagctggcagcagtgggacaagtgtgttttccatttgattcccaaagctcacagtcctgcctgtcccagacaggtggaggcctgtgggtcacacctgggggtggggaaagagcagcttgaataagctctttcccttgaataagctccttccataggaaggccaggagtgaggagaggctccaaactggcttccatattcaagtctcctggactctacactttgtgggaaaaagagtagaaatcacgcgcatgcgtctgtaagcaccgcacagcacttcatttttctactataatactgccaaaggtcctaaggccaaagtcaagtaaaatacacacgcccactgccctggcccacgttgtccgatggaactttctccaacaacaggaacgttctgccaggtgcaatgcgacagcctgccgagcacctgcaatgtggcctgtgcagctgaggagcacaatgtccccttttatttaatttgaatgcatttacatttaaactgccacatgcagctggtggccgctacacaggacagcagaccaacctcgagagaaatacaacaaaagacgtaacgtgggggtcaagtcacagttagggtgggttttttgtttgttgttgttgttgttgttgtttttgagatggagtgtcgctctgtcgcgcaggctggagcgcggtggcgtgatctcagctcactgcaacctctgcctcccgggttcaagtgattctcccgcctcagcctcccgagtagctgggatgacaggtaccaccaccacgcccagctaatttttgtatttttagtagagacggggtttcaccgtgttagccaggatggtctccatctcctgacctcgtgatccacctgcctcggcctcccaaagtactggggttacaggcgtgagccaccgcacccgacctagtgttttcatcttacagatgaggagactgaagtaagtgctttgcccagagctggaaaagggcgaccgctggaggttcccaggctgttggtctgagtccaaatgtgttgctctgcctcacagcacttttctgcaaagtcgattccctgagccttgtgggcttgacgcagagagggtcagagggatcagtcccctctcacacagcgccgtgatgagaacgggcttgggatgcggcgtctgtgggtttgatggttctggtcagaactgctctgtgggtctgggcatagtgacgtgcacctgtagtcacgcctcaggaggctgaggctggaggatagcccggccaacatggtgaaaccccgtctctactaaagatacaaaaaattggccaggcgtggtggctcgtgcctgtaatcccagctacttgggaggctgaggcaggagagttgcttgaaccgggaggcagaggttgcagtgagccaatacagttggtcctcctatctacgggttccacatttgcagattcaaccagccaaggatcgaaaatactcagaaaaaaaataaaaaacaacacaatgataaaaagtagtataaaaaacataactatgttatatctatatctagcatttacattctatcaggtattataactaacctagagaccatctaaagcatacaagaagatgtgtctacaatatacggcaccaatttaatccgggactggagcatctgcagactttgctatccaaggggggtcctgaaaccaacccctagatactgagggaccaacccccagatactgagggatggctgtcatgtcatgaggtgttcccacagtacccactgcgtggcatgcaactgacaacgttcttacttaatctggcacccagggccacccctactggagggatccttgcaccctgaggggaagggggaggctgtgtgggggccccacgcttacctttgaccccgatctggcaatcgtccccaggttggacaccagctcttcctgtgtcatcccgataccagtatcctgaggagagagacgcactaagtgccaagcccccagcacctggggagccgggtgagtgcaccagcagtcccagggactcaagtggtgtcaatgacattggccagacagggcccagccaggtagcaccagatgctcatcagaaaagactaattctaggggccgggagtgatggttcatgcctgtaatcccagcactatgggaggccaaggcaggcggatcacttgaggccaggagttcaagaccagcctggccaacatggtaaaaccccatctctactaaaaaagaaattagccaggcatgatggcgagcacctgtggttccagctactcggaggctgaggcaggaaaattgcttgagcccagtgaacccaggaggcagagactgcagtgaactgagattgcgccactgcactccagcctgggtgacagagtgagactccatctcaaaaaaaaaaaaagaaaaaacgaaaagactaattctagtcatagcagcttggcctcaccagagaaaacaggaagggacagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctggtggctctctcaatccagcagaatgatctgactgaggacaccaggaagcaggtgttgggaacgcagctctgcacgcggcacctactcccaccctaccaccatgggaacagcgggcacagacgcctctcctgcgggaaggcagagcccttgcgttggagcctctatctggcctatcctgttgcagctgctctgctctgagtgccagtgtcacccaaatccatatattaagacctaagtcccaaggggatggcactgggaggggggccttggggaggtgatcaagtcacgacggctccactctcatgaatgggagtagggcccttagaaaacaggcttgagggagcttgcctgccccttccaccttctgtatgaagatgcaagaggcactgcctgagtcaaagggccctcgccagatgcccaatctgctggccccttgctcttggacctcccagcctctagaactgtaagcaatagggttctgttgtttataaattgcccagtctaaggtattcggctatagcagcctgaatcacaatacagaccaacgcgctggtgaacacacaaggccttactgaccatgggctcctccttcctcaaagcccagtcagactcccatctgcagatcctcgctcaacatgcccataatgtagccacagccccagcttgctctgctatgatgtgcagaccaccttaaataaaagagctcactccaagcctccacatctatgaattgggacaaaggccctcagaaacagttttctgaacttccttctaggaagttcctttctaaagacttcctctccaggacagcctgcaggagccatgggagcccactagcaccaggcgccagtgctgtctccattggcaaagcaagggtggtcagtgccactcagcaaataatccacagcaagcagcaggccagggagactggccagctgtcagccttcccattgtaggcagcacaggcagaatgggtgccaaaaccacatcaccaccagttactgcagtgcacacatgtgtgcatgtttcacgggccccagcagccaacaagaaacatggcaccaagaggcttctgggcaattatttctgaggtgccggtttgaatagtccaaaatccagcctgattcatttattgtagatcatgtaataattatgaataaaaaactacttaaaattagtatctagttgatatcagtcattaaatataagtttcatttaagtgtttaatacatcagaaacttaaatagagtccttaagggaaaggttaatgttagaccaaggtaaaggaaaaaatgcaactaatagctcctattttcaatttatttttattttttcccaaactgatctgcactgcaatcccagtctaaatcctcacaggttttgtagaaaatgacaagccgattctaaaatgtatatggaaatacaaagaacttagaaaattttcaaaatattttgaagaacgaagttggagaatttaaaatacctaattttaagacttcctataaagctacaataattaagacagtgcgatgtgggcatttaaggatcgacacatggatgaaagaaccaaacagagcacaggaacagagatgcacagagagtgtattacttgatttttgacaaagattccaaggtaattcaatgggggatgataggtctattaacagatagtactgaaacaactgtacacccataaacaaaacataaacctcaagccctacctcacaccatacacaaaaattaacttgaaatggatcatagatctaaatataagagctaaagctataaaacctctagaagaaaacatagggctggacacaacagctcacatctgtaatcccagcactttggaaggtcaaggtgggaaaattgcttgagcccaggagtttgacaccagcctgggccacaaagcaagaccctgcctctacaaaaaaaaaaaaaaaaaaatttctcgctctgtcacgcaggctagagtgctggagtgcagtggtgtgatctccgctcactgcaccttccgcctcccgagttcaagcaattctcctgcctcagcctcccgagtagctgggactaccggcacacgctgccacacccagctaatttcttttgtattttcagcagagacagggtttcaccacgttgcccaggctggtcttgaactcctgagctcagacaatctgcccgccacggcctcccaaagtgctaggattacaggcgtgagccaccatgcctggcaaaaaaaataatttttttaaagttagccaggcatggtggcatgtgcctgtggccctagctacagggggctgatgtggtagatcacttgagcccaggaggtcaaggctgcagcgaaccctgatagcaccaatgcaccccaacctggagacggaagaagatcctgactctaaacaaacataaaaaccttccaggtcaggctgggtgcggtagctcatgcctataatcccagcactttgggaggccgaggcaggcagatcacacgaggccgggagtttaagatcagcctgaccgacatggagaaactctgtctctattaaaaatacaaaattagccaggcatggtggcacatacctgtaatcccagctactcgagagactgaaggcaagagaattgcttgaacccgggaggcggaggttgcagtgagctgaaatcacaccactgcactccagcgtgggcaacaagagcaaaaccccatttcaaaaaaaaaaatcttcccggtcatcaaaaacaaggaaagtctgagaaactgtcacagccaagaggagctaaggggccaggacaactaaatgtcatgtgggatgctgggagagaaaaaggacatgaggtaaaaactaaggaaacctgaatagacttgtgttaagaataatatatccataccggttgattaactgtaaccaatgtaatatactaacatttctttttttttttttttgagacgagtttcactcttgttgcccaagctagagtgcaatggcgcgatctcagctcaccacaacctccgcctcccgggttcaagcaattctcctgcctcagcctcctgagcagctgggattacaggtgcacaccaccacatctggctaatttttgtatttttattagagatggggtttcaccgtgctggccaggctggtcttgaactcctgacctcaggtgatccgcccaccttggcctctcaaagtgctgggattacaagcgtgagccactgcacccggccataaggtttcaatcataagggaagctgggtgttggagtagatggcaacgctgtactatctttaaaatttttctgaaaattgaaatctgttctaaaatatttactaaaaaaaaaaaaaaactatagatttttcagatgtagacagaaatcatctgttgccaggcgacccgcacaatgtgattttaaaaggaaatggtgagactaggcgcggtggctcccgcctgtaatcccagcactttgggaggccaaggcagtcagatcacttgaggtcaggagtttgagaccagcctgaccaacatggtgaaaccccatctctactaaaaatacaaaaattagccgggtgtggtggcatgtgcctgtaaacccagctacttggggggctgaggcaggagaatcacttaaatccggggggcagaggcctcactgcagtgaggtgagatcataccactgcactccagcctaggcaataaaatgagactctgtctcaaacaaaaataaaaaggaatttgtgagggtttacaacaggtatatacataaaatatttgacatcaaaagaaaaagatgattttgccaccggaatgatactgttgtaagattcttacaatgaagtgttaaatatcaattcaagctagacagtgataaattaaggctgcatattttattccctagaaaatcccctaaaaataacaaaaagcaatgtagctgagatatcagtagatgagatggaatggcataatacctctgagaccccacaagaaagcttccttttctaaaactttaggtaagaataatctatcaatattagttaattaattgtaataaatgggctgggtatggtggctcatgcctgtaatctaacacttgggaggccaaggcgggcagatcacttgagggcaggagttcaagcccagcctggccaacgtggtgaaaccccatctctactaaaaatacaaaaattagttgggcatcatggcacacatccgtaatcccagctactcaggaagctgaggcacgagagttgcttggacctgggaggcggaggctgcagtgagctgagatcacactactgcactccagcctgggcgacacagccacactctgtctccaaaaaaaaggaaaaaagatgaaacaaatggaccatgacgctcccatcggctattgagaatagaaaaactgggtcccaaaggatataatggagctctaaattacctgctcaaattttctgtaaatctagaactgttctttaagaaaaaagaagacaaaagacaaaaccaaaaatcattattgtaacataaatggtcttagtaccaggaagtactggcacatgaggactggcccctctgctaaagaccaagaatcatgtccccatgaccccttgccccagcacatccattttcaatcatctgcaaggaacctctgtgctgaaaacaggaggaaagcacagggcgctgcagccctgcccacagggcccattccacagccaggccagctcagcaaaggcagggagagaagaaacccactccccacccaatccttatgaccaagggctatgacaaacagctggcacgtaccacggggctcagtctggattctctaaacccaagagggagtgcgtaaagctgacacctcacaaaagcccctcctttaattaaaacagccatcccttcacaagtccattcattcacgcgtgcctgcattcatttatgtggcatgaccttcagagcaagccagcaccctaaaagggaatactcagatcccaccgaggccagtctgtccacctctccacagagacagacacccccgcaatgacgccgtgaccctgggatgacaggtcctgaggcagctgtctttggatgcaatgtctctcagggcccctacctgatcctctttggcctaacttttcagccttaaaatttccacaaggctacagcagcagccacagcactgcttcgtcggcattttgaggggaaaacgcagttaaaaatatgaaaagagtacattaaaaataagatatgtttagatatgttaatacctgcatataccaaaaccctgtgtggccatatgctaagatgttaccagtagttattgctggatgatggggtgatttcaaattttcttcttttctgcttacctgcttttccaaaattttctataatgaatgagtgctactgtaacactaaattatagccagagttatcctggtggtacggacggccagtacgtccctgggacccgagacatcactagaaggcggatcctgtccttgctgcatggccgggcctgccacacgcctggacactgagggaggtacctggatggtgatggtgcctttctcggcattggtctgcaagtgaatctccatttctggcagtgcttggccgtcagacaccagtttgtgacgcagtttttccaaggcatcgctggcattggagatcagctcccgtataaacacctacaggaatagaaatgggaggcacagacaatgaaggacactcatcctgcaggatctatctggtcagctgcacttccaataactgttaaaaggtagaggagaatagtcaattctcaaagcataaagagtttctgctttagtcaaaggcagttcctctgggccggtcacaaagtgactgaaggtgctgactttcctttcaggatttctttgagagtctcactctgtcactcaggctggaggctgcaatcacggcttattgcagctttaacctcctggacccaagcaatcctcccacctcagcctcctaagtagctgggcccacaggcatgcaccacacccagctaattgttttaaaatttttatagacacagggtctcgctatgttgcccaggctggtcttgatctcccaggctcaagtgatcgttgtgcctccgcctcccaaagtgttgggattacagacgtgagccacggtgcctggcccttttcaggatttttaatcaagcctgaagttacgtgtccatctgttaattataactttaagaagagccctctggctggggttgggggctcatgcttgtaatccaggcactttgggaggctgaagcaggtggatcacttgaggtcaggagctcaagaccagcatggccaacatggcaaaacccagtctctactaaaaatattaaaattagctgggcgtgatggaacacacctgtaatcccagctactcaggaggctgaggcaggagaatcgcttcaacccacaaggcggaggttgcagtgagccgagatggcaccactgcactccagccccgacagagagagactctgtctcaaaaaaacaaacaaaagaggcctgcgaggaacaatttctttcccaactcctgcacagggatgacggcatatcactcaaacatccatttctccttgatatggtttggctgtgtccccacgaaaatctcaccttgaattgtactcccataattcccacgtgttgtgggaaggacctggtgggagataagtgaatcatgggggccgtttccccagtactgttctcgtggtagtgagtaagtctcatgagatctgacagttttttggggtttctgcttttgtgtcttgctcattctctctttgcctgctgtcatccatgtaagacgggacttgttcctccttgccttccaccatgactgtgagacttccccagccacatggaggtgtaagtccaattaaagctccttctttggtaaattgcccagtctcaggtatgtctttatcagcaacgtgaaaatggactaatacactcctactccacaaaaacaggttccctagcttcatctcatctagtggggaccaccaaacaccaggtctaccacacccggagaaaaacaggcctcagggcccagctgtccctcaggagctgaaaagcacactgacctcaaacagaccttccatttaaaatcagtgagagaggccgggtgtggtggctcacacctgtgatctcagcactttgggaggctgaaacaggcagatcacctcagcccaggagttcaagaccagcctgggcaacacggcaaaactccgtctctacaaaaaaatacaaatatcagccagaggctgaggaggaaggatggcttgagctcaggaggcggaggttgcagcgagccgagatcataccactgcactccagcctgggcgtcagacccagaccctgttccaaaaaattaaaaaaccaaaaaaaaaaaaaacaaaaacccacacaattaaaaatagaaaaattaagtccgcaagagcacataggtgaagaggaagcggtggctgatctgggcggaagctggaggtcactgggagtcaggaatgcagcactcatcagtacgaaacccggaaacagctcctagaaggccctctgagctttgaaatctgctgctttacaaactttcttcaggactctcctttgccttccagcaataatcagcatgtcaacgatggtggccttcatctttctttttccttgtcctgtcaccccaaatgagttttgcggggttttttttaatagagatggggtctcttcacgttgcctaggctggtctcagactcctggactcacacaatcctcctaccttggcctcctaaagtgccgggattacaggtgtgggtcaccgcacctggccccaaatgcgttttaatttcctcagtaactcctccctgctccatacacacaggactggggaaccttcttcctccggcagccaaagccgccaagacctgcaggtagtcccaccaggcaaaggggcctcagagcgtatccaaagctccacagagacggaattcagcagagctgcacgctaggatttgggggactttttttttggagagagggtcttactctgttgtgcaggtcagtgtagtaacacaatcatggctcactgcagccccaaagtctgccaggctcaagtcatcctcccaccccagcctcctgagtagctgggaccacaggtcagtgcccccatagctggctaattttttaaattttttgtagagacggagtcttgctgtgttgaccaggctggtctcaaactcctgggctcaagtgatcctcctgcctcgacctcccaaagcactgagttcccaggcatgagccaccacaccaggcctgtatttcgggaacttttaaaattattggcaaaattcaattaattcccagagttgatccagcccaaagaaccatctggatacacttatccaggaaaccaaaacagattctggtaaaactcctctcactggtagcttaagatgaggacctgtccaaagtttaatgctttctcacagctaatatattatctggcaattctccagaatggcataaaaaccagctttgtgaaaagaaactttgctagcatcgggcatggttagcagggaacgcacctctttttctgagtacagggaccgggcaacaatgtccaaaagcttctttgtctcggcctggaactcatgtttggaagtggaacctagtaatgaaacacagacacaaccaacaaagtttaacttctatttttgtgcaagaatacgctacgtcacattccaaagaaagcttaagtttatgagttttaaacttttttttttttttttttttgagacggagtctcgctctgtcacccaggctggagtacagtggcacgatctcggctcactgcaagctctgcctcccgggttcacgccattctcttgcctcagcctcccgagtagctgggactacaggtgcctgccaccacgcccggctaattttttgtagttttagtagagacggggttttaccatgttagccaggatagcctcgatctcctgacctcatgattggcccgcctcggcctcccacacatttaagatcatgaacaaaaagaaagaagcagacagaaacaaagtctggctgggcaccatggctcatgcctgtaatcccagcactttgggaggccaaggcaggagaatcacttaagcccaggagctcaagaccagcctgggcaacacagagggatcccgccatctctacaaaaaatacacaaagtagctgacggtggtggcacacacttgtggtcccagtgactcagggggctgaggtgggaggatcacttgagccagggaggtcgaggcttcagtgagccatgattgcactacagcactcggcctgggtgacagagaaagaccctgtctcaaaacaaaacaaaacaaaaagtctctcagaaaggaggtctcagggcaggacaaatcctcccactgctgaggccagacatgcctcgggctatgtcgagggaatgctgagcctggtttcccaatgtgcatggttacgagaactggactgcctctaagaaccagattatatgttctttcttttttttttagaggcaggatctggctctgttgcccaggctgctatgcagtggcaggatcgtgctcactgcagcctcaacttcctgggctcaaccgattctcctgcctcagcctctcaagtacctggaaccactggtgtgtgctaccatgcctggctaactttttaatttttttctgtagagaaagggtctatcttgcccaggttggtctcgaccacttggcctcaagcaatcctcctgcctcggcctcccaaagtgctgggattacaagtgtgagccactgtgcctggactatattcttcaaaaaagcggtttccaaattaattagttagaaatcaaaataacaagaaaacctcacttctctttttaacttcaaagattctactcttgtcgacccacttaaaagccagaaatggagccacttcaggactggctccaaagactgcttttttatacttcagagggaatgaaaagacagctccagaattcggtcctgcgcagactgggccaatgctgagtttcccctcccgcttccatgattattagcagatgtgccatgaatcaccactcaggggaggtgccggacggcaaactcacgggtggccaccagagggggcaagacacacccgacactggcagaagtccctcgctgggacagaaatggagggcgcagcactccctacagccaagaccttctgatttcacacctaaggcggtggctctaccaatcactgcctccaccctgaaaatgcccctttacgcacagcagtgaaccaaaaagccctcccagaccaaagcacgagccaaggctaccctgcacgctctctgtgctgctgataatcgagtgcaggggttcctccttgtcctcggcggtctgcgtgctgaacagtcgtcctgcctgcaagctccaggctgggtttcgcctggggcccaactgggctgtggtcctccgaggacacagaattggttttcctgaaaagacaaatatgcagaaagaatgagaattaggaagacacgagaaacaatatggtaattcgtcccatcaagggtgtctagcagaagctagcgtggacatctctaagtcgggctgttgctgaaagagaaatccacaggaccaaatgccacagtgtcagggtgtggttttggcaaggagccctcacagatgtcatcagtgtaagatactgtgtcttctcagaaccgcagaagcgaaactggagggggtgggctgctgccttcttttcagagggggtctcgctctgtcactgcgatcacagctcactgcagccccaacctcctggactcaggcaatgctcctgcctccgcctcacgagtagctgggaccacaggcacagaccaccatgcccccataattttttaaaaaattttttgtagaaatggggttttgctatgttgccaagactggtctcgaactcctgggctgaaaccatcttcccgccttggccttacaaagagctgggatgacaggcgtgagccaccatgcccagctggcagatgcctgctgacagcacttcccacattcgcctcacgggtgacacctcgcatcaacctaccaaactgaaacctgtctcgaccctcgcagcccctgcagaagcccccgatgggccacacttctttgctcttgacagtcaagcaaaaaaaaaatcctcccaaaagggatccaaatatttaaatgttaatattctgaaactgtctcatcttctaaaagttgattctttcccattgctttttcatccaaaacagattttttaaaaaaaatttgtgtactttaaaaactgaaaaacagctgacgatgggttctaccttctaactaagaaggagacttgtcttctgtaacttcctgctcagtccagtgggctgagaaagttgccggcagagcccagcgagggaggaaagcagccaatgtgtccccagccgcacgcagttcaccgacgcaggcccagaaaccagacactttcactccaacacaggactggaccgacccaacaccaacacccactgaccccagggaccacataccaggaccctgccttggtcagtagatttgcaatacgtgatggtgtcaaggatatgtggccagccagccacgccgtgtcaaagtctaagcctaaatgaaccgcatctaactgggagcctctcctgttcttcacaaatttgtaacaagtagaaaggaaagacaacagaatatccaggaatcaaggttttaaaaatcagcatatcagccaggggtgcggtggctcacgcccgtaaacccagcactttgggaggctgaggtaggcggatcacatgaggtcaggagttcgagaccagcctggccaacatggagaaaccccatctgtactaaaaatacaaaagttagccgggcatggtggcaggcacctgtaatcccagctactcgggagactgaggcaggggaatggcttgaacttgggaagtggaggttgcagtgagccgagatcgtgccgctgcactacaggctgggtgacagagcaacattctgtctcaaaaaaaaaaaaaaattaacatatcaactttcatactcctaaaaggtacaaaaacttgccttttttttttttttttttttgagatgaagtctcactcttgttgcccaggctgcagtgcaatggtgcaatctcggctcattgcaacctccacctcccgggttcaagcgattctcctgcctcagcctcccgagtagctgggtttacaggcgcctgccaccacacccagctaatttttgtagttttagtagagacagggtttcaccatgttggccaggctggtctcgaactcttgacctcaggcgatctgcccacctcagcctcccaaagtgctaggattacaggcatgagccaccgtgcccagccaaaacttgcctattctttaggcttattcctggacttacaaacagcacaaacctggccttttgtttttgtttttttttgagatggagtctcgctctgtcgcccaggctggagtgcagtgatctcggctcactgcaacctccatcttctgggttcaagcgattctcctgtctcagcctccaaagtagctgggactacaggcaccagccaccatgcctaatttttgtatttttagtagagacgaggtttcaccttattggtcaggctgctctcgaactattgacctcaggtgatccacccacctaggcctcccaaagtgctgggattacaggcgtgagccaccatgcccggccaaccctagcctgtctttatctctatgcagataccttaaaaacatctaccacaattcagaaagtattcaaattccaaaccatgtaaacatccagttatttgggcccatgtaattgcattgttcactttattcgtacagttaaaaaaaaaaaaaaaatcccgggacatttcttctggaattaaatggtatttggcattagaggagttcgcgaacagtctacatcaaaccagggtgctgaagtctctgtgcctccttccaaagcacagccagccctgggggcacaggagggaagtgtccaagtgccaacacctgcccacagagcatatcagtgtttctcaccatttgtgtaaaagaaacacaaaaaggataaaccagaaactgatgtgactgtgtattttgtttcctaggactactgaaacacagcaccacaaactaggcagtttcaaaaaggtccacagttctgagccaggcacacaacctcacacctgtaatcccagcactttgggaggccaaggcaggagaatcgcttgagcccaggggtttaagaccagcctgggcaagaaagtgagactccatctctgcaaaaaacacaaaaactagccaggtgtagtggtgtgcacctgtagtcccagctacttgtgaggctgaggtgggaagatcacttgagcccaggatgttgaggctgtagtgagccaagatcacactaccgcacttctgcacttcaggctgggtgagacagcgagactctgtctcaaaaaaaaaaaaaaaaaggtcccaggttctgggcagcggtgcttcccactggaggtgccgagggagagtccatcccgcacctctccccagcttctggcagtagccggcatccttggtgtttcatgctttgcagaccctccaggctctgtctcttgtcacatggcaagctcttctctatgtgagtcctggctgtgtccagatttccctcttcttatacggataccaggaatactggagttaggccccacccccatgcagtgtgacctcatcacaacctgatacatctgaaatgacccaaataagctcacactcacaagtaccagggatgaggacgcgaacgtatctttctctttttttttttgagacagagtctcgctctgtcatccaggctggagtgcaggggcatgatctcagctcactgcaacctctgcctcctgggttcaggcgattctcctgcctcagcctccctagtagctgggattacaggcacgcaccaccatgcctggcttttatttttaaaagagacatggtttcaccatgttggccaggctggtctccaactcctgacctcaagtgatctgcccaccttggcctcccaaagtgctgggattacagacgtgagccaccatacctggcctctttttaaaaaagaataaaaatagagacaaggtttctctttgttgcccagcctggtcttgaactcctggactcaagtaatcctcccactttggcctcttaaagcactaggatgacaggtatgagccactgtacccggccttcaaaccccacagcttggttacctacaggaggtgtgtattaaactccccgtggcacaaacccggtagcttacagtaacagacacttattctctcacagtcctggaagcaagaagtccaagatcaaggtgccactagggctggttcctcctgaggctgggagggagggtctgtttgcgcctcttccagcctctgcagcctctggcgttgcttggcttgtgggtggtcatcttctccctgtgtcttcccttcaggacgtctgcccttctccctctacacatgtctgtctgttcaaatgtccccattttataaggacacagtcatactggattagggcccacccaagtgaactcatcttaacttgatcacctgcaaagaccctatttccaaatatggtcacattcacaggtactgagagctgggacttcaacatctttcgtggggagacacaattcaacccccaaccagcatatgtacagagaatgcaaagaaagcgggaaggggagagggctggcagagctgagggaacatgacacttccacatacatcttttcgtatgtctctcttagaaccatggtcaggtttctcatactcaaaaaacaaaccattacttagccagacgtggtggcgcacttctagttatcagctactcgggaggccgaggtggaaggactgctcgaacacaggaggtggaggttgcagtgagccgaggtcgcaccactgtactccagacttggcgacagagtgagactctgtctcgaaaaaaaaaaaaaaagaaaagaaaaagaaaaagaaaaagaaaccgtgaaaacaaaacagggcgcacatgaacacaaaatgaaatacaaacagcaaatatgcagagctgtgacgatgacatcaccactctgaaagaagaactaacctaagagacttcagaaaatagcactttgactgttactgtaaaactaacctcagaggacagcacaccatcaccaggctcgggcaggagatgtgtcccctgcggagtcagcaggtctgagcccgatttacgcatgtgccaagatcaagcggaaaagctgattgtggctactgagttggggtcctcacagttgaagaaaagtcactgataaggaaggggcaggaataaaccctgcggggcggcactggaggtacaggcatcagtacaggctcacaacctttgccatgtgtacagactggatgcagaaatcaataccggaacatttacacacacacatttcccagctctgtccactgacgcgtgacagggcccaggcgcgatgaccccccacttaggctacagagagcaaagtccaaaagctgttccagtttcagcactctaaagtcccacgtcccagggaaagcctttgtcctggcaaactaggacggctggtcaccctacctggcagccagatcttggtttgtgaatacctctctccaaaaacaggaaccagagatccctgcggagcacacagaggagcctaggacacccagtggtgtgcagaaggacgagaaaggacggggtgtgtcaggagaacacacagcccagccagaagggctcccagtggcagaatctaggacaatctgtgcggcaaaataacgaacgacaataatggattgtaagctgtgacccggcaaatcaagcaaacatcggtgcacacttaaacagaggaggagcagcagctcttcatcacagcagaattccaatgaataaacacaaggaatggcagaaaacagaaagcacaccatcaggaaacaccacagcaataactggctggtgtaagttactactattttgagacagggtctcactctgttgcccaggctggatcacaatggcacaatcacagctcactgcagcctcgaccttcccgggctcaggtgatcctcccacctcagcctcctgagtagctgggactataggccgtgtattaccactcctagctaattttttttttctttttttttttgactgggtctcactctgtcgcccaggctgaagtgcagtagagtgatcttggctcacagcagcctcaaccctccggattcaagtgatcctcccacctcaaccttccgagtagctgagactacaggctcatgccaccatacccggctaatttttgtgttttctgtagagacagggattcaccatgttgcccaggctggtctcaaactcctgagctcaagtgatcccccggcctctgcctcccaagcgctgggattagagccgtaagacaccacgcccagcctaaggttatgtatttgaagcagtggtagatactgccaagtcacactccacagagatcctatcagtttacgttcccacagcaatgtactaaagtgcatatcatcctacattcctgccaagtcagtgttgagatgaaactcttggatctttgcctattggtcagataaaattttcactgcagttttcacttacatttctcttattataagcaaaactgagcactgtcccgtatttttaaatatttcctatttccttttttgttaagggactgttggtatcctctgataatttttctactacattttaaatcttcttcttattgatttgtaagagctttttatatattaaggaaattagtcgccaggagcggtggctcacacctgtaatcccagcactttgggaggccgaggcgggaggatcacgaggtcaggagattgagaccatcctggctaacacggtgaaaccccgtctctactaaaaatacaaaaaattagccaggcgtagtggtgggcgcctgtagtcccagctacttgggaggctgaggcaggagaatggcatgaacccgggagacggagtttgcagcgagctgagatggcgccactgcactccaccctgggcaacagagcaagactctgtctcaaaaaaaaaaaaaaaaggaaattagtcttttggttgtaaaagccttcctcactctaagattaaacatgatttccccatgtttcatttttctagtctttttggtttttccccaattaatatgcagaattttttttttttttcctcgagaaggtcttgctctgttgcccagagctggagtgaaatggcgtgatctcggctcactgcaacctctgcctcccaggttcaagcaattctcctgcctcagcctcccaagtagctgggattgcaggtgtgcaccaccatgcccggctaacttttgtgtttttttgtttttttgtttttcttttttaagtagagacagggtttcaccatgttggccaggatggtctcgaactcctgacctcgtgatccgtctgcctcagtctcccaaagtgctgggattacaggcacaaaccactacacccagcctatatttttgaaaggatttaatataatattcattatgggaggagtatatagaagtcctcacaattgggaaaaagaaaaaaataagaaatctatatttccagccagaattgcaagacttagtatcataacgccaagattacattaattgaattgacagcattcttaaaagcagatttgatttcaggttatgtaaactttccacaacaacttttttttttttttttagagtctcactctgttgcccaggctgcagtgcagggcgccatctcggctcactgcaagctccgcctcccggattcatgccattctcctgcctcagcctcccaagactacaggcgcccgccaccatgcccggctaattttttgtatttttagtagagatggggtttcaccgtgttagccaggatggtcttgatctcctgacctcgtgatctgcccgcctcagcctcccaaagtgctgggattacaggcgtgagccaccgcgcccggcttctacaacaacttttaatcactaactcaggtgcagtggctcatgcctgtaatcccagcactttgggaggccaaggccggggggtcgcttcagctcaggagtttgaaattagcctgggtaacatggcaaaaccccatctctacaaaaaaacagccaggtgtggtggtgcatgcctgtagtctcagctacttgggaggatcacttgagcctgcaaggcagaggttgcagtgagccaagatcacgccactgcatttcagggtgggagatgcagccaggccctgtctcaaaaaaaaaattaaaaattaaaaaaaaaataaaccattagaggaataaatctgcctgaaccagataccaaacacgctagctgtacaatttccgtctttgtgtttctcctacaccctaaaggaaaaaccacaaacctcaatgtcaggctacaagatcttactgttaaactatctggtggtttggggtcgcacaaaatgggaagcactgatagtttgaatgtgacaccacacacccctccccttccaccccccacatccctacccactactgccagtgcccatgcagctcctccactctgcagctgcagtctcagtagctgggactccttcccatccgagttgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatcccagcactttgggaggccgaggcgggtggatcacctgaggtcaggagttcaagaccagcgtgaccaacagggtgaaaccccatctctactaaaaatacaaaattagcactgggtgcctgtaatccccgctactcgggaggctgaggcaggagaatcacttgaacccacgaggcagaggttgcggtgagccgagattgtgccattgcactccagcagcctgggtgacaagagtgaaactccgtctcaaaaaaaaaaaaaaaaaaaaaagatttattcatgtatttactatttctttctttcttagaaaagagattgctctgtcacccaggctggagtgcagtggtacagtcatggctcactgcagtcttgaactcctgggctcaagggaccttcctgctttactctcctgaacagctgggactgcaggtaagcaccatcacacaggactaaattcttttttttttttttttcctagagatagggtgtttccatgttgaccaggctggtcttaagctcctggtctcaagcaatcttcctaccttagcctcccaaagctgctgggattacaggtctgagccaccacgcccagcctgtgctgctcatttgaaactgctgctatatgccagcatatgacatttcccactgttaattttttggttaatgtataatttatctcaccaaattagggcaggaaaaagcttgtatttctcagtaacactctttgaagacaggaacatccatatttcttggtatgccaaagtatctatcacaaaagctactctttacaaacttttttttttgagatggagtttccctcttgttgcccaggctggagtgcaatggcgcgatctcagctcaccccatcctcctcctcccgggttcaagcgattctcctgcctcagcctcccgagtagctgagattacaggcatgtgccaccacgcctggctaattttgcattttttgtagagacggggtttctccatgttggtcaggctgctctctaactcctgacctcaggtgatccgcccacatcggcctcccaaagtgctaggattacaggtgtgagccaccacgcccagacttttttgtttgtttgtttgagatgcagtctcactctgttgcccaggctggagtgcactggcacaatctcggctcactgcaaactccgcctcccagttcaagccattctcgggcctcagccgcccgagtagctgggactacagatgcacatcaccacgccaggctaatttttatatttttagtagagatggggtttctccatgttgcccaggctggtctcaaactctggggctcaagggatcctcctgcctcagcctcccaaagtggtgggattacagaagtgagccaccgcacctggccaagggtgcatatttcaaacaccagagtaaccactaaaataataattcaaagaagaatagctttaaaaagcattagataaaccacaatggaaatctcaaatacatttcattgataaggaaaggaaaaacagggaaaaaatccaaaaggacaaataaaaggcaaataataaaatggtagcaataaatccagccacatcgatatttactcttacattaacagactgaactctaattataaggcaaggattgtcagaattggtaaaggaagacctaattacatgctatctacaagacactttaaacataaagaaaaagatacacttaagacaaatgaatggaaaaatacataccatccaaaaagtgtgtttaagaaagctggagtggctctattaatatcaagtaaaatacatttcaaaataaaaaatattattaggaaaaaagaaggatatttcagaatactacaacaaacaattcatcaggaaaatgtaatcacaagtgtgtatttgcctaataacagagcttcaacatatatgaagttaaaacggaaagaattaaagacaaaacaattccacaatcacagctggagatcttaacactcctctctcaataactgacagaatcaaaccaaaaaataaaacagaagccgggcacagtagctcacgcctgtaatcccagcactttgggaggctgaaacaggagaatcgcttgaacccgaggcagaggttgcagtgagctgagatcgcgcccctgcactccagtctgggtgacagagtaagaccctgtcccaaaaaaaaaaaaaaaaaatagccagacagtccagaagaaaaacctggggcaaaagatatgaacggcatttcacagtggctacagaaagcgaaggagcaccaaactatatatgaacacagcaagctctccacgagctatgtagtgagtaacagaacacagagaagggtgcgtccctgagggaatatgtacatctgcacttactacagtcatacaagtaagtagtggcaggacccacaggcaactaatagtggttatgaagacagcaggtgctctgaacagcagcaagacttctcaagctttacctgttcacatggttttggttaatcaaaccatatttatttattcaaaacagatattaaattattaaaaatatgaggctgcccggcacggtggctcacacctgttatcccagcactttgggaggccaaggcaggtggatcacaaagtcaggagttcgagaccagcgtggccaacatggtgaaccctgtctctactaaaaatacaaaaattagctgggtgtggtggcgtgcacctgtaatcccagcctgggcgacacagtgagactccatctcgggcgggggaaaatatgaggctgtcacaaaagtgctaatgttttccctgctgtcgatgttgaggtcacttgaaagctggtatggacacatcggatgaggaattcagtctaggggcctcttaggagccaaggcccaatgactagactaagtggacccagcaaacacagagggagggggcctgaggcacaaacacagacaaggtcctatgctcgaggcaaacaaggacgaggtacaaggtgagagccagaaggggccactgtgctgcttcacagacctgggaagaagttttttgagaaaagactttcatttttcaagaggcagatcattttaaagaataaggcctagggcagtggctcacacctgtaatcccagcactctaggaggctgaggcaggcagatcgcttgagcccaggagtttgagaccagcatgggcaaactggtgaaaccccgtccctaccaaaaatacaaaaacttaggtggacatggtgacacgcacctgtagttccagctacttggggtacttgaggcggaaggatcacttgagaccagagggtaaaggctgcagtgagccgagatcacaccactgcactctagcctgggtgacaaagtgagaccctgtctttaagagaaatttaaaaagctgggtgcggtggctcacacctgtaatcctggcactttgggaggctgtggtaggcggatcacctgaggttgggagtttgagaccagcctgaccaacatggagaaactccatctctactaaaaatacaaaattagccaggtgttgtcgtggatgcctgtaatcccagctacttgggaggccgaggtaggagaatcgcttgaacccaggaggtggaggttgtggtaagccaagatgctgccattgcactccagcctggagaacaagagtgaaactccgtcttgaaaaaaaaaaaaaaaaaaaaaaagcattcagtaagatggtagaatacaaaaatcaacacccggacgtcctatatacagaaaactagttagaaaatatgacataagagaccccaggaacaaaaactaaacaattaagaatgcatttaccaagaaagcaaaatctttccttttttttcttttttggcaagatcttttaagaaaactctgaaacactactagggccaaagactgtcattaaataacccacttaagactgttacatatgctacatactcacaagcggaggactaacaagtaaactacagacgtaaggtaacacttggaaagcatgggattatagagaaatgggacaatgctgtgtaatgtgtgctgatgctgaattacctctaacacaaagaaaaaacactagaggtagaacagcggtttgcacacactaccatggtgttcaaatgcatatacatgttatgtgatacatgcatgcatagctattctcatatgccacgcagatctctgcaaggacacccaaaaactggctaatggacttgccaccaggaggggtgttgtctgaggcatgtcagtgggagacgagtttttcatcagatatacctctgtatcgtttgcatattggactacatatatcaataatctacaaaataaataccctacttataaaactatttacaaaagttaggctgggcgcggtggcttacgcctgtaatcccagcactttgggaggccgaggcgggcagatcacgaggtcaggagatcaagatcatcctggctaacacggtgaaagccagtctctattgaaaatacaaaaaattagccgggcgtggtggcgggtgcctgtggtcccagctactcgggaggctgaggcaggagaatggagtgaacgcgggaggcggagcgtgcagtgagccgagatcgcgccactgcactccagcctgggcgacagagcgagaccccgtctcaaaaaaaaaaaatcaaaaaacaaaactatttacaaaagttacattacaggccaggtgaggtgcctcacgcctgtaatcccagcactttgagaagccaaggtaggcagatcagctgaggtcaggggtttgagaacagcctggccaaaatggtgaaaacccgtctctactaaaaatacaaaaattagctgggcatggggatgcacacctgtaatcttagctactcgcgagaccaacgcactagaatcgcttgaacctgggaggcagaggttcagtgagctgaaattgcatctctgcactcgagcctaggcgacagcacgactctgtctcaaaacaaacaaaacgttgcattataaaaaacacttaaaaacttacgagaaacataaacacatttacaaaatttcaaacacatttttaaactattctcattctaaaattcatgtggaaaagttagtgtacataaatagccaaagaaattttgaaaaaactgaggaaattcatcaaatattaaagaacattaatataaagctacaatattaaaataaatttccagaccaggcatggctgctcacacctgtaatcccagcactttgggagggagatccaggcaggaggaggctccctcgagctcaggagctcgaggccagcctaggtaacatagggagacccccccaactctcaaaaagtaaacacacacaaaaaaaggttaaattaatttccagcagggcacaggggctcatgtttgtaaccccagtgctttggaaggccaagttgggaggaacacttgaggccaggagttctagaccagcctgggcaacatagcaagaccaacctcttatttttttttttttaatttccgctgtcacttattaagtcaaaatgaattccagatggaccatagaagtaaaaataaaagctaaaagtactgaaagaaaacatgaaagatttagtaactttattgagatgtaacacatctgccatataattcacccaagtgcacaattcagtggttttagtatattcacaaagttgtacagccacgaccactaaccacagaacatttttttttttgagacggagtctcgctctgtcgcccaggctggagtgcagtggagccatctgggctcactgtaagctctgcgtcctgggttcatgccattctcctgcctcagcgtcccgagtagctgggactacaggcgcccgccaccacacccggctaattttttgtattttttttttagtagacacagggtttcaccatgttagccaggatggtctcgatctcctgacctcgtgatccgcccgcatcggcctcccaaagtgctgggattacaggcatgagccaccatgcccggacaactacagaacatttttatcaccccaaaagaagccctacagccactcatgttcactctcttttccctctcccaccagctcttggcaactactcatctatgtctgtctctatggatttgccttttctgggcacttcacagaaatgaaatcatacaatatatggttttttgtctggcttctttgacttagcataaagtctttggggttcatccacatatagcatgtatcagcacctcattcctttttataactgaagagcactccgctgtatagattatttttttccattcatcaaatgatgggcaactgggttgcttccaaattttttgtgagacagagtttcactctcgttgccaggctggagtgcaatgacatgatcttggctcactgcaacctctgcctcccgggttcaagtgattctcctgcctcagcctcccgagtagctgagattacaggcatgtgccaccacacccggctaattttatatatatatatatttttttttagtagagacggggtttctccatgttggtcaggctggtctcaaactcctgacctcaggtgatcggcccacctcggcctcccaaagtgctgggattacaggcgtgagccaccagtcccggccctttttttctttttttttttttgagacggagtctcactctgcagtggtgtaatctccgctcactgcaacctccaattcccagggtcaagtgattctcctgctgaggcacccgccaccacgcccagttaatttttgtatttttagtagagacgggttttgccatgttggccaggctagtctcaaactcctgacctcaagtaatccacccacgttagcctcccgaagtgctgagattgtagacatgagccactgcaccaggcccagcttccaactttttactgtaacttttgttttggggtggggtgggggtctcactatgttgcctggagtgcagtggctgtttacaggcactgtcatggtgcatggtagcctccaactggcaggcttaagcgatcctcccacctcagcctcccaagcaggtgggattagaagggcgcaccaccactcctggcctatttgcactcttttttttttttttttttttttgagataggttcttgctctttgaccaggctgaagtgcagtggcacaatcacagctcaatgtagcctcaaactcctgggctcgagcaattctcccacctcagcctcccaaatggctgggaccacaggcatgtgccaccacacccagcaatttttaaaaattttttttcgagatggagtctcactatgttgtccaggctggcattcaactcttggcctcaagcaatcctcctgccttggcctcctgaagtgctgcaattacaggcatgaccaaccgcacccagcctcgtttccaccttctgatggaccttcagattgttttcattttcgggttattatgaataatgctgctatgaacattcatgtgtaggctgttctgtggacatgttttcatgtctacaaggtatgtgcctcagggtagaactgtggggtcatatggtaattcggtttgactgtgtgaggagctgcaagaatgttttcctgcagaggtcgcaccgttttacattctcaccagcagtgtgggagggttctgatttttccacatcctagttatccattttgtatcacctgtttttttgttgttgtttctttaatttttaattatagccaccctagtgagtaggaagtgctaactcactgtagttttgctttgcagttcctaaactgccaggcatcttgagtttttaaaaaaaatgatttaagaggaaatctttttttttttttttttttgaggcggagtctcgctctgtcgcccaggctggagtgcagtggcgggatctcggctcactgcaagctccgcctcccgggttcacaccattctcctgcctcagcctcccaagtagctgggactacaggcgcccaccaccacacccggctaatgttttgtatttttagtagagacggggtttcaccatgttggccaggatggtctcaaactcctgaactcgtgatccacctgcctcagcctcccaaagtgctaggattacaagcgtgagccaccgcgcccggccttaagaggaaatgtttctaaacaaaatatataacccaaaaggccataaatataaggaccacataaaaatttaagtcaaaagacaaacacccgggtgaggtggctcatgcctgtaatcccagcactttgggaggctgaggtgggtggatcgcctgaggtcaggagttcgagaccagcctggccaacatggtgaaaccccgtctctaccaaaaatacaaaaattagctgggagtcgcagcgggcatctgtaatcccagctactccagaggctgaggcaggagacttgcttgcactcgggaagcgaaggctgcagtgagccaagatcgtgccactgcactccagcctgggcaacagacagagcgagactctaactcaaaaaaaaaaaaaaaaaagacaaacacattaagaaaaaaactgggggccaggcacgacggctcctgcgtgtaatcccagtactttggcaggcagaagtaggaggatcacttgagaccaggagttcaagacaagccggggcaatatagtgggaccccatctctaaaaaaaatgttttttaattagccaggcatggtggcacatgctccttgggaggaagaggtcacagccacttgggaggatgaggcaggagtatcacttgagtccaggaggtcaggcctgcagcgagccaggatcgcacaactgcactccagcccggatgacaaagcaagaccctgcctctaaaataaaatttagtgccgtggctcacgcctgtaatcacagcactttgggaggtgggggcgggcagatcccgaggtcaagagtttgagactagcctggccaacatggcaaaaccctgtctctactaaaaatacaaaaaaaaacaaaaattagccagaaagccaggagcagtggctcacacctgtaatgccaacactttgggaggctgaggcggatggatcatgaggtcaggagttcaagaccagcctgatcaacatggtgaaattccatctctactaaaaatacaaaaattagccgggcgtggtgacgggtgcctgtagtcccagctactagggaggctgaggcaggagaaatgcttcaacctgggagacggaggttgcagtgagccaagattgtaccactgcactccagcctgggcgacggagcgagactccatctcaaaataaataaataaataaataaaaataaatgagccgggcatggtggcgcgtgcctgtaatcccggctacttgtgaggctgaggcgagaggactgcttaacctcgggaggcggaggttacagtaaggtgagatggcgccactgcactccagcctgggcaacagagtcagactctgtctcaattttttttttttttttgagatggagttttgctctgttgccgaggctggagtgcagtggtgcgatcgcggctcactgcaagctccgcttcctgggttcacggcattctcctgcctcagcttcccaagtagctgggactacaggcgcccgccaccatgcccagataattttttgtatttttagtagagatggggtttcaccgtgttagccaggatggtctcgatctcctgacctcatgatccgcccgcctcggcctcccacagtgctgggattacaggcgtgagccaccgtgcctggcccgacactgtctcaatttttaaaagttatttaaaagggctagcgcagaggttacggtgagccaagatcacgccactgcactccagcctgggcaccaagtgcaaaactccatctcaaaaaaaaaaaaaaaaaaaagaaaaaggccattggttcaagagaaaaatggccattcacaaaaacaagaaacatcaatggctttacgtcctagtaaaagatgttttaccacactcataactaaggaaatgcactttaaaacgagatagcattttcactaccagattgacagatgttttaaatactgtcattctagcactggtgaaggtgtgagaaactgttggcaatgccgtctgttatcttggggaaactcagcaacaacctaaatgtccgccatgagagggttacataaattacaaaacatcctcgctatggaataccagagctctgtggcgacaggaaacaaaccccagaatataagtggaaaatgcaaggtacggaagattacacacggttccttcccagtttacctttgtttcccttttttttgtgtgtgtgtgtgagacggagttttcgctcttgttgccaggctggagtgcagtggcgccatctcggcacaccacaacctccacctcccagattcaagcgattctcctgcctcagcctcctaagtagctgggattacaggcatgcgccaccacgcccggctagttttgtatttttcgtagagacagggtttctccatgttggtcaggctggtctcaaactcctaacctcaggtgatccacccgcctcagcctgccaaagtgctgggattacaggcgtgagccaccgcgcctggcgagaagattcttaagtacatgaacattctgaacagaaagacctgtattccctcacaaatgtctgagttcttagctctggcattctcaacactcactgtttcttgaggtttcctgtgttccagaacctggtctaatcgttctctactatgatatactgatacttcattcatcaggaaacataactccttgaacataaagaaaaagaacaaaaagcgaaagggcacctcggaatagtcaaaatatgggcctgaagccctcaccctgagctttgctcatggaagactactggccccatatgaaatccatctcattctaacaatttgatgctaacaagtttcccagccacatctgcaaactaggaaaggagagaacagggctccagacagacctgcaagttaaggccacagtaagagaggccaaaaatataaacactcacaatgcagttttgatgtggggacacttcatagacgaaggattcttcacatttcaatggccctacgggagcctacatattaaaacagaagaccaaacattaacacccgtaataatgaccctgaaaacatccaagagaggttcagtcatgggccatcaaatgatggagtgttctagaaagacttctcatcataatggttaaaatgaaatgttttaaagtcagcctcgtggaaaattcgcttgaacattccattgcctgacaaatgctgaaatactggcaagtgtgaactaacatggcaatgtgctgtcttaatttctccttcgaggtgcatatcactaacccgacacacatagttacattagaaggacccacgtccttctgtcttcttctcagcagcattgctgaatagcctcctgctcttaatatggcatttaatttagctatctcaaaattaatttcttttatatgtgtgtgtgtatatatatatatatatatatatttttttttttgagacactgtcactctgtcacccagactgtagtgcagtggcgtgatcacagctcactgcagcctcgacttctcaaggcttaagggagcctcccacttcagcctcttgggtagctgggaccacaggcacacccagctaattggaaaaaaaaaaaaaagggttttttggtagagatgggggtctctctaggttgcccaggctggtctcaaactcctaaactcacaggatcctcccgccgcagcccccaaagtgctgggattacaagcatgagctaccaggcctggccaattttttaccttctagccacatttcttaattatatggctatgaagtaactgagccattccttttaaaaccaatgattcagctacatgtcctttcaatctacccaatctacaggaattcacctggttaaaaagccaatggcagggctgggaacggtggcgcacacctgtaatcccagcactttgggaggccgaggcaggcagatcacaaggtcagaagttcaagaccagcctggccaacatggtgaaactctacctcaactaaaaatacaaaaattagccgggcacggtagtgcatgcctgtagccccagctacttgggaggctgaggcaggagaactgcttgaacccgggaggtggagattgcagtgagccgagttcgtgccactgcactccagcctgggaaacagagcaagactccatcttgaaaaaaacaaaaaaaaaacaaaaaccaaaacaaaaacaaaaaaaacacaggtggcagtaatactcccgcaagtagatactgtttctccaagctacagcttttatggtaattcctagtggttttagcagaaataaccagccacaccacaaataaactccctgaaatctattttgttaaatgctgtggaactacagggaagccactttgtggactaagagcagcttcctagtagaaggcaggtcttcagtaggactaagcaggacggtggtaagaaaagttctagctggctacacttgaggcaccaaaaacgccatccatgaacattctctggctttgaacccaaaagcactttttacttcatttgagtatgaatggatacattttcaatcgctatcaagattctttgtcaggcccgacgtggtagctcatgtctgtaatcccagcactttgggaggccaaagcaggcagatcaaaaggtcaaaagattgagaccatcttgcccaacacggtgaaacctcgtctctactaaaaatacaaaaattggctggccatggtggcatgcacctgtagtcccagctactcaggaggctgaggcaggagaactgcctgaattcaggaggcggaagttgcagtgagctgaggtcatgccactgcacttcagcctggcgacagaaagaatctgtctcaaaaaaaaaaaaaaaaaaaaaaaaaaaaaaaaaagatatgtcagcattttgagacaagcaagtatcacaggcctcagtaacagcctctttcatggaactcacctttgtcacatggtatttactgacatggggggcaggagtaaatgtttattttcccacagttttcttatcaacctgacacccccatccccaccccgcaagctgcattccctctcttcctgccaaggggtagcaaaatacttggagattcctcttttgtcttagcttaggccaactactcacccagtaaccaataaacgctttgctaatctcttacattcggattgatgtgtttgtttccaagacagagtcttgcactgtcgcccaggagggagtgcagtggcacaatcttggctcactgcaacctccaacctccacctcccaggttcaagcaattctcgtgcctcagcctcccaagtatctgggattacaggcgcctgccaccaccctggctaatttctttgtatttttagtagagacggggtttcgccatgttggccaggttggtctcaaattcctgaactcaagtgatccacccacctcggcctcccaaagtgctgggattacagacgagagccaccgcgcccggcctgatgtgttctttttcaggcactcagataactcagttcccttggtcctaactaagctgaaggtcctcctggtggccttggacagctgggccacaccttcctctgccgtctaagtgccagcaccacagcttaatcagacgacaaacatgtcatggacgctacacctctagcgtcatctcagcaacacaaagagctgtttcacagacagagtcgcaactgaccagcaagtactactcccctccactctgaaaagaacagccggagagcaccagaaattcacctgaattctcctgaagggtgcagcacacaagacacggaaatcaaacagcacaggctccaaacaaagggagagcagagggaggaggcaaaacccgtcaacaaaacgaagtactgaaggggagggcgcagcaggcaggcaccacctacaggagcggggtccaggtgaggctctttttggaagatgaaacaaactagctagtacttgagccctgagcaaagtgaggaaaccagctctcccgaccttcctggtgctggcaggggacctactctcacaactctgatttccaagacaggaagttccagcaaaggctccagcttacagagaacaaaaaggcccaagatcttaacgcctgcaccaaccagtcctatcgtggttgcctcagtcatgttctggcaatttcacgaaaacaagagcatctggcatgaccaggagactggactcggcacccttggtgattgtggcagtcacctcgtcatgcaaaatgaccaacccgtcaccgtacctgcctgaccacagaatcacgtttgctttgggagactgcgtctgctgttgatctttccaggtcttccctctcctttaggaggcggcctcatccttctactggcacatctgacacttctgacagttggagctctgacgaaaagctctcatggtgggccacgtggctgggctccccacacaccaggcccagggctggctctgtgactgtcctgaggaatgcaggatgaggctcctacgcacaagcttatatctgacagaaaagacacaactgctagcctcattcaccatcactcctgcacactcccgcaagtctttcatcaaaccaattattcagagctatctccttacccttgcacctgcagctttccagacatggaacgttcctccctcccctccagtgaaaacagccttggacactcggcccaaatcgctcctcatctgtgaaacttaccctggggcaagcagctcttgtttctctaatgtgctgtccaggccaccaagatggccctggtacactgctcagcagccacctatgactccagacagcagggtcacattttctttgacgactcgggggcattggaaatgtatttgctgaataaactgttatgggcaaaaatgacaaatataaagtccacaagcggatatcctagcccacccctcacagaaatattctgagggtaggccaggcgcagtggctcacgcctgtaatcccagcattttgggaggccaaggctagtggatcatgaggtcaggagttcgagaccaccctggccagcatagtgaaaccccatctctattaaaaatacaaaacctagctgggtgtggtggcatgcgcctgtagtcccagctacgtgggaggcgaagtcaggagaatcactcgaacccaggaggcggagggtgtggtgagctgaggttgcaccactgcactccagcctgggcaacagagcaagactccggctcaaaaaaaatcaaataagatattctgagggcaagtgacagggctggcagtgtcaggggtcagtgaggtctgaaagggtaagagggctgagctcatgggtgactgaggcagcgtagcatgggcgagaggattccacagacataagacacgcacacctgaagccaggcacatgctacaacctggaaatactttcccaagaaaagaaaaaaatttcaagaggtctggattttctacataggtggatctgcctaaactattctttctcccctgttgcacaagacatgtattttcttagctaaattctctcatcgttcaatcaatccaaacaatttaccttcccattcatccacacaggtgacaatgacaagggcacctgccacgcagaaggctgccaagaacatgttccatttcttagactcaggcagaggaatgcttgaaccaccgcaccagaagatggaggacgagaggagagagacaatttttaagaaaaagagataaagggctgggcacagcggctcacgcttgtaatcccagcactttgggaggccgaagtgggcggatcacgaggtcaggagatcgagaccatcctggctaacagggtgaaaccccgtctctactaaaaatacaaaaaattagccaggcatggtggtgggcgcctaaagtcccagctactcgggaggctgaggcaggagaatggcctgaacccgggaggcggagcttgcagtgagccaagatcgcgccactgcactccagcctgggtgacagagcaagactccatctcaaaaaaaaagaaaaagaaaaagagataaagaaacagaattaaaatgtccctgggctgaaaactgacatattttccaaatggaagggacagtgcatgatacaaagcatgaatcacaaacacctgtggacgcgagaccacaaacgacaaagagaaaaaatcttaacctccaagggggaaaaaacccgagtcagctacaaaagaaacgagaaccaaattaacagaacagttggccaggcacggtgacacacgcctgcaatcccagcattttggagggcaaggcaggcagatcacttgaggtcaggcactggagaccagcctggccaacatagtgaaaccccacctcataaagacaaaaaaataaataaataattgatcagacactggtgctagaagagagcaacagcatcactttctgagggaaaattattattatttttgttgttgagatgaagtctcactctgtcgcccaggctggagtgcagtggtgcaatctcagctcactgcaatctctgcctcctgggttcaagcgattctcctgcctcagcctcccaagaagctgggattacaggcgcgcgccaccacacccagctaatttttgtatttttagtagagacagggtttcaccatgttggccaggctggtcttgaactcctgatctgcccacctcaggctcccaaagtgctaggattacaggcgtgagccaccgcgcccggccacaaggtatcttttatagaccactggttttgaaaagacataagattcagcgttgaagaaaatacctttggaataggcagtcttgatgcctgctaaaggggatataaattgataaggcctttttggacaatttggcagtatctgctaacatttcaaaaatgcataggctctgaaatatcaattctaaaattctaattatgtaaggctaaagaaataccgcacgtgaacaaatatttaagtactcacccattctatgcagcattgtaataaaaagtaaaacctgaaataacctttattgcgtccactaataggacaatgtttaaacaaatgacacgtccatcatacagaatactgtgtggtcactggaaggcacatggacctgtatacactgacatgaaaagatgtggaaagaatgctgggagcgttaaaattttctgaagtacaacgtagcacaatgcatacatggtttaggctttttagaataaaaaatacttatacgcagacatttatatttacacgtataacactgtgtacagccccgaagcaatgccgaaactttcactgttgttacctccgagtggggactgggaaagcagaggttagggtcgttctctctgttttacaaacatttattggcgcatccatcaattccaggccccgaggacacagctgcgtcaacgacatcgagtccacctgctctggggacccggatgactgctataggttttgttcactgtggcgtccccagaacctgcacggcgccgggcactgagcgggcgctcacatgtgcgtccaatgaacgaattaacaaatgaaccctcagtgcgctactgggaggcggggaggggtaaagcacgatccatggaactagcacgatcaccccgagtgagtccattccccgcaacatgcacccgcaaagactccgcgctccgcagcggctccacctgcacgtgcgctacctgactggaccgaagctccaggagggacgaccccgcagccgctccgcccgaccccgcgaccccccaagacccagcctccttcagggctcccatgggcgggtggcgaggggagtccagccgaggaaaaggcagccaagctggagctggcgaggagcggagcgaaagtaaacgcgtctgccgcgcttggcctcgccggacctcccacgcctgtgaagcaggtgccggcgcctcgctccccggagcacagggacgtccctgccgtctccgtggcccggcccgcccgctgcccgtccagccaggacgccctcacctcccggcacggccgccagcgccggcgcccgcagcaaaggccgcaggcggcggccccacagcagcagcgcccgcagctcgcgcgccatgtcgtactcccagagcgccgcgcgcagccacgcgggaccgtacacgatgggaaggggcgggacggggctgcgcggggcggggcttcctc

SEQ ID NO: 124 - DNA, 733316 bp, Homo sapiens
ttttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaactgtccagataatagagaactgctcaccatcctcagaagcaattcatgtcctgtctcaccctctctaatggttcttcggactcctttttccggagctgagaaaccctaaaacatagcacccgtttacgtctagacatgcacaggtgctgtgaattgaccccatttttgcagttcatagtttattaaggaggaaagaataagccctgtcataattagttgaaaatacattttgaggctgtataaaaagaattataaacatggcacatctgagggcaagtcttttcaagcctctgtggcgatgcactattccctggagcctttagagggcagcagcacactggctgactccagcggatttcagagaggcgaactcccgaccagaaccttcctcctggtcaccatgccaaaggttgatttgccaggctctggcctctcagtctctttcttttcagttctcattctctctctctctctctctctctctctcattctctctctctctctctcattttctctctctctctctctccaaccccttcctcctctctctctgttaaaattatacactctgatgaagtcgcccctcaaccggaaaatgaaagctccaatgaaaaagttagacaagccaacaacaacaaagaaagaaaccagggaaaaaggaaaagggggctggtgacagggaaggacttaagaataagaaaagggcagatgtttcgcaaatatatgcaaagcaaaactgggtgtaccctgaacacttccacagagaaacagaccaatcattgtgcacttcctcccgccacactggtggagctctgcattcaaaaaaagaaaaaaaaaaaaggcaaaaaagcgtggccgcaggcacccgcctttcaacggtcagttctgacattctgactgaacatctctcaattgtccaaggagaacaaaaacattttcatctcctcactgcaaacatttctgttatgagaaaaggctgcttcaagaattgggagtgtgttttaaggagactggcggccgagttagccagcagagccttctggtttttaactctcattgtgctggccccagcaagaagttttaggctgaaacatagcagtgagtaaggctgtggaggatgttggctctttcctaactagaccatattgtatgtggaaagaaatatgcattaaaacatattgatgatatggtaggtattaagcatgttaaatgcatggaaattaaccagatcggcggcatttgatgtatatatttcacactcttttgcacatattgcacacatacagtgatggcaatgctttctgcaacatatggaaaaataaatattttatctgtgtgagctcttagcagtctccagggtgttgagagtgctctcttctttcaccctatcccaattttctctcttcactgggctcccaccctctcttgcacgttaatgtgccttttacttatcagcttggtcttttcctatctggtaagtaatgtgcctgttacttatcagataggaaaaaattagttggaacctcctattggctcatgataatttagaccagtgatgcctcccccaatcttactggagtcgtaacaatttccctactcttttccccaacaatacattaaataggcttagtatctgggcaggagagaaagggtaggtggtaacaaaccaccccaataagggtggtagcggaactgcgctccactacctattagctgtatgtcctgggtagattactccgcatctctgagcctcattttcctcatctgtaaaatgggaataataatacctaccgcttagggttattgtgaggaacaaatgagataagccatgtaaagtgatttgccttgtgctggcacatggtaagagctcaataatggtagttcctctcatagggattgttagttctgtgatattcatcatgttagctttaagaagacatttccgggcaaggggtggtagctcatgcctgtaatcccagtactttgggaagtcgaggcgggcggatcacgaggtcaagtgatcgagacaatcctggccaacatggtgaaatcctgtctctaccaaaaattcaaaaattagctgggcatggtggtgcatgcctgtagtcccagctactcaggaggctgaggcaggagaattgcttgaacccgggagtgcagaggttgcagtgagccgagatggcgccactgcactgcagcctggagcaagaaaaaaacaaaagaaaaagaagacatttcccttcatttcagtaatctgtttagatatctagattttgggtaggggcaaatggattgttattgtagcaaaggcagaaacaatgttaggaccagcaatctcttcctcaacatttgatcttgctgtatacttcctgacatctcctttctgctcacatgtttgtcattgctgtggctacactacaccatgagctccttgaagctgagggttgagcaagctgcacttagcctatagaagcccatcaagcctggacactatggtctattcattgagaccaacctatgggactctggcttatcgtgttttcttgcaatttatcatttctctacctggtctgatgtcctcacatcaatttaagatattttagtgattaaacacattttattttctcaatcttattttttttaaccttggcagggctgatttataatttttttttcagtataatttcctcttaactgtatcagtcaggatcctggcaaaaatagatggcacatgcaaagtttttagctaaagaggatttaatgaaaaaactgtatttggagctgcagatgaggttaagggacctcaagagagatagcaccaggtactagcaatagtagagactgccaggtactagcagtagtggaaagctttaaaccatttaaactgaaggggcaagtaaaatggtgatgaattctgagtccagtcagaattggagttgggaaggagggctgaactaacacatttcctgacctctctcttcccccactttcacatctcctgctgatgtctccttttggccaaattcaaagggaagcccaaggacaagagagcctgggtaatgtagtccagaaggccagtcttctgggtcacacatcagggcaaaagaatggttctggggtttttttgggggtagaatggggtggcaagactaatcaacatatgtgttcttctctcttatactttcaattatactttctggaaggaaagacagaacaaaataaaataggttctgtcttagcttccatgtacctattatgtcgaattgccattcacagagcaagaaaagagaatgctgctcagccgagcagggatttttgtttgttttgcttgctgccatattcctagttcctagaacagtgtctggcacatagtaaatggtcagcaaattttaaatgactgagtaaatatactcacctctgccgtgacagactttatatatatatcatctcattgacttatcacaataatctggttaagtaggcagggccactgagcattattgtgcaggtggtatggggggggtgggtaggtattaaaatttaatatgtgcctccccaacccacttccaagccttgtgactaggcccgaagcattgtcaacccaccagaagagatatacttctgtaaatgattcacattttaattttttatcctctttattgatttttgcacctagcaagtttctgttttattattattatttctcttttatgcattggaaagccaagtttctgaatagcaaagactgcaaagattataacccagtctgtccattctctagggcccatgagaagtaaaagcaggcactggcattctgcacagatgaaatacttcctacgacaggaatacatgctcacttgtggacttctctgtaatctgtaggcaacatcagctcctgatttctaggtctggatctgggttctctgtagcacaggaaggtaagagtgataagaactcttttccctcttaaaggatatagaaacttttaaacccatctgcatcatagtaaggctgtgttatctgtatcagcatagttactctgtgatgaagaaaaactcagaaaactatccagatgtgggaatttctcgggtattccttgcacttgaacttaaggatgaatgaaggtatatacaagtaagttccttgtgtgggtgtggactgaagaaactatgtttgatcttctgtcatgtctttagtccccagtaactcagtcctattagtactatagaacacattcccctccgggaaaggcaggcctgtctatcacctacacagcagcccccatcaactatgattcagttgactggaagcattaaaggtaaaaaagcaacacaaaataaagcaaaactctggcttcatccctttaggtttgatttataccagaatagctaaagacatagaaatatgaatgtaaatatcctacctgaagcctaagagggatgttagtctcccaggtttagcgttttccagtaacatagaagtctgtaaaacaccatcccattacctgcctcataacatataggaaaacttgtgaatataacaactagttattgttttaaaatgtgtaattaagttactttgcatgcagaacttctaaataattcaaatgactggcttttctattggaaaatagcatatattcatctgttatttcagcaatgattaatgaatacttgatatcaaactttcatcagtattttcccataggtatcatatcccctaccccaaattatttctgtacttttccttgcaaggtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgtgtattaaacaaagtgaactaagaagccttttattggagacataatgtactcacagtagtttcaaaatcaatggtgtcactcttcaggtaaattactccaaggcttgggcctagtgcagatgttcattggggcagggagcagagagcggctgcatctagatcagacaaaaaacaaaaataaggttgttaaatgaacaggtgatggtgatggcaattatttattttgataggaaagaactttgggacttgagtgagaggttggttgtttggttctacatctttgcaccagagaatggcgaggtacggaagggagaatggagaggatgttgtccaggctccattttcagtgctttcacctaactgcctgtgcagcctgggacatcaacagtaccctgtcagtgcgggcggagctgattttgtggttctgacttagaagctgagttgtgggtgacagtgggggaaggaagtagaaacagtgtccttcaaccttcccacagttgattcttctagtatccttttcttttttttttcatttattatatttatttattttttattcacacataaaaattgtatatatttatggtataaaacatgttttgatacatgtatacattgtggaatggctaaatcaaactaattaaaatatgcattaccggctgggtgtgctggctcacacctgtaatcccagcactttgggaggccgaggtgtgaggatcacgaggtcaggagatcgagaccatcccagccaacacagtgaaaccccgtctctactaaaatgcaaaaaaattagccaggcgtgatggcgcacgcctgtagtcccagctactcaggaggctgaggcaggggaatcgcttgaacccgggaggcggaggttgcagtgagccgagattgcaccactgcactccagcctggcaacagagcaagagtccatctcaaaaaaaaaaaaaaaaaaaaaagaattacctcatgtatttatcactttttcatggtgagaacacgtaaaacctactctcagtaattttcaatatatactacattcttattaacgatagtcatgaggatgtacagtacatctctggagttattcctcctgtctaaccgaaattttgtgtcctttgactgatgtctcctcagcgtctggcagccaccattctaatttttgcttctataaattaagcttttatagattccccatataagtgaggtcacgtggtatttgtttttctgtgcctggcttttctagtacaaaaaaaagcctattttttccccatatatcatggatgacctctagattcatccatgttcttgcaaatgacaagatttccttctttttgaaggctgaatagtgttccattgtgtacttttaccacatttctgatattcttgatttcatttcagtctctctctttattgcttagttcttaatgtattctagtgacacccattgatctgggcatgttctgagcattccctctgtccttcactgcaaaggctccattttcttccataggctctaaccctgaggacaccgaattaccctattttttcccctatacctcagtctgctattctgccttcttcactggcttattttctttcttctgttctctaaatgtagacattcctctagatcctctcctcaggctttgtctaccccagtcctccctgacctcaacaatcacttctccatggagagcatccacattgctatctttagttctagcttttctacagagctgcacacccacattctaaataacagctggttattggttcattcgttcctttgtccattcattcagtgtttatatagcatctatgaggcacctggatgaatacaacagggtctctaactttgagaagttcacatcgccatcaaatactacacaggcttttctaattcagaaagtttagaacttaattcattgtctttcctttaaaatctgttccttctctagacgtcccatttcctgccattggtattctcttcatccagttacgtgggcctacagctggggagtcatcttcaattcttccgttttttttttcttcctatatccaattagctacccaatcctgtagattctactctgattgtgattcctgaatcaatacctgttttctataccagcccctatttctccctttgctacctactgtgaggacatctatgaaaagctcctgactggtttcacttttccagtttttctttacctcttgtccatccttcacacaaacattacattaatttttctaaagtgcccttctaaacatatcacttctttgcttacagtcctccttgcttattggattaaattcaaacttctcagtttggtattcaaagctgctacaatgtagcccaatctagtttctcactcttatctctacactccattctacgctccagcaaagtcctactctttcctaccatgttcatggtatttcttcctttctttcaatgtctacatgtagcttcttcaagggccatccaaatgccacctcatttatgaagcatttcacaaaggagagtgcccttcttaaatattattagcacattctgtactactccctttgcatattctaccaattagaatggttatttgtgtaatttgtcttccttcttcataagccctttgaaagctgagacaatttttactctgagtaccctatagtgggccatgacttcttgcacgttaagtttgcactaggctgataatctgctgaactgaatttaaaaagaataaaccctcttgccttgagtcatagaaacggggactaaattgaaaagacctaaaagctcatctgcttcaaccccctcatttttcagacgaagagatgaagggaactgacttgctcaaggtcgcatccttgttagtggctgggcaaggataacagacataaaaggccacagactaatatttatcagtgcttacttggcaccaataggcccaacagatcatcagtaatgacaagaccagagagagggaggttggggtgtgtaacctgcaaaaatatattgtgttccaaaatataacaaatttgcttcatttatttgcttcaacaaaccgaactaataaatatgttttatagttaaatgttgtctaaaaaatgagggtggatttaaaaaacaaggaagcaaagttttctaacattaccagcagaaataattatgacaatactgtcaacaccactggggaggaggtgcggatggttaatgggtacaaaaaatagaaagaatgaatacgacctactatttgatagcacaacagagtgactatagtcaataataacttaatcgtacattttaaaataactaaaagagggtaattggattgtttgtaacacaaaagataaatgcttaagaggatatatgccccgttctccatgatgggattatttcacacggcatgcctatatcaaaacatctcatgtaccccagaaatatatacacctactatgtacccacaaaaattaaaaacaaataaaatgttaaaaataccactggggtgataaactcaggctgaaaataagaataaagaaatttctcatgctttggaaaagctgtgtgttcagctggagttcttggtgaaaacatgcagtaattccgtggttaaattcattactttgtagaaacaaactattggcaatctgctattatgccacattaacacttctttttccacctagcttagcctagtactcattctctaggtttgtttaaatgtttacttgtttttctttccttatattactaatttacttgtagaaatgcatagacaattgcctctgagtctgttcaaattttcttgccttgttcttctcttgtagtagaggaaacattagttgtttctcttctctatccttatcctcaaacagaatcattttctctcacccaaagatgaaaagcccaacaaaacatgctgtggggataatagtgtttacctaggtgaggaaaacagacttttccagggaatctcagtaattattacttggccagaaaagctcagctcttaaatgttagctccaatactacaagacctcatctgcatctcccaggtgagcgcttgactcactgttactcaccagaggaaaaccttggtaggtagcattaatcaaactctttttggccagtatggtggagccatgctacgcattgagacatccattaaatagcatcaccccagcagccacacaaacagcaaaatgggctcaagagctcttcattgttctttctaacccatcataaggctggacagattattgacacttcaccagatagaacttacttctccttttgccccctggcaactacattaaaatcataaaggaaatcactcatcaatagtacattgcagtgaaaaattatctggcaaatttacaaatcctttgtgtaattatataaatgtacattttaaatatatctaaaatctgatttacattgtgcattttataattaatacaaccatagtatgtctgtcctttaattaaatccttctttctcagtcccacatcctgctgctataatcttactttcatttttggcaaagtgtcacctagctccatcttctttccccttttgccttagtacacacctgagcgtctattaatcagaaccactgcatggtgtgtcatgttttattgcttaaagggtggttacactctaaaaaagattcggtgagaatgacttcatggggtttcacatttattctcttttaatgactttcatatccagtgtactcggtttttaagtcaaaagataattttgaggggctgctgatgccacaaattctccctagaacctgaaaatccagctgttgtctctgcttcttacatcatcactgtaataaagaatctgctcttggaacccagctggcaagtttcttgatggtgtcagaggcgaacagacagtaggtcacttctctacagcccgtttcattgttggcgtttctgcagatctgtcttggaagcccttagagagcagagctgttatgaaatacactgccacatatcaatgtaaggaactttctgcagatgtctactttgagtatggcctgtcccagtcctaggaaatcacaccacatcgttctaaaattatagatggggggttcatgattaaagtttacaagaaaggtaatagtaacaataacagctagcatttattggatgtctaaattttatcagggactgcaccaggcatttttataaatgagtatgttcttgtttaaccctcatagcaatgctatggtgtatgttttagtatacccattttacagataaggaaaagtgagacttaatgggcttacgtaacaggtcgaagtttagaaagctactggatagtgaggccagaatccaaacccagatctctctgagtctaaatctgtactcttttcactatataacaactgttccaatgcagcatggacacgggacacatttctagttcccgctgtgatcacagtacaaggaagatgcttatttccacgatggttcagagccactggaaagatctgggagcacagactccaggagaaggaactatttcagaaactgccaataagtatagtcccttccctcctcctttctaattgcagatgagaatgtcctctaacagtcttctcaaactctaatgaacaaacgaatcacccagggcttctgattcagcatgtctggggtggagcttgtgatcctgcatttctgagaagctcccaggtgatgctgatgctactggtctgggaccacaggtcttatttctgacactctcctttctactagggttgtttttgaaggagcagttcaagccaaataacttggctaacagttcacacagccagccgactggcttctgattctaggccagtttgtcaggtcatcaggcattacacagaattcaaggagttcttagcatagagcacactgtcaaaaaattgtttttagatccccaagggttttcccctctctctggaaattcaaaatgataatgtctctaacatgtaaagttcctatttttttacattattgttatttttaacaataattatctggtaataattcaaataacaccttccctctgagaaattcaatgagctttactaaccttaattgtctaacagcaattcccaggtgaagataaagctgtctcaaagatcatagtaaatttaaaattgttccacttccctcgtttctttgccccaaatgtagtggtgagttagtggggacgggttactaattggcaaaggcccactatcataatttgaggcacagcaaatttcataaaaaggatacatctaagaaatatttagcagagaggtcattgtggggaatacaatgttagaaaaaaaagagttagaaagtgtaagataagaaaagagaaagcaaaatcaggactagctgatgacctccgatgagacatttaacctctaggtggctcagcttttctatctgcaaaaagaggaggttggttttatgatttttaaggtcccttaaaactctaatagtcccctgagaaggaagatgtgggaattaagtagctcatcaacctgttaaaccattaaacatgttaaggaagtctatttgacttttaactttttagctaattacccgaaacaaattcccaagtctacgtcaccagccccacctctctggaaagtggtgagaaaaccatttaatgaataaggcaccaaagacatcacggccagataaactaatcaggaacaccatcgtcagcttactgatgctgtgataactattttactttttaggttttagttccttaattaaccactagttaatacccatgtccataagaaacacctctgatggcttgaagacccctgggatggccctgccaacacaaggtggaatcacaatcccactgtttgtcacattaaatctatgttaattttctccatagagacctcttgattcctctttgacagttcataaactctgttaatataagttgcacatcccatgccatgagcgttagcattatcagatacagttgattcttgtttaaaataagagatcttttggatcagagtacatgtaaacacacacacccacacacccacacacacaatcatgaatttctggtattaatgaatctggcctggtgatgggaacccctctattatgtcaccggatactggaaccttcttatccagaaagcctgccacaggtcatgttaataagatcgttttaaactttgtaatgagaattctaacatgagcatgatttatgacacagcattttatttggtattatcagagtttcctataccttacctcttacagtgagtatgtgttctgaattaaccattatagtttgtggtaaatggaaaaaaaggtacagagaaacatcacagtggcattactccagataacacactctgtcactgttcccaaagtgaacatcatttccctcttcctgctcccatcacttcaatagtaactttggctattactgactaaatgcttaccgtgtggcaggcattgagccttttcacagataactttattttcttacaattactctttgaagttgggaattatattcccattttatagacgaaggaggtgaaactgatactcaggaaaggtacagttattggtcatcagtcatgaaggcagagggtagcaaagcagagttaagggccaggttctaaccacatgttctagagcttaacctataccaggctcacaatcaccaaaccactgatctgccttcattccactcctcttcatttgtgatccccaccattggcttaggctagattcttcttcatggctctctcatgtcttcttgaatatttcttgaaatttctcaaaaccttctacacttgatttatgttttccctccctgtattaataatttaatccaaaaactcattaacacttcttttcaacagactttatcaccccttttcttagctctcatactccttctaaattactcttttgaggcctcacatttgacatcagatgttccacacccagctattgaactcactttcccagaagcccaaggaacctattgttttcagctggttcattagtaggccccagttggccttaccagatgtatttgtccagtttgatcttgccccatgatcaaccatttcaacactgtcctcagtaaccatgcagatttccttccttttctaactttctatgtgcagtgcctccttttacattcatcaactgtgaatctgtatcaccattctccatttgctcccactctcagaacaaaaggctacacatgcatgctacctggacctatgctcctgcccactgtttccaggtacaacctatggcagtttttcttagtttgttctcctttatgaagtcccattctctttttcagttgatgagctagcatcctagtttaataaaaggatctacaccatgcagtgtggtaagcttattagctctcatctcctctaatatctctgaattttcattattttatttcctcaggatatatcttttcccatgttcccttcgtatcttgaaggttattctctctacttctctttatcttcctttggtttcatcagggatactttctctgtagctgatagcatatcaatttctaatagtactagattaatcatcaccacataccttttttttttttgtcccgcattcaactcctgcccttcaaaaatcttttcagatggtgtatcttaaagtgtgtttcatactggaacttcaagatgcatctcaaaaaaagttcctcagtcaagtaagtttaggaaacactgaaaactatatattctattttcaaactcgcaagtgtacacaggatattaaggtgctggaagcctaatctttgtccaggcttaccggattacagactcccccatccccctttttaatggaacacttatttaacctcagaatatgcttcgggaaaagatgctttaagggattcccctggttccaaactcttaagcctgggctcggaaattcactgactccctatcaaatgagtcctctcagatttcctttccattaatactccacatggtctaaactggttaacttatagggtgtcagaaagactaagcacatttctatctctgagctactgtatataccagtttggctgcttggaatacctttatcacctttcaaaaaattatataggacttttttctccttcagggtccatatataaaaatgtatcctttatgaaattttcccttgtgaagactgctttagcccataatgttttctgccactttttaagtacttcaataaatggttatggtttactgcctgtttgctatattattagcgagggtgtacatcctcttgggtaggaaccttgttttatacactacagagaccccagctttttgagcacagtaggatgttataaccatgtcatcggttaatataaacagaaatggatggcattaagacatgatggtttaaaacccaatttctgtagctattggaatagtttaagatgctaacagcccaggtgaaatgttccatcacaatattgggaagaaacactacccgccatcactgccattgccctgaaaatgataccatgtgtgtctaaggatgtggataaaggctagatacagaagagcaaaggcagctccgttcttaggtgaaagtaagaatttgcattagttaacaccaaatggcgataagattaaaataatctaggaacatcaagtgatccatgaaaggaatcactggaatataccaatggtaaaattaccattcataatcattaaatcatggtaacttgatgaaaagaaaaaggatattttcctacttaaggaagtcagggtaagtattgtctgaggttccactgtgtgctattgtgcctggtatacagaatgtgtagcaactatttacagaatctgctactgccttctagtcacattccaaattctatctctttgaatcagtctggagacacaatacattggtgaattcaaggcagcttggcaacgactggcacaacataaaaccccaaataatgaattccatctttcccataaagctcttttattgacacaacatacaacagcgcagggcaggttgtctcgggctagtgtgtaataactagatgttaaggggccctgagtttttcagattagatgttatctgaagttgggactcagcaggttccctaacagtgaatttttagtgggcctacgactagaagtttggtctcttgatgcttagtcagggagttttattatgtgagagagaaaagtatagctttctttcttaaaactgcagcaatttcatattttagcagaagagaaagtgcattttattagagtataacctgtggagtattttgctaccttcctggatataaagcggtatacaaacaaaaaatttaataaaaagctattttataaataagaatgtttacttgtgtttaccttaaaataggtatagcttgtattatttaacatgtgaaatagaaggataatggtaaaatttcataaatataaaattctgtgtccgtcttcagttaaaattcgtaacagtgtatcagagtgttggttattagtagtaatcaataataagtattttttaaattggaatttttattgcaggagattattgggtgggtgaagctaaatggcctagatgttttcctgtcatgtcaatacttaagaattgtctttctgggcaatttacacatgtgagagtgaaaatgaagggtggcctgcctattgggtgtgtaacaggccaccggggcaagactgctattttctgagagccatgggcagtttctgcaataaagtatctgagtttcttctttttgtagtaaaaataaatagtttacttttatgttctgggtgaagcctgagatctctggatctctttgctggatttcactcttggtgggggcagggagatactattggcaatgctttatatatattgacctagacatgttaaagattatgtggtactttcatgaacactctaaaaatgagttctccctatcatgagttgcatagatgaggagattgaggtggatggggtgaagaggaaggaaagggcagtttaagcgggctagctaatgagtagtagaacttaatctaaaaccaagattttcagcagaaaatgctttttttccccaaaaaatgccatggttgtcaacaagctttgtagcaaatctggggcagagcactagatggagaatcagaagatctgccttgtcttcctggatctggtaagaaccagccgtgtgaccatggccaagtcactaacttttgtgagtcttattgttctcacttataaagtcatgagcaaggaatcaatgaatggcataatacttgtaagctgtaaaatctctctcttgtaaaatggtattgacaataatgtatgctttgcctatcttataaagttgtgaggctaaaataagctgatccatgtggaagtgctttgtatagtgtggagtactgaatcaatgttgtctggaagatttaggaaagggtcccgaatgtgtgtgggaactgacagccagtccacttccattcaggttttaggagaagctataataaagcactggcagcagctcaaatcccactccatcctctcctctcccagcacgctgcagagaatcacttgaggaaagttacttgagtgggtgagccaaatgctcaagttccaacctttctgagtagaagccacagtgaatcctgagccacaacacaggtgacaatcactgttcctccaggtgtgtctgaaacactgggggaccctagggaaggaggtcagacgtcactgctcctgaggacccgttttctcctgtacacagctccagcccacatgatttcacctggcagccccaagagacaaaaaggatccagaattagcaggagcctcctctcctgataacctaagtgctctgattgaaaggcagagggtatcaggagaatggctgtaccgagtcggcattgatttctccagcctttgtctgtgtctggtttctgtctcgtttggaggtggttactgttactacaagcagcatgaatcatgtctctgttaaaaaacagagcttcaattgtcttacataacccctggtaactgaacgtctaataatagcaagccatttccaggtagggaatctgtctacctcccagacacacacacacacacacacacacacacacacacactactcccaatgcttcacagcacagtgagacagacagggaggagacagaaggagaaaggggacagcacaattgaatttttttgtgttttaaaatatattgaataatcatgcatcatgggatctgataaccaatatacttagctgagctagtttaataaactgtagaaaacaagaattcttctttaaagtatttgaaagtatcccaatccataccagacagacaccttctctaacactcttatactgcataaaaaccccaaacccccaaaacagagtggggtgaaaatttcactggattgtctgctagcttgtaccaactagcttcaactttcaaaggattttttttgtcctcttttttgtttgaccagagagtgatattccaaaggttcttggccgagatcatttcataaaattccagagagtgaaaggcaactgaaaacatggctgcagtgttccaccatgcagactatgtaatgtcaggcacttttgcccgagccactttctttgacggagatgactttccatctgaggacttacatttttcccatgagtacactctctggcttgtaatacatgatgaggtctttttatacttgatccccactcagctacccattaaggtggctactgaaataaaaaaaaataataggagaggctgaaaaatgatttttgaaaaatcacaaaggtaggattttctttaaactaccaatttgtttgagaacaaatacaaatgctggataggaagtttaaaagtttatggggaataataatataaatgtataacatatatacgtccatttcctcactgcttcaccttgcccatgctaggaaaaatcacttaaaggctgtattttttgagtgtgcattctcagagtgaagtagctgtacatatcatgtaaattggactggggaaggacttcgcagaaaattacagatggcaatcacatcctgccagtcatttggtctagaaccagagaagaaaaactttcttttctcttttgattgttcagtaacatgaaacagtggactagactagttcaaaccaaagaatgttttagggcacacccactttgaggaccagcacctggctatgctacatgctcttcaattgtttaggcatataaaaaggagtgatgagatggttatatgtcaaaatggctgttctccctccaaacaggatttgattggcttatttgcttttggagtactctccaaatccataaacaaaggagtattgaattgaagaagcaaacaggagaaagaaaaaggctaaaaaggaaaagagagaagaagaggaaggaaaaatactaatttctcagtattcctatctgcaaatctggctggatttgataacaaaactcctactactgttctctaatggtctttgctgcatgccatatggacatggcttctaaaggggatgaattctaggttttcctcacaaatatccaagcacagaacagcagggatcttgacgactaaatcatcctaactcacgacgaggatcacagaggtggaacatggctgttgggactagattcttctgcttatttcatgtgctttgtgaattaaattgttcgtagagttggaaagctggtggactaaatgttttaataaaaacagccatgagacacaacagttttcttcacaaaggctttcccccctagctactgtgaatatattgctgaatggttctgacttctggaagggcaggaggtttgcctcttctctttgcctcaaaaaccaggcttattctatgcatctgggagatgattatacttacccgaaatttcaggatactatgtcagacagttccttcacagtggtgtgtctggcacctaagcaaggacttggtgggccagacacatttaaaatgtaaaagtggatgattatattattttgcattgtaacaatgagagtatttctggattgtagctgacgtgtagatcatcataaccatatgtggcacaacaaaccacacaacattgcatcagaagcttgtagttaatatttttaaatgattgattattttgaaatagagaaatggtggatgcttttttcgacctctttaaataaccacttattgaatgtctattgtcagtgatggactctttcttcacagaagggagctgggctatgccagactctcaccatgttctttctcctctaacactgaacaaaatatcagtaaaacaccaagtacagctggttttgaacctagtaagaaatcagtctgtagtaatgggccatattggtaataattggaactggtgatatcgatagcagtgggaataactgacttacaaaggcacagcagttcaggaacgtctcagggactcagagtgggtaaatgcgtaaatctgctctcacctatttatatgctccaacaaatatctggaactctagaaacttcaagagtctaatatgatcaggccacgtttataggtattataggattcatataaaataaggaggcatacatgttgatctagtgagcgtctccatatttgtacaacactcaggatatgtctgagaacacattttaatttttagaatcagctatagaatctggcagttattataaagcaaacttcacttcaaaaaaattaactgagaagccagatgataatccagatatacaaaacaacattggtgggataagtcaaataattctctaaaatgattatggagaaactgaagaaatgaagggcacctatttatcatatgtgggtccccagccacgtttgtaatctgttgtgtgaccttgggcaagtcatgaaacttctctcgagtctcatttttctcatatataatgtgggagtgttagattagatggtttttaagattctttccagtaataacatttgatgattctaaagtaagaagagatgaaagagtaattcctctttcctcttgttttggtaaatacttgctttctcctgctccgtgcctatgcagtttgcagtgagtattaggtttctggactcaagaagtcaaatagtaaatactgaagctatttttccttgtacacatggacaaatcataggggaataatccttcctttctttgtatatcagtgtctcttctcaaatcagacttatgcctaaggtaatcacgatcattctggtactaataaagatttttcctcatccttcccacaaggccctcacccatgctcatgaaagcttatgtgattgggttatttctatatttatgtcttggctattttttctctttcaacttgtttatgaagtccctggtaagcataaagctgcaaaaacaaaaacaaacaaataaaacaaaacagctctgtttgaataatttacttcagttgaagcagtataagaaaacatcctaacgccgaggggaagaaaacaggtcataaaaataccctggtatcttagaaaagactaaataaaagcttatatcaataatagtttcatatgttattgtctttcattttcaaagagaatggtacatattggctttatagtctggtgtacagacgtggctatttttccccatagctctcaggtcagtgcatcctcaaagccaagaaggcccagagcctgccgagctagctttacataaacaaaggagctacacagaaaacccaatacccggagcttatatcatatcctgactaggcactctggttacccatgactcgctcttttccatctgtgccctgattctctgctggtttaattcccttcacctagaatgccctcagtttgcctccttttactgctcagaattccctctggacacaactcacgactagcataagccccatttccaagaagcagcttagtttgacccaacttagtttgacccagcgaaaattttcatggatagcaagtgaaaattagtccttgtgataactggagtcactgaaaccaggtatctaggaagcactcagagaataccagagaaaaactttcaagggttgcagtgtcctcataggaggaaaaaaaaaatcctagctttaagaacaagcccaatatagaagctgtggtatgtaagagaaaagttgtagccatgtacgggaggaattgtgttaaaacagtctgactttttttttccaataaaggagaagagatcctctgtttcttaaaagaagtttagtcattggatatagcaacatacagtgtcataaagtttaattgcattaattatgaagctaaaatgtctacattttagtagagagaacatggggcatagctaaatggcgaagacataggaatgtgtatacaatttgagtttcacttcctccaaatctctcagttagaggatccctctcagtctgacggtcttatcatcaacagcttcacaaactctgacaacacctggctgggtttaagggatgggccatgatatatcttgagagtaaaagatggaatgaaactcagaaatgctgaatgcttttatatatgtatacaattttatttatgtgtatatttatatatcaatatatacaaacatatatatttgtatgatgtttggcaacctcactcatggtattcctgtgaagtaggcatgtggtaaacataattagcccattaaacagatggtagggctctggcatatctcaccatattctaaaatggtggagctgtaagcagggactaaagagagtgtagtttgatacatggctaactgcaaatctctgtgaattgctactttcctaaagacaatctgggtaggctgcatttggctgagaactggggatagtttaggaagctttaaaaatatacaaagggacaacttttcacattcattcagatatagtatcttcatttttacttactagaggcatttttttttaaaaaacagctttttatcttaactcatctgtgttccaagcaaacttccaaattgctgagcagattaaaaaaaaaaaccctacatgccaagtagaaacactgggtaaatgttattttttaaaattgtcttaacaaagtgcacttttggaaaggataaagttgaaaagacgtttggtactgtaaacacttagctgtcattgtagcacagtgaccaaatacgtccaaaagcacatgtaatgaacttttatccgactgaattatatgaccatggcattgccactctatagtacagcaggcttcagagatcctgttattaaatattctagcctaattctttatcatttgaaataggatctagcagaagtgaaagagttactaaaattaagacttgaatttacaagtgtgtttgaactggcttcaggaagacatgaaacatcaatacatctggagaatagaacttgcaattgactgttctttaccatctggtctcaagaacattttctgcttggaagttgcataagcaatgaaaaaacacacaaacaacttcctgtaccatgtttttggtcacttataatgacgcattacaaagtaaaccagctaaatatgagcaactgcgccttactcgagatgacaacatacattatataactaagatcaatgaaaaagaacatctttattttaagagacctggacttaaaatattcaagaataaacatccttccttctaaggtgtttgtactccttctaaggtgtttgtactgagtagttttggctagacaggtttgtagagtcactactacaaaacaatccctatattttttcaaactgaaaaaggatataaaaaagcaagctatattgaggaataaaatgttccatatattttaaaatgttttttaatgacataaacttgcctttttaagcagtaaaatatattctacacatgtttttcatagaaaacttttacatatctttgttttcttaaacacagtatgttgatgtaatttaatttttttctatgatacagggtcatccttgtgactattcattgttcctgttttacaggaatacacttttcttacttgtggtgagaactggcctcatcccttggctcagcctaacggccacagactgagctatagcccactagccactgccatagccaactggcgtcactgtcccagtttttcagacccatcgcctctaaatcctctctgctaaatgtattttctaatgtgctttggattagaaaatcaaataaataagaactgtagagacaatactgcttgaatgcagggtttggtagaagatttgggggaaactcatttggacacttgaaggtcttcagttacttctttgctcagggttgtaactcagagatctgaactaccagaaagtggattttgaggtattattgtgtaacacagagtgaaacatttatgcacttttattgcaaggcttcttattttaaacagggttgtccagaaatccattcttgattactttacttgataggtctctgatccattatatttcactcccttgatttcctccagcaatgtaactaacataatgacaattgggaagtaaagaaatagcacatttttaggataaggtgagagagtcttggtaactgacttcatcatagtgatggaggcaaaaatatacagtcaagttagaaaacttccctggactgctaatgggaactctggcctgactagacactgggaaaacattaaaaactgtgaagttatttacattaattttcagtgttcagagaagtaacatctgatcatcttttttcctcttctccaaaaggagaagtcagaataattcgcaatctgtgataggatagggattgtatcgaaatttgcctttttattacctctgaaaataggatttctaagcaaactaataaccttaaaactgttgggaggaaggatgggggaaaccaaatgtaacctatatgaggggggggaaacatctttaactactttaacatacacacatctgataagttactgaaaattcttatttattttgaagttagtgctgaagaaactctatctgttaaaacttagaaatctcagttcaaagtacatggaaatattccatgatcacgttttcagctcattctagtcgtctgtctcccagtttatttgaactgatgaaattttacaaaataaacttctttagctttctagagttacgtttttacccatgtaatctatttgttaatttttgtagcatgcttatatgataaaaaatactatgtaagtactgagtttgcttgttatggattatttctggatacagagaatttgcaagaaacttcagtttacagcagccaaggttactgcagactaaagcagaagttcaggcataaacttgtcttctaccagttttccacaactttgctgttgacagcatctgaggacatggttgatgagttctgaaaatcattcacaacattgctaatgtttaggaatcttatagctttgccggacctttccataatcacgagagaaaacctttgacgaaattagaacaagtcctcataccctcccttcctttcttctagtgatttttttttttgtattggaacaatcgaaagattcaatgtttttaaattccatagaagactaacgattgaataattttctcacatctctgtttgcactttcgcagtctggttgcattgatttgtgtctcacaagtagacatttcctttgttggtcacaaatcaatgctacagaacaaacctgccagcacattccacccccacccccaattttttgcagtttaaaaacaaagcacatttatatactttttcttttaaaaattactttcattggttagtaatacactaaaagaagacaaagcctcagagttaaaaatccccgggagaaggagctcctctctagctggtctctgattctctcacactgcctggagcaaagaactgcctagtgggagagcagcgctcgtccgccgtccgctcctggtgtgctctgttaacccaattaaggtcctcgccttcatacatcacaaagctgcccaaagcaacacactgtgatgtcacagtcagatatgatttcatggcaggaaaaaaccaaaaaggcagaaaaggttgaacgtactctgcttttattcaaatcttctaagagggggaaaaagggaagacttttttttttttttttttttttttttttctgagagaaaaagagcacaagctttctgacgtgaatgtgaaaactccgttctgaagataccctggtgcttttaccccaagtggataagcatgaataaagaagcacaaagaaacactgtcatcaatcagaatgctcttgcctacacttagctacaggtggaaagcaagcaggcacgatttgatttacctagattaaaagagcaattttctatcttccttttttccttttaaaaatagccaatcgattttggcctagctattgctgactgtacaggtccattttaatacaccactgattaaacggtatgttcatggctgaaggcactacagcaggaacaaacagaagcagctgaaggaagggggtgggggacaggcgagagctccaaaaaacactccacgaaggccacaactactcggcacttcccccgtagacagttgatatagcacattttaggcttgaaccagctataattctgggagtttgaagcctggaattcatttagctttttaattctgaccttaagaataaaaaaaaatcaaagctatgttttttaaaaaacacaaatgagggaaatattgtgtcctaaactgcaatgacatctgaaatgaagatgtgcctcagaaagatgcttcttatgaaacacttgaaatttcataagttatagaattatctactgaaagaggacctagttgtttagagactttgtttagtgaaattgcatgtaaaagaaacagaaagaaaataggacttttatatagggtgactatatgttgggattcatcaggcagctctcagaagagggagaatatctctactagttctagaaaataaccatcttgattatcatgagaaagtatagcctttatcgaagtctgggtggcaggaaaaataaattagggagggaccttctcaggcaactcagagagagacccaacatccagcagatgtttcttctgagaaagacaaggtccatctaacaggtgagacatcagctgaacaatggatgccaggacatgggaagtggctctgagaatcagcgaactccatgtttaaaaagtcaacccactttttttttttctgtttgcttactgattccttgttcccttctctcctgttttctctctccaattatcatttacttaatttgaaattctggccttaatggggacagaaccgtatccagaggtactattaagataagaaaattcaggaagaaagatttaatgaggggcttaggagtttttggaagaggaaaaggacattagagagaaacgagggaaaaactaagaaattaaatatcagcctcagcacggtggctgtagaagaatagcttctgagagacacagatggtctgcattctccagaacaaaaacaaacaggaagtaacagggccagagccccctctccccttcattcctctctccagtgtaaattggaaaaaaactgaaatgtgttcacatcaaaaagttttccttcaaactctagcaagtgaccacagtaaaagaaacaagagagcgctggttccagcaggtaaaatgctgaaaggatgtcacatcgtgggggtgaggaagaaatcagggattaaatacatacagtttggagaaaaatcaggctctatagctaactaatgatgaatggagcagacaggtggcagatttgaggtccggaggagaggaagggctccattttgagccgcccattttctggaggagaggtggtggccgctgtggaaaatggctactcctggggtgcatagggagacaactgacttagtggagggaagggaagaaataaactagggagtcatccagggacacatcgagttagtgagggttttagtttggatgataacaagctcttaaaacatggctttgactcataaaaaatgtagctgggatggatggctacttacagggttaaaagcaaactgagagctcttctattcccaaatctgaatgctgaagtgctgcctagaacagcaaacatgtacatgcaaaatatcaaaaatacacaaagtgggggtgcagaggaggtgcaggatgcaccagtcacctccttccccacacccttcaacagcacagagctctggcagggtcatcaccagtaaaactggattcttacaagccattccacagagagaaaccatcccaggtcccccatggctccaggcatcagtgaggacagttttcatgttccaaaactaattggacagtaaggagtgtctgtaagaataaaagcgggtgggaatggaggatggaaataaaagggaaaaaaagtgtccttgttgaaagttttaaattacaggctcagtaaaaaactggcattccaccacatccggtctagttaccaaatggaaaaatagggtcattaacatgtttatttgaattacattagtccttctctttcatatttaatttattctgttagaaaaaaacacaacgctctgcatgctggtgaaaggcaggggtgtaatggatcagggagctgaaatacaatgatctttacccattatctaccctgctaaggcttttcagaacttactaggatcattcagggattcttccctcacaagggagggaagggtacagaaagatgtaaggtacagatgctactgagtttgttaaaataatattgaagcacatttaaattaaggagtggaaggacgattttaatatggaaagtttacaaaaagaagaaaagtttgggataaatgacctcttctgagactgaatgtccagatgcaaggttggtgctaggcttacggaacatctccacatgatatggaagttgtagaacattgtgttattagtattcggggtattaaaaggcgaagtctgcaggatgatctcatgaggcttgctgtcatccacaagaggtcagggcaacttcagtacaagcaagtataatgcagtacattcaggggaaaatgaaacaaggtatattttcaggaagatgtccagaaatgacctggctatctttgtggcggtgacatggaaaggacatagacttagtatcataaggccagtccctgctctacaacttactaacaccatttgcacaagtaattcaatcagttttcctcatccataaaatgggaacatgaacagttaccatagagttgtgaggatcaactgagacaatctatgtgaaagtgttctataaagcactgtacaaatgtaagacatttattttctgaagacagtggtgccaagtgtgagccaagcagtgtgccaaatatcctcagaaataggattggaaacaaagcagggaatgctctgacaaagctgaagaggacaaggatctcccatctcagtgtgactgggtgtatcgctcactcaaacctgaagggatttctcaccgggatgctgaccttgggttcatagactaactccacagtaggttgccacccactcataatgagtcatttaaagttcaaatcttacttcatgctagcgatgctagcacagaggcaagcagttttaggctttttttggtcacagatttctgctgccattgtcaaaacagtagccccaacctctaactgcaacctagggcagccagcccaacctagacttgattctggtcacttttagtggaacaaattggctcagaaaacatcgccttctacttcttctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttcaaaaaataaataaataaaaagaataggagaacgttcagtattaattaaaataatcatgacataagatgaagatttctatttataatgataaaatccaggcaaggatatggtaaatgtctataaagaaacaaaaggtctgggaaactgactatggatttctttttcaaattctagtatacgtgaactggaagtcatcttactacttttcaaaagaaacaatttatgacaaactaaagaactactttacacagtaggcaatcaacttataaaattcattaaaggtcgatgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaatggcagatttgggatttgaatttaggattatctacttctgaagctctgctaccacactgctgctgttttctgcccagtagcctgatgtattaacagcttaagatgactaatttaacctgttaaagcgatatgaagtcttgctcttcatttgccttgatatctaaactgtgtgtgcagtagcttcttgtcatcaaatcatgtgctcatctatggctttacattaaagatgtctccagctctcattaagagggaacaaaagaagcaaacagatcacgaggaggtaaaaggcatgctgctatggattattatagagtacctcagactataatgtatattaacagaaactcttctctatcaactaatctaaagactcattcttagttttcctaatctaaactcaggtactacaatagaagtaatatccaagaagtgaatgaatatgatgaattccaacaacctccttgctttggtgactctaatgttgaatgggatatcaaaatggaagatgagaaacacaagaaatagctgggttgggggagaagcacgatgaggagaagaaacattagagaagaatccggagtttactttcccagactctaatttaatctgaatgagctttgtttctccacattttgaagaaaatttaagtttagtaataggagattgtgtaatgcaagagtgttgctagcctaaaggctgtgataacatatcttaggagctctgtgtccctcataacaaaagtaacaaacctttcaaaattatttgtggccttgaaatataatacaaaatacctgtatcttaatttctatccttgtaaaatgggaaaagttatttttatatgaaacaacgaatacataaaatactatatatttatataaaatatataaaatataattataaaatatataaaatataaaatgctatatgatagtatataaaatactatatattttatataaaattattatatatgtttacatgtgaataggagctatttgtgagttttattaaaagtctaggtaaaagtaaagtcatctatactcctttctctggggttctcttccctttccttttgtatatttttgctcccctttctctgccgcccccccgcacccacccaggattttaaccacagatgtaatgggtttctgtaacactggcaactcatagctttcacaaatgttcccttggctagggaccacccaaatagtgaccaaatagtgactctcactggctaatgaaaaatcaatgtggtttgatatcattaggacaaggtcaaaataatcctctaagcagaatttccttacattccctcaacaccaatgtgacaatctcgctgcaaacaaggcatagggatgtggcactgctgaacctggtaaagctatgtcattgttaactgaactaaaggaactatcagtgccaaagaagaaagagagtaagagaaaaatgtcagaaatgactgtctagattcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaatttagggttaaatggagtggggccaagagagagcacggggcttgatactaatgcatctgaactcctgggcgaaataacttaaaacgtgggtctcactgacattgagtcagtggtatcaccatatagtagttgtgctacaagaacaatcttactattcagactctttgaatcacctgaaagtgttcttgccagtagcctcttcccaaaagagataaccaatcctgagagaattccctgattttaagattgcataaatagctcatcaaatccctacaacattcagttgggatatgaaaattacagatatttttttcctcttcacttttcacatggaaaaacagaagtctgcttccattgcagtcaccccatctcctacaggggtgggaaatgacttagccagtattacagattgagccactacctctttgtaaatactatagttgagcatagaatttgcccacgtatggtacacccagggatttaggtggcaatcacatgccagaattttgctttagataatgagaatcaagtcataaaagaacttgtgaaaataaaaattgagacacttaataatatcaaccacctgatcattgtggtcagacatatgataatttcaattccttagcaatacttaaaaaaaaaaaaaaaaacaactaactaaatagagggattagaacctggaagataaagaatcaaacattagaacaagtaaccttggatcataaatattctctgacattttcaatttgcttgcaacatacagggttttgttttgttttggttttgcttccatgagtgtattgtatcccccactttctccccttctagaagctggctaagtatagacgcagacggtgaaactcaatcgcagagtgctgacagagcttctcttagggtctacagaacagatctactgagtctcacatctcttggtcagcagcgacaggtaaacactagctttattttagcagctcagctgcagctccatgggcagctgtccttactgcacataatcagtccctcttttcagggggttataactcaactatcaaaataccaaaatatgctccggtttgaaacttggtgtatagagtcccaagcccaggaatgaatgtggtttacttccaaatttaagaaaatattgagttttgtaggtcatttatttactattttcaaatatgtttgaagaatcttttaaatgccataggaaaatgtactaaaaaggacacaccattttaatacctttggtgattcattctgaatttcagcacaccactgaaagaaccaaatggtggtggaaaaaaagagtttgttttattttcttaccaaatacagatgttttgaccacttgggtcctcatcagtgttcaaaatattagtgtgttgtaacataataaaataaaggcgttaacttctttgttttgttcttttcagtgatgtgcagaatggattaacgagttcttgtttctggccctcgtataactcaaaaactcgtttcaacttaaataaattaagtaagtaattagttcataatatggcctaatcacctctggtattttgaaacaaacaaaaacacaaaaatggctgttgcacatttgcacttaattacttccacagaaaacactcatgtggactttattacaggtgacataaatttcaaatctaagctttgtttgtgatagaaacctgggttatggtattgtgtagacttccacgaagattctgtaaccgtccctactattttccttaagaaaatgaaaccacagtctatgaaaccacattcttgcgctcttaattggcaaaagaaagtgctttatttcaaaaactctggagaatagtttacttcctacagaggctcaaaggacgttaatataaaaggtagtatcatttctggaatttctgcagtgttcaatttttgctcttggagtctgaacagttcttgtttgcatacacgtctatctgggaattgctcttagtgatcaggacagccttatggaaatccttccagatgaatatactcaatagagcaaaaaatcttgctctgtctttaatgtaaaggaaaaaaggacttttaaacaagtgtgtaattgtgagttctagccttaaaggaactttcttggcttggatttcttctaccctccccttcagatacttaataatcaaagtatatgccaagaaactaatgatgcaaaccagagtattgcacatgaacttggatcgctttcccattgtgtagtgtgtgtagtgaccaagattggacccaaaaagtcgatgatagaaaatagacaatgcaacataatcaaggtacgcccaccttgggtaaattcactaacccatttcctatccttcataaatgcatataatgattctcagtatagattctgaaacttctaggctaatctggccatcagctgtgaaaggaagaaggatcaaccttgattagtaaacttccaggtcatttgcttggcatgaacccactgatgtgttagctgcatacctcacaattctttaggtgttatctgatgttaccaagcattcctgatgccctttgaatttcaatacagaaatctaagtacaactaaacatttccccaagctgtgacagccttatggctattactcattttagaactgagaccaacttttcttctgacatttgacctgggagagtttcttctttagctttctgagtcatgcaaatttattcaaattctgtattgcaacccttgtcagttgtggccatacattcacttagtgatatcttacacacaataggctctcaataaacatttgctttccagaatgaaactagccttatcataagaaaaaatggaatagatttcaatagagttataaatgaactagaagaaagactaatagatcttgagtatattaaaaaaaaaaaaatcaagcagtgagaacagttgggttttgatacagtttcccaagggaagtagtagaagtttcattactcagggcattttaaagtagaatagacaaaacactagtggggtatgttgaaataaaatatgcgtagtccgtctgtgaattagtgtttactttcaatataattataagtgaagcaacactgtaatgggaatttttcatacacaggaaagctatggctactatgtttccacatcgaccatatgttgcacatattggttgctgtggatgtgtatccctactgccctctagtggatgaaatgtaagacctacctgattaaccagatctaacaagctactggtttgggggtatatcaatctttaatcatttagggtagaaagaaaatagctgtgttgatgcattttccatcaaattataaaattgaagggcattaaaaacaacagaatcaaactctgtaattaagactgccatttaatgtttgttcgcacacggtattcatttctgtgtatccctgccaaagatccattgtgtaatgttgtcctcacatgacattaaaaacaccagttccctggaaaatacaaaaaagaaaccgtgctgccttgaaatacacggagttcactttcagaaacataaaattaatacagacacagtaacataatttggaacacaaataatggctacaagaaacttgaaaaccaggactgctccttaactctgagcaagcgtattagcagtctatgggtgtgctggctggtagtcagaagagggcaagcaaaatgggtttcagaacagggaagctgatttgagaaaggactgactaaacacatagtaatagggcaggaaaataactctaaacacacatttggtactgtgggtatatatttaatgctgtcacattgaggctgcttttcaagtgtagcacccagatgctgtactcccaatgaagaaagatagggacctgtacagttctttggcattttgtcattaagacacaggacaaatctgaaggccatcctctttgtataattttaattattttacaggatttagactttaatcactaagttttagtctcacacttagcatataaaataattctcctaaaacaccaagaggaaacaattatacaatctacgttgccaaaacaactgacataccaaagagaataaatgaaatccgaaagaagagaaacataccgtgtgcatgctgagtgcaccagggcaatggcccttattatgaatgtgggaaataaattggctaaatctttaaatatcataaattgttcgaagctggtgatatgtgagtagatgtacacttgaggggaggggaactgggtgggcatggcccagatcgctctctgagttagtgacagtttttacagtacataatttggtaaaaaagtattggtttagtaatgaaaggtaggtcccaatggacttctccttgtaaacttaaaaagagcaacagacttatctagatagagctacaaagcaacatgaaaactctcattacctgagtgatctagaagaaaatctaacttgataaatatcctggaagcattgttttcatctcaactagatttactgtatagcaattagcatctctatagatagatatggggaagcccaggagagctgggggtaagcagtatgggccaaaaggaggaaatacagccaatttcctacttagcaccacggacagagctgtcagcagaaagaaacatccttggagttatccttggtgttaaagaaacacaaagaaatcagtgttgcattttaaagatgcttcttatccccattgcgactggcagtctgggttggaattatgttccagtgcttccctgtagggcacccattggagctgaacgaataaaaaggtgtcttgcccgcctgtgcacatacaggaaggaaaggttgatacaggagaatgatgtctccttgacttttgtctgactcttctctggtttttgaaaaatcatagcactctgaagaatactatccagtctttcccatgtcaagacaagtccctgtgcatttcagccttagggtctctagggcacagggattgctctggggcacaactagggaaagggaataagtaaagacaactctaaaaggaagtaaaatgccttctattccatctcatgttatagaagattacaaataagaccctcttcttcctctcagttctggcctttatgaggtggaagtcactattagactctataactgaataacagattctggaaaattagaactatctctcttgcacttgagaagtcagtgggtctccttttctgtcctgctgaagccagatacagacaaatctagagaaccagttttatgaaagaaagtagcctagcacaaattatttggcattaaaccataccatcatttgctaaagacttggagtcaaagcttttctcatttgattgttaataagaagcttatatttctaaaatatcttgattaccagggaacttgtgggttttggctttaatcaattcttagggcttttcctatcttttgtttcttagacctttatgtccacaggatagtctagagagttgaaatttactttttgccagctcactatgcatgttcaccaaatggtaaagttctcactttaaagcccagcaagacaagatgagctctgtctgcccagcagcctttcagaggcattaagggtaagagagaaggtaagtaattcactatgcgtccccatttctataatggggaaggacgtcttgatacatttacaatactcctctggggatatttcatcagttatacctaaactctaatggacaataattgatttgaactttccacttagcacagagctgtaaacagcttcactgcagacggcagcaatgagccgacgttttgtaaagtggagagagattcagaaaacttttgtactgggtcatgccgtagcctaacagcttttgaatccagggaagaaacagtttgtcctcctggttttaatagctgggctaatcgagtttcaagcctgcagtaggtataggttatcttttgaaggcattccattttaacccctcactattatgatgggtttataacctagccataaaaatgtactcctgatttagacatacatcaggacacattcaaaaacataactttctgaatgttaatttcctggtgaaggaaaaaataagacattaaagtcattttaagactacagattttttttttttttaactctgcgtgggtggtgagcctttcagggaaaatattccctctcctccagtgtccctcatctggttgacaccaccctgtctctccctctcactcaacatcactttgtttcgggctgtatcttagtgcaatctcccatggaatggccccaaagactaatctgctacaaggcatgaaacaagcacaagtatagctctgttccatgactttcttttatagcctccctccagccccgttgaacacacaagtagatgaagtttagaagaattctttcactatttaaatcagctcttctgtctcactacggcatgatagagggtaaaatgaagagaaatgaaagactaactacattttacttagaccactacatcgtctgctcagtctatagctttcctattttgttccacactcctggaattctcacaatgggattcaaagctcacctagaagccactcttagacaacaaaggacacagtcccctttggagttgttgctgccacttctcttgtgtcaaagatctacaaaccttgtggctgtgaagtaggactttatgaacacacagcaagaaagtatattttgtgaatatactgcaaccggacgttacccgccttacatgaatttgacatggaatatgaattttccctcaattcagctgataagattgtaagagcaaaggcataccactgtcagaaaatagatttaccctgcacccccaattgtaattccctttctagaaatctacagaaaaaataggatataatcagacattttgtaagatgttgtccagattctgaaatgcattaaaatcaaactgaacataacttgttccacttggtcctgaaaattacattctgtagcttctagacatcaaacttagttctggttttgatgtaaccgctgattatttaggtaacactaagcaaggtactgaaccttacagagcctcaatttttccatttctcatttggggagaatgacacctgtgtgttcttatttattgatggatgagatgaaattatatcataagctactgaaaaaaatggtgttatatatattttgggtcagtcacctttacctttacagcagcatgaccaatgattggcaaagtagtcaaagtctacttcacccctcctgggtagaaggcaacatggaaagggtattttccatcatttggcagtaagggcctagctctacccatgttcttccccaggcaagcccttttctcccataatcaaagggcaacattttaatatttaatctttaaatcaaatatggcattctcaaatttgatttaaccaatgtctaaacttcactgagctttcagttgagccactaactccctctttcactgtcaagcttccatggaacactctttaaccacaaaattttgtacaatggtacctagtgagctcaaatgactttctcactgatcaacaattattagtctgtaaggagtttatactacagaacatcactctggtgtgtcaggctcagctctcatagacttaactaagcataaaatgtgctttacaaataaaatgcttataaaagttaacaaagaagttaacaaaagttaacaaagaagtggatgacttacattcaccctgtgttttataccttggaattcaaagttccatacttaatggaaatggggaaagcttagcaagggttcagagcaaaggccaaagaaccttccttccttgtttgcccaaaatattaaagagataatttgataatggtcattagtaagatgatgtgttaatagatgttccttacctataactcagattaaacatttaaaaagggggtttatgaagtatgagggattgagttgagttataaaattattacatacttcaggagatgttaaatcctcatatgaaatactctgatgttccagtgtaagttttatgaaatacatttgatccctatttatctgtgacaatttagttaacatgctactagagggcaggacaggtgaaccagaagagttctaggctttggcatctcataaaagttaaaaatgatctgtagagcttatcttgaaatactctttcataaaatgtatgtgtatgattcaatgactgagccatcccacatgctaagttgactacggtcatagggaaccaacctcatgtgaactgtttgatcccattattgaccagtctttatcaatgcttggcagaggtcaaggaagtaaatctaacacctataaaacaaataagcgatttccttgtttgcttttgaaaatgccacttactgattttatttttctttacagttgttagcagctgtacacggtcatattataattgtcacataacaaccttaattcagggacacatcttttgaaacaatgtattattcagcaactttgggtaaacatgcaatttaggagtggaaaagatgcacacagacacaagtaatcatagatacaaagcatggtgaatttctgtgccatgcacttcacaccccaactcatctcgcagggaaactagagaaggggcagaaccatttctattatgataattcacaaagggaggccatatagatatgcatgcaaagtctctccccacctctccatttacatgccaggatttcaactctgcgacactgagtcccttcatttagccaattagtccttccagcttcatgtaatgcacgccaaaaagaaggagaaatagaagtgctgacgttcactgctttgaaagttgctattctaatgccaaagctgcctcttgagcaatttccagaatgtattaacatgggagcaaagcgctattcctaaagacagggatcacattatgcaggggagccccgtttaacgtgtcacaattgcacagaacctccatcccctgcacgatcttacagttgtagtttgcatgggctcaagtttacggtctttacttaggtgaaacttaggaggtcttcctaaagaaaagaagcaatttaaaaatatctagtaagcaaggcatggcacatcttttgtaccatggcattgaccaagtccttttactgtcattctgaagaaagctggtcaaggtgtaaagcaaaccggcctctcagtttaggacagagtgaaggattcttcagtttctttctttctttctttttttaaatcaattaagtctaggttcaattttaattattttaatttggcagacatccctagaattttccctccatattaaggaccaagttgaaaaccattacataattgtgtagctgtgtatctgaatgccctcttatgcacgtgattctgatacttagtaggcaacaaggtgtcgctctgaaatttgaaaaaccattaattcttcagctgaccaccctgtttacagctgaagcagtgatagagattttaatatcgccttctcccttactcttggcaatggatttacaaaagccagtttgtgtcagcctggccctctacaaatttagctgttctttgcttaaatcatgacatttgcaagagatgactggacaagtcccccactgaggcagcatagcagaggtgaaggggcacttgaagtcctatttcttctacacgttgtctctgcttacttcgaccacatctgtcttctaggtctccttttcccaatacacaaaatttgaatactgactgagacgatcctgcagggttccttctagcccttttttgcttttttaccctaaaacgctcaaaatgatttctttctatgtctttggcttctataatttataatcttggctcaatcttctcccttcatttatttcctcaatattaccttttgtaactcttaaatatgctgtccctcaaagaactatcttaaggccatagttttttcttcttatactcatgcatctgaagggctgatgcactcatccatcttttctcataatctacctcttttagttagggttaactaagttagttaacttagataacactttctcttcagaatatctctacttagatggctgctagcccctcaaaacccaaataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaaaaaaaaaaaaaaaaattgcctcctcactccaaacatattctcaatggtttgactgtcacagttccctctttagtcctccagtggctttctaccctacttcagatcaattgtgaattatagactcccagcactgaaagccccctccctgtaggtctgcttgtctaacctgtcagcatccggtgccactaaggcccaccttaatccacacagcaagtcgcttttgtcttctggcttccttccgctgagaatacaccctctccatctctgaactttttccacataagcctgcatctacggaataatccctcatgcactgaagaacatctttccttcattcagatgataacttaaacctcacttatgccagagagatttccaagatgattaccagccaactgttaaccctctaaaacaaggtaagaaccactccacccacctttccacacatttcagaaaaaaattatatttttaattgtgtattgtagttgtttataaattattttgatggcagcaaaatatggtatttaatacagtttatttattgccttgcaacttttaagtcttgatttcaaattggtataaaaaacaaaaatgaaaaaagtcccattttgttactttaatatatataaagccatttaagtctcatgctttttgagatctgtcaaccgctatgcacatgataggtatcactaaacacacacttgttgaattgaattgaggaggaaccatcttaaacagtttactcacagaggaggaaggaatcagaagactatgaacataaatattccatagcagcatctgagtgtaacaagaaataataccaaaatgagagtttcccaaatttctctcaccctcttgattgtttaatattatattcataaaactatatttttaaaaacagctttgattttaaaacgttaaatttacacaccaagaagtagacactagcaaagtctcatagtctgatttatttctctgtaatatatctgtcttgagaacatcagcaggaatacaccaaagaaatatgtccctcacgggatcaactatataaaaagacagaacacatcatcagcacaaaaatcattatccatctaatttctcccattctagatggctccagtgagcccctcgatcattactgactagggttaagatagagcttaatggattaattaagccaaagcaggactgcaatgcagaccgaagaggagaaggtcctgacacagatgagacaacaactctgttcctcttttattcaaatgtgcaagacttgcccacccccaagtactacacatttatactgtaaatagtctccaaaaataagatttggtgtctgctgtctgggtcttcccctcagcactcaccaacatctaatacttgggtgttaatcaaaatgtatcgtgtaataagaaattaaatgttaagactttctttttcttcagaaacgtggagaatgattgttaacagaggtaaagcagtagaggcagagcactcgttttggcaatcaaggagcaccaactaagggagaggttattgtttgaatgtcaatgtgactctgagagagggccagggacacagaatattcacaaagagctgaaaggaagaagtgcccacagccataaagtcacggggactggggggcatgcccaaaggcatctgtcgtaatagaaaccttgagatttgttcatttaaaggggattttgaaattcaaatgtaaaaagagaacaagataatccaaagggcacaatttggggcctttttcttcttgtaaaaagaagagaaaatagagagaatcccccataccccccaacaaagtactgtaccatagtggcagtttactctcacttttacgaaccaaatcaacatattaatgacttaaaaaccacgttcacaatggggacaatcagactctatcagacacaacattaaatacgcaggtattaaaagaaaaaaatgcaaactaccaagaaatacctcactccggaaatggtaaggctgacgaaagcagactatgtcattaataccaagcacaccagaaaggcatctatggagctagactgggagggacaggcctcatttgcaccaaagaggaagtgccctgaaggggcccagaagtggggaactgggtagattttagtctttttctttttttggtaggtggggggaatgacagaaacctggcaggctcctgtggaggtctggctgcccccaccatgttgagtcccagtgtctaagtaagtaaagaaatgaaaagacacctatctcaatggttgtcctgaaacagttttaaaagcaagtacaagtccccagcccctagtagaatacaaataatttcatttgtgattcttgcatcaaggaaaaaacttgtgctaagttcaaacaataggatacctctcaaaaagatatgacttctcactagagagaaagaatcaaattctggagtgggaagtgttttttaccttagtgatcttttagtcattttgtaaatgaggaaactgaggacttgccaatggtcacagaagttaattctgtagttggcaattctagcagtaatgaatttacagatagatttggggctatgaggaatccagtggaattgggtccttcaaggccttttatttaaacaattatacatatatatacaaaaaaagatacagggggagagatctatagatatagataagtctgtataaaatatattgctgggtagtaaaaagaggaccggtgttgtagcattttcactaccatggtcaagaagccacggactagattcatttgttcagtgaacaaacagttactgaactctgtgtgcaagtattataaaagtaaaaaagtacgattagacatagtttgtgctgtttcaaaaagagttaacagtatagttgttttatatctacaatacaacctcttaaataatcaagtagtcaaactaattcctattggattaatacaaatcataatcattaattttgaatcttgagagaaggcataaactctgcattatattttagttagacactggaaataatctggaatgtttctggtaccccacatctaaagattggatttcagctattcggtgcatttggatgtttttttccctttagaatccatcctaaattcaatgccctaactcggtagctcagaaacagagctctctaggcattgctgctctccttctgcccagtctctgagagggtattgaggttgaggatggggatgaaactaagaataaggcagagaacgttgctaagtcatgcttctttcagatctaacacatttgtagtcagacctctggccctccgtatccatgggttctatatccgcaaatggaaaatatttggaaaaaaaaaacctccaataaaaaataatgataccacaatgaaaaataacacaaacaaagaaacagtgcagtataacagctatttacatagaccttacattgcattaggtattataagtaatttagagatgatttaaagtacacggaaggatgtgcatgggttatatgcaaatactatcccattttatattagggacttgagcatttgttgatttcggtatctgtgtggtgggctggggtgggatggggtgtcctggaaccagtgccctgctgattggatatcaagggatgactgtacttaatctccaagtcatttcccttacagttatattttagtatatggcaaagcacaatgatttcctttgagatgaacaaaaattgagtagctaaaacctaatgaatacaattagtttaagtaatctggttatggagaaaaatcactagtagtaaagaagtgatcatattacccaagcatttctcttaaaaagaagaaaggagaaagataacatgtgagtgcctactacatttcagtactatgctaggttctttacacaaattagctcatttaattctcataaacatctcccagagcagagattgtttccatttcttctggtaaagaaactgaggcacagcaagattgtgttttgagcagacatacaaagctagaaagtaatttatggcactcatatttggatccaagtttgtccatctacaaagcctataagcctgctaagggagaaacccaaaaatgaaacaacaatgaatgccactggcagtctttttattggatatctactatatgatgctaagttatgtgcccaattaattcgaatataaacacacattttctgccaccttgatgtttaaatatatgagcatgagcaaactaacatttggatccaccatagaatattgatgtagaaaattcaaatcactcatgtatttttttaattttagaagacaatttacctgatgttgcaaagttatcatgcaaaaattaatgctaaaaacataaaaaataccctataaactctttcagtgccagggaacatcatgcactgctcctacaaaaacctggcacagtgaattccctgttaactgccagtagatagggttttatccttaaaaatatttaaaggtgagcacatagtctgcttcatttttactccagggttggcattctcactgcctctacttaccttgttttctgtaaagtgtggaaaggaaaacaagtgaatttttctctcatatatgaaggcctagatgtggggaaaggttgtttaaatgaaaacatggagtttctcctcgtgctaagctggggcatttggagagtcccctcctccctgtgcccctccatccacacaaacatacaccccagttcacgttctagtttcacgcgggataggaaaagaaaacgaaaaacagaaaaagcaggaaaaagtacagaagaagaaggaggaaggataggaagagggtctaaggaagtagtgtagtcttccagagtgctccagaaagtgaaacgatgaaaagggtgagcctcaagagcaaggcacctcccagctctccatggatgaagagtctctatcagctccagaactaaaaccctcagtaggcaggatggtgctaaaagaagaaaaactctggaagggggtcagagacggatattgcagagctttctagccccttctacattacgtataaaaacgattattcaagaaataatgtaattttccagagcatgttcaaatgcaagaaaaaggtgcattctaagattaaatgtactacgacagctaatgattcattatgttaaagttatttattatttacaattattttctatttatgacattgtagtctttcattgacacttgataatcaagagttgacaaaataccatttgaactgctttgctaaagaacaaaaaaagagggattaaggtagacaggaagtgcgtccaccaacaataaaaaggacacatgactcataccccaatattaatgacaaaaatatctacagtgagatcctaaagttctgggtatttgtctaatttttccacaatcagaaccaaaggtaaaaacagcattgacagctactgcagtttggtctgtttaacagaccaaatgctgggatttcaaagattcatggctgggattccaaagatttgtccatgttggaaacagcattcacagtagcttttcggtcaagtggcacaaaggagtgaaaaggtagaaaaggaaacattagcaccaaaaatctctagtcatcttttaccaccttaacatgggttagctgaaggccatggagaataacggatgtgcagttgtctctttcttatacagacagcagagagaggggggaaaaccacacacttatattttgctaatgtaaaagtcccagtggaaacattagcactcaaagacattaatgtggatttgggacactccctgaaggattttgattccattagaaaaaaaaaaaaagacagtgacagatataatcctgctttgatatgtttaatgccatttaaagagaaactgtacccatttacctcaggccaggacaccaagagttcaaaaagtgaaataccatttctcagtgcaaagaaaaagcttggaaaatattatgtgaaaattaatttggcatgcttctttgaaattttagatttctgggatgagcaaatgggtacagttttcttttaactgtttttgaacaccatgtgttgagaagaaaacaacagaatggcaattgctcatccaaaatgctaacttgtggcatggcacagtcaagatggcctgccacagccaaaaagcaggtgtgtgctatgcctctcacttcagtagcatgcacgccacatgtccctgcattcggcaacctcttgcatttgcttttggaacctttctgagggggacagtaaacatgactcaacagaatgtctagctgaggagggactggctctctgagcctgctgtgagacagactttttgaggaagaaccaaaggaaaactggaataatgtatttattttggaattctttggtatcacttcctgtgacctaacaccaagacgactggttccagatcattttgtgtggatgaaatttagcatctaatcaggtcggagagtaatggtgaagcttttgtgtgactggagaggacacattaaatcagctacctcatttggactgaggtcaaggttaatgtagctggtacagatcatacgaacctaacctaaaagcttagagtaataaactcctcacccctcaggtccatggataagcttgaaacagggtgtacaaaaccatttggtgtgctgggatgccaaagcttcttcaatctgacattatgaatctgttattatgttactctaggaattaaaatagttttacgtagatataggtccttttcaactatacaacagtcctatgagggagacgaggaaacagaaaaaaaagattttccttctgccctgtaagaagcctgataaagaggccaagttaaaagtcatgaccacgtctaagctcaagtcaggaaccacttggaatgaaatcccaggatatctgtgctgtaggaatagacaaggtctgaagataaagaagtagatgaaaatcaaaattactattttagaagacaggagtgggacacctctactttattctatacttttaataaatacatcaataataatttattaaaaacctactatgtgcaaatgtcaagagtggggaagaatgaaacctataagtaataaactggaaagaaaaaacatccttaagcttttctgatgtaactgagtgatgttctctgcttctgagtagaaatttatggattcagaaaaggtaatttctttccaaacactcacatgccattgttaatttcactcattcaaatcacaacatttactactataccttttatttctgatggcacattctaggtgttgagggggatacaactgtgtgtaagtacagtctctgtatttattaagcttactgtgcagtggcaggaggaatgagacatataaacatgctctagtataagacagtatgtaatcagtgccacaggagacatacaaataagtgctttagcagttcggaagaagcaagtcctcctggctatagaaccacccctccatagacatactgaaatgactcaatgcacagaaaggaaggatctgtacaactttaagtcaacttacaattgatgtgcattaggggattggagggttagctaggctgtgaggggagggatgtgctcactgtgtccacagctcctctcacactgggtcaccccataattaatgtttatcaaaaacatgcatggataaaagtggaagtcaattgaatgatagaccaggtcaatgggtctgtgttagttctagatattttagatgattattaacaccctgctagaagttggcattataagaacatcattttcttcccacactagtgtaaaaagttcagttttttacccattccagagtgatgggaagtaaaattcagggcttcagtcttccaaatgagggaaatacttggcctgtgcaaaatgctctcggtaggggtatcaaaatgtctttcaaaacagcaaaaaatacatttcctgatagcccctaaggagtatgagttggaatccatgttctctagatgtgacgatggagttcgggagaggcaggtatgctaggatccatataagatcgtatttcccatggtagtgggaaatagaatttgaatgtcctggcttctaggtctgggttcttcctacagaaacatctttttcattttgtattcctcttggacactctagtcctttacctcatgaagagtagccttctgcaattggggtgtgtgtgtgtgtgtttgtgtgtgtgtgtgtgtgtatctttctaagagagaggatagccttactgatgtgcttttgtaaaggattcaaggttgtctggatcctcaaataatgcaattgaaaaaatacggtttctttgattcaatggtgcttacatttgagcagcgttttctttttccattctcaaacacagtatttgagactatctgccaacaataaaaaggtttagagcatcaaaagtgtaggcgaaccaaatcagaattaatctctgtgaaaaccgagattcaggcgcatggaaaaagtttaggaaaaaatccaggtgggaggcaatcccatagaaaggtgtctggcatctttcctgattcaaagtgaggtgtagtaggacacatgtggaagagagatgagcggttctagctattcatatgatccattgtctcaccaatgctcacacaacttgggactgtgttatcagggggccatttgatttatcatgtagtccatgtatcctattgtatgtatgatccggagagaggttaataaagggaagtctaagcttaactgggactaaaatgaggtggcaaacagccattcactcaaacaagactcaccagattaatctgtggagtatccagcagcatttccttttattatcatatgaaaagctgtgcattttattggaaaataattaactctttaaaaaaaaaaacttgcacaccatagcagcaaaagggaggaagataacagtgatcacttctgaacacctggtacacgtttggcactgtttttctttatgcatggatttctttacatatgttatctcatttgatcttcataccaactacgaatgattgatattttgcccattttttttgtataagaatcctaaggttcagagaagttacgtaaatatcctttggtcacacagctagtagggactaagctggaattcaaattggagcagtaggacacaaagcctgtgctcctcaccatgccttgccaggccagacttcatgtgcttttcatggcatgaaatcagtgttgggggaattctgcccagcatctctggttagcagagtgaattgcttttatcatttgccaacatgtcacagaaaaaaacaaaacaacaaaaaaattaaaactcctggctctagatttcctatcaacctgaagtttggcttggttacatattatttgaatatctgacaatcttataaaaagtctaacgagaataaaaaaattcttcatttatgctagctcctatgttagctaaaaatctcctattcctacataacaatgtgcctggggaactctctcactgccagaaactcatctgaaaatgctgaaaagtcagaatttggggcctatatactgactaatgttaccagctgtgagtcagcttgaacatcagtaatatgatatttcccgctacaatttgatttggttaaaatgtgtttgaagttcacccttttattaactggaattaccacctcctgtaactggagggcctctgagaacaggctgctggtgcaatccaccttcccacccgccaacggtgcatttcctggcaacaaatactattaaattgataactacagaaataggtcaaaatgtcttttcaatagttgctaatatttctctaatgctccatagcctccctttgattcttgtgctgacatttttttttgatgagtgcaggagcaacaactgttaaagagaaatgaccagaagaaaggaaagctggctggggtggatggaggtgctcttaggagttcccgtatcagacagaaaagctagatctccctagaggcccaagggccccaaactcagctctgctgttgagtttggtgacccagaagaaaacctgtgtcccatctgagcctcaatactctcatctgtaaaaagaggagactcgagatgactgattattcaaatttgcaaaatgcccagagttcacaggaggtagaagccctgacttatcacaaaacatttgggttttaaatttgtttatagtactcttataatgttacctgttaaggccttggctatccaagatagaaacttattttcatacaaaaaaagtaatattgtgttatattttcgtaagagagaccctttgctatcatactgggttttattcactatgtaaacctatattccctccctctctttcctccaggaacaaagtttgcttttctgagttcacatcacatgtgtgattacagcaaagacagaagtttgaggctgcagtgagccatgattgtggcactatactccagcctgggtgattgagccagacttcaacccttaaaaaacaaaaaagaaaggggtggggtgggtatagtcacattgggaacatagctgattgtgagcctgcaagaagaaaagtccccttgctaaaaaaggttttccagcacttcttctgagatgcaaacataccacggaggggtcaagccattcatgccttcatgctataaccacttcaactccaagagagttatctcagtgtaaagcagttttgaactggagctggagggagggatagggataattctggaacaggggaaggtgaaggaagcaatcagattaactaacacaaggaccctaggctctgctggcagaggagaagatgaagtgggtgacaaggactgaaaagaacccagtctctattgcagtttttgcccagggccttgtctggagctggtgaaccactaaaaaaatcccttgagagatgtcatggtttatcaaaaatgcctttggctcttctgttgctccatggttgtgctgttgctcaacaggcggtcagcaaactacagcctacttggttgaggtgagagtagcttaatctcatataatttaaactcacaaagactatctctccatcagatcccttctgttttccttcctttcctagagcagggaggaaaaaatgtgtgaaagtaagggcaaagaaggaggaggaagaggtagaagaaattaacctttcctcagcttccaagtgagttaggctttgtgttaggtaagcatctctctagatccttccaacagccctgaagatattattagtaataggaagtattttatagggttgaagcagctaactagagctcaaggtggccagtcaggctccttgttacacagcactcttttctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttttgagtaagaagaataaaaggattgatctgagctgaaagcagaagggaagatgaggggaaggccacagaacacatagctagcagtggcattggtgggggtctgagagaggcagaagcccagggccagagctgagagatcagcttgtttttagcatacacggatgtgtttgatcacatgatggttgggaggtacctaggctaagataatcttaatgttaggtgctcattttaaaacatcaatttaatgactgaagcctattttaatgatccaataaaggccaaagccctcactactatgatacaactatttctccctagtattcactccttgccaaaaaaaaacaaaaaaaaccaaaaaaaaacaaaacaaaacttggctgagacagctatagagtttctgattacaaaacaagatcaccttgatcataatcatctcaaggtgcttggaggaaagaaggagagatgagttcttctgaaccacattatgtggacagaaatcttcaaagagtttaatggaggaattaacttttgaggaattgaaaaaggtatcattttcagtaagagaaaaaatgactgatactttcaattggtatgctagggaaagataaattctaggcaagaccagctctataatttgtggggctcaaggaaaaataaaaaaagtagggctccttattaaaaaattattaagaatttcaggacagcaacagaagcacatcaagccaggcatagggcccgtccaaacatgggaccttgtgcaactgcacaggttgtatacccatgaagctggccctagttttagttattgtttttaccaaggtattccagtcccagagctacccagacccaaatggaaaagcacataccacaactctcaaaactctcagttaaccctgtcttcctacggtaaggacacaactgaattctgcaacaaggatcagaaaatcctggggtctgccaacatatttgatagattgcaactgcactggcttctgcgacatttgtcacagtcactaatccgtgtttctgtcacaacctaaggatgcccaggatatcaatgtctgggaattcaaacatattttctaaaaacacaaatttatttaaaaacaacaacaaaacaagcagaagtcactaaaaagaagctgagtcccctggatgaaagtctgctcttaatctctttctggctttaccttgagtaggtcttgggtgtatgcacacaggttcagaagtgcaggtgaattaccacaataactcttttcagttagagaaaaaatagcagaaacagaagaatctggtcatagcctagcagaaactccctcatttcaccaacagtatgctttctccctttcttattatgctaagttgaagcgatgacttcactctccatggaagctaagtttctctttcctggatgcttggaatgggcctggtgaaaagctattggagggtaacatcatgtctaaaaaatgtatgtatgtatgaagaaagtagagatttaaagagctcagaccaacatcaaaagaataacagcagtccaaagtgaaatgaatgtggcctcttttccaatgaccttagggactttatatatacttagcctacttcttgagtggatagaccagtagcttggcagatgcctaggatgtctgtacaggttgaaacttaattccgtcctttctatacatctttgtcccattaaagaaaaatatctaatatagagaaccagttcactcctacagccagaattatactttgacactagaccaattgctacatccttgatttaggattttttaaaagatatctattggcaaagctaatcttttatttggcttaataggtttgtactgctgctctgcataaggccattagggtccataagtagatggaaatgtgtttgaatctctataatcatgcttagatttcaaaagtcttccatttcacagaggtgatgtaggctcagccatcattttcaagtgttttaacaaatggtaatcagcagagaaggtcttacttttttttttttaaaaagtgactgaccttcacaatggatgcacacataaaactctgattcatttattttaaaaccattctcccctgctgtaaatagatagctacgatatatacattaatatatgtgtgcacaatcagccttagcaatactgctgtgaagtagatgaggatagatggttttctatttatttgacaaatacactattacacagataggttaagcgatttgtcctgtaaggaagggtggagctgggggaaaaaaaaatcctcccacatctgctcttacatgataccactatggaattgggtatcctttattgtttttgagtgacttgatctaaataatgggtaatgtaattttcctgaaaaaaatttcactatttctctcattccctcttactttcttcttctctctgcttctcctctgagattattataaactattgataaatgtggttgctctaaatttacacttgctcttcatgggctttgatgggtttcagcttctaaagagagcataggggagaaaaaagcttatttctaaaaggttttaaaaggatagataacgctgggacagtttatttgaattaatgtcactataaagtggatactggtacgagtactgtcttggacccttctctcgcaagagctagtccaaaggctctgaagtgataccatgggaaggaagagctttttggaggcagaacctgctcatcaacactctgctattctcctgggatatcagacaaaagccagagctttctgtgcaccttcctgttgaactgctttaacttggaactattctctacattagggctgtcctctctgagtccctgaccttagatggtctttctctattttggcacatatttgcatatcagttacggtgacatatttgataaataatgggcctcactgttttttggccagtgaaaaactattttgctattattttaactctttattatctcttttgtcgattatttgtgtgactaaaaagatttcttgtctcttatcatgcttctggttactgtttctcaatgtcatctggtaaatgcttagaaaatacaattttattttgataaattctaaacaaaacataattatgaagaaaaaccaacagagacaagtatataatgaattttgaagctaaatataataaatagttctgaattttctgccactccggctcatttagaatgtaacattgctgacaaattagttattcatgctgttttttaaaaatcaggggcaaaattataagtttcaattctcctaataggagttataacccctgcagcatgaaagcacttgagtaatgtttgctatgtgaaactggcttcggtgatttctcctgaaggaaactgcactatcaaaaccttcatcaaggctgcttctgtttaagacccactgcactacgaatgtccctgtacccgtcagaaccttggctggctgtcatcccatcaagcacctcatctgcagttgccactcagacatgtaaagcgtgtgtttggggacgacgcgcggtggaatgagaagggatacagagctctgttgtaccactacatttattgtaagcaaccacttacacggcaactgctttgctcttttatattctaggcaacacaccggtgaatataattcataatgaacatattcaacattttttccatcagttcaatacattattcataaatattagagatggaaagacctggaagattacagagtccaaacctcctttttgtaactccctttcccctaactgttgatggtagctcaaaaaatccaaaccaaaaccaaaacaaaaaaaaccaccaacaaaacaaaataaaccaaacaaacaaataaaatacaaacacacaaggaaagcaacaaatttacaaattttataagtaaagtgaaaagctccaaagctcgtgtttggtgggggttgttgggggcaggatttacactgatggagctcgctgaagactaggagtatggatgactctttgctttgaagacaggccaagggagggaaatgtcagtttcccccttttagataacaattcaaggtaaagcccaagaggcaataccaagttcttggccaagtgttaactatccatctctacagcctgttgtggactcaggactcaggcactcttctcttcatttagaacttgagatattaatgctaatgataaaaagaaaatgtataaatgaatagagagtgaaaactactagagaatgctccctgggattatctgtactatcaagataggaaaactttgcagatgctactgtctctctagaggaataaatgcttgcattttaatattctcagcagctggttcctgttgaatgccatcaggatgattcagccacccaccaggaacaccagtaacagcaagtgcacacacagaaatctgcaaaactttcttctcttgatgccaacaccattactctggcaaagtcaaaatcctttattgaattatcagttctactaaatgtgaccttgttcccctcacaaataccagcttattctcaaataaatggaacttctggctgattaaaatgtaacattccttctgacttgagcacaccctgctgtcagtctctcttctgccatgttcatgtgatctacctctttttcgttttcttgctatccactgaaaccttgaaggactggcaagatccatacatactcagagtccactttgtatgttgctctgcttgctaaacccatacatttaatgttatatctctacccttacatgtctcaagttatttcatcatttccattttttagacattttctatttccacagaatgtgtttgtatgtctggaaaaacagaaatgtgtagctgaactgcatttaccattgacctcattaatacagaattaccatgccatattcaagctagataaaaatgctatacttgccctcttcttcaaatttagaccagattacacactaaagggaagaaaatgccaaagatgacagctagctatcaaaaagatctcactgtctcattttcaggtctccaaagtaaaatctaaggacattcaacacagattcaggtgctctcaacagccatgaaaatatatggctgaagagggaatctataaatgtaatgaatacacaattggcttataacagatgcaaccaaaattaaattcgatatcttgacctgctctccaaagtgaaagtttctagtttaggctacagacagaggtgtaacaagctcattaatcacatgaaccagaaatataagctgacacttctggggatgctgcaaagagcagtcttaagctgttgggggtctgtggggaacctgaaaaatcatgtggctctgacagtccacagcaagcaacaccactgcattttacaatgtatgtgggtcaggcactggccataaccaccactattttaaacttccaggacaggatttaaggatctttgtagggaaataataggtccaatatggacttttataaaaagattcaatatatttttattaggttcctgttacacaaaaatcattgtgttcattgcatgagaagacaatgaattaggtcaatctatgacctcgagaagtatataaatgggaaagaatcagaggcaggggaatattaataagtaatagtagcaataacaataacaacaatgatgagtgataaccttgagctagtcattctgctaagcactttatatactacatttcatggaattcttatagtatcctaggaaggcagatatcgtttttctctttacagacgtggaacgtgaggcccagtaaaattaagtacattgcctaaaattatgtagacctgttctttacattacaaataaatacataaatagcttgcatataaaatgaaatatggcaaggctcattaaaagatacaaagtgttgtagaaataaaggaggcagaatgtgtttctatttgggaatactaggagaaaaggaacatggatgggaaaatgtggtgtgtgcttaggaaacaaggattgttccagtttgtaatgttataaacctgttgaatcatcaatgtctcattagaactcatactttgataagatagtaaaatataccaatctgtacaggaatatttctacaaagaaatacttctttccaaaagatcttctgactacaatttctcaaaacttttcttgttatttattttttggtggcgatagagggagaaaaaatgtgagatacaaggctatggaggtctgggcagcagtgttaactccagagtctctagggagtacaatgcatttgggtgcattttccttcattcctcagaatgccttatcctcatcacacatatttgtccctgccacatccgaggtgaggttactggcatagaaatagaaaccctgagggtctggtttcttccacttcttcaaagtgggatatcacttactttttatttttataaattagttttagtggtcagccttttggcataggagtacatcaagaaaacgtgagttagaaaacttgagttctggtcccagttttgccttgctcatcttgaaagcattttatctcttctctgtgtttaagttttcttattggcaaaatgagtagtttaagcctgaatatcatttcttaatctgttggacaaccccctcatcaaattttttttgataaaaataaaaccttgttttaatgtagatccttctattcttctctatttaaaattcctggttcacagaatgcaatatatagtaccattagtccagataattttgtagagctttactttctctattttgttaagtttttctcgtaaattttgttttccaaatataaaacattgtaatatatatgtattttcaaattctacatggtcctcgaccagatattccaatattccattctgaagagttggttaacccactcacccatattgagatatctaaagccccttcaagctccaagatacagtgattatgatgctctgatgctgacatttgctttgtcaacgcttaaagcagagcttttaaacttcaaacaatagcataacaagttgctataacaattacacttacataaatctttaagcagatgtgcataacagctctttacatctactatcacactggacaaccaaagcttatgatgttgttataaatccttgcaatagtaaattctacagttaattataacctataggaaaaagtactgtccatatttagaattgattgactcttattttccacatctgttaattttgcacccagctatagggctttaaatagctcccataactttaatcattagcccccactcagtcatgacttctatgtctcacccttctgaccttgcccactgagttcactcttactgatgtaatcaaacatgtttcattgtagttgcattcgtcacagtgctcattagaattatcatcattcctacagcacctcagtgcaatgaaattgtgtgcctatgcaatttgttgttattttaagttcttcagctggaattttaaaaatctagatggacaattttattttatctgatcgataaatatatatccagttaagtgcctctgaaaaattggtaagaaaattatttattagagcaaaatcttaagtctagagagatttttgtaaacttggacagcagcattcactgaccttgaatccacaggttcaaaatttattagtgtcaagttagtcttttaaagcaatccattaaagcaataagtataaaatatatatggtttacatttatgtatgtgttgaatttaataaattagtcaggagtcaaggtatttttaaagaaatattaaatctgttctatattgatcaattaactgactttctaacttaaaatattcttttgctgtagttaaaacctttttttctttttaaaacaaacagagtacataaactgtaaggtggcaatgtagttcactgcgacaatctatatattccttaacgtttgttctttttatggtcatggtatgtagaaacaaataaatgtataatagtttaagtccaggagtttttgcctgactaaattctaaacacatagcttaaataaagggttgaaagcctggcatctcatcattactgtttatatgttataaggtttgcagggccaccttataaaatatatagttgtttattttcatgttcaataaataagtagtgtggggtttcagactgagaatggattacagattgttctctcctggttatttttggctttaagtatattgatcattttatcattttcttgttttaaactactttaaacacagcacaaatgttattctcatcatgccagaaatgggtttggaattgattctgagtttccatcaattttactctttgctctttgtgagaagttttgcactgcttaaattcgaaaggatagttttgtttaaaagatgtcacagtacaacatttagagaaccttagctgcccagaaaaactcagattttctgctttacaaaagaataaaaatcatcgaatttattaccctggactttattgaaatcagtgaagaatattcatacaaatacagtttcacgaacttcctctctctctttcttcatgtaagtgtttgacaaaagcatgtatcttctgagaagccggcctgattggtccaggttggcactgtttcagtgtttggcctacggcggctgcttaggaataatttcatctcatcctctctattttcctggactgtatcaaactcagacacgtggtatgcaaaggaaatccaagtcttttaaaaatgctatttcttttggtactaaagccaagaccagttctactttggccaaatgatcttatcaagatttaacaagagatattcagtaatatctccaatctgtgagaagacattccactaaggaagataatttattacatacagtgtacatatatttctccacttggtaccaggaagagacatgatcaaacttattctattggtactgaaaacaatgtaacactgacaaaaattctgtggcaattattcatttcaattaatttaaaaagaaataaacaagtagctcttcccccattaaaacagatactggaaatctattttcagttattgctgaaaatattttggcttccacaaaggcaccttactaacacactactttgccctccactgtgctgtcacaattcagaacttgtaacattttattcaggtactctagactaattagatgaaacaactgcattacagtattaagatgcttttgtagaattaaatgaaaggagatctgcacagttcagatagcttggaagatttgcaatgaatatcaccaaaatcctgcatgtgcaatatatttttctacatttacaaattagctaatgaataagtgtattccacaataactgctaggatttaatttcacacttaagaatatcaacaaacacagagagaaatttagataggtaaactccatttcccttcccaccccaccctagtgctcccctgcactgtttgcatttcagaacaaatgcttcatgtctcttgaaaagcgccaggaaatctcttctctagctatgcaggcctcaattttatgtgtgtagtatgacacaccttaaaagagagagccccacaaactagagtgggacgttaatttaaatacagacttaaggagaagagctccatctactgaatcagttagatcatagtgtgtaccctatagttatcccattcactactttcaaccacttagaggctctggagggaacaggaaagttatagacctgagcaaccatgaaaaacagctttgagcctaatgccatttgggatatttctcggataccctgagcccctttcctttgcccctccaatttcaaagctttccatgttgcaatataaaataaaaatggatgttttgctatatgaaccatcccttggaagtagaaagtcattggttgttgaaggaaatgtctcagacagttgaagagaaagctacagaaagaaaatctctagctggcaggttgggcagcctaggtaagaagggaaaagaagagtagcctacttactcctcctgccttgcaccattgctggggaagcctgcagccacccaggatcagctcttctggcctctccccggctgcacagtattgttgtggcattgggaatttgctgtggcttcgtaagattatggggatgtgcttcagcaagccaaaaaagtcacaaacaaaattcaagaggaaaaaaaaaaagtataaaaacagctgatcttactggagaagctcttggcattttcctacatatgccacaattttctctggtatttcctggttctgtgatcagaaaaattatcgtatcatatttattactgttgtttttttcagggttgctggtggtgacgggtggtacagtgagggcaaacagatggatcaaggagaagcaaagtaaagattacttctcccacttgtttgaaagctttccaagagattgcaggttaaaaaatctcttcttcagaatactgaagatgtatagatatcacatataggaaaagatggccatactctttctagattgggaaagaaaaaaacttctaacacagtaacagattcggaacaaagcaaattgtatcagaaaaaacttaaacgttcatatagctgcataaaattcagcagcatataagacttataaaaatacttcataaattaagataaaatatttgaatataaatgggtgttaagtatatatataattggatgaaagcaatagttcagtgaattttttattacagaaaaataaaatataatgaattaacaaaagttttacagtaatgctaaccttttctcttgtaggttaaaatagaattaatgtaactgtaaagtggattcatgtttccctgtgggtgtgaatgtatatatatacctgcccaggtattactgactgacactgaaaggtgatatgttgcaaagaaattcaaactttgagcattattttaaattgggtatttaaaatatcagtattaacctggcaggtttctttctttttctttctttctttttaatacatttaattttcagggtctgttttaaagcacgaaaagaaaaacagattagaaaagcattgcacatcaataagtattttgtaaaataatccatttgcatttattagaatattcagttctcaaaaaacggctaattggattttcttcaagccttttcaagacaagttcagttctgtgtcaaggataactatgagaaatttcacctcaaaaggtaatttgtttggttagttataaaagcctgaaaaacaagattatctccaccataactataacaaaacagctaatgagtaagtacattctggtaagaatcgataagaatggcaaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagctttaaaaaaaaaaaaaaaaaaaggttgcacaaaagatacatgtgttccttttctggtattattacaggcccacctagatttagctttcgattccagatgagatcaggcatgttcagactagcacatctttgctctgtaagcacagagctgctatcatttcactggcaaattctcgtatccccaaatttatgcacaatagataccctttaaaatctgcaaattttctatttcagtgaaataactgattgagttaattttttttcttaatttacgctgctcgtattaagctgaaaagttaaggcaggcaactcctataaaaaaggaaagttgaacagtacttaccctaagtgtaatgtgcaagccttaatggggcaatttacttttgctctatgatatttagaaaggtgtccaggtctaaactcagctctcgcctttttcccttctggaaaactgagtagactcacagaaggtgcctctgcgaaagatcatacaaatcaacagccttacctgtggccattcagaagactgcactttggtgtgtgtttaaaactatgaataaagtcagatacagcgcatgctcagcaggcaatttaaaaatatttataacattgttgtttcaaaaacaaatttcctcaaacaaagcaaaactcaaatttttttatccatgccaagtttaacgttctgagacaaagctgttttggagttttccgctgaaggaaaaaaggcttttaaaattttttgttgaacgaaaaatagttctctcttcccttttgggtacgcttaaaggggtggaataaatttttctccaagtttcaacaaaattcacctctggctatgataaggcattacaaatttaaggtctgtaaaaaataattttagagaaactaacaagaaactaaaaactatgggtttaaagaatgtaatggtcatctgaactttcaaggcagtcttgcatgtaactatacaaaaattatatcctgatacaaacaggatatattatatgtagataagaataatgtgtatacaaccatatgcatacctagagaagttttatttttcttttgctaactaaaatcagaactctctaaagccgaaaaagaaatacaacaaaaatttaggagaaacccagtaataacatcggcacaattcatctgtttttcatagcaagcgtggaaaagaaggcaatcataccaattgattaaattttgagatatataaaataaaaatttgataaaagaaggtttttaaagtatgaattgcagtagaaatgcctgtttcgttcctggttgaaaatttctttctcttccttgaatatccctaagcattccattttaccatctatcaccaaaccctgaacagctcacagatctcacagatcttatttaaatctcttacttaattcttaagtctctgaatgaatttcagctcctgctctactttccaagggtgctcagctggcctcacaaaagctccacagacacatcgttcactatctctgatgctttcaagcttaacagaggatgccaaaaaaaaaaaaaaaatcaacgattaaaaaaagtttattaaagtgaaactaggagtgcaaatttgaagaagttgcttctacttttatttctctctcaactcagcacaggtgtttcctaacttatactgctgtgcatgctgatgaaggggagggttaaattaaggtgagggagtgggccaagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctcaggtcagatccacgaagaatcccagaatgacagctatcacctgtcactgtactcttggcggcacaactagctgataggagctgcctgagttgggatcaagaagagctagtgcagctttcagtaacagcctgttatcccagtccctctgcccctttcaaagatccccttggtcacatcaaaaacagaccaaaaagaaaaagaaaaaagaaaaaaaagggggggtaccaaatgaaaaattaaaaatgcagggacaacagcccacagcaacaaaagaattcagggagaaaaaatagaacacaagcaaaaaggaaaaaagcaaaaccaaaacaactcttgtcttcaatataaaactttttaaagactgagtttctcttatttggatgacattctttttaaaagtatttttctccttaagcactattaaaagcattaaaaaattctacaaaaatacagaaaagtctgaaagcaattcaagaatattcctaaagaaaacatgtaagtgtaagaagtgagttaccctggaaaattctggatttgccaaaagttcccctacttctaatatctttcagtgagttcaagtgctaacactggccacctagtacttgttttttatctgaggatcattactgaggcaacacatacatagtaaggtttcccgaaaagactccttgttatcaagttacttcaaacataaggcactcacacctcccagccaggagggttttttgatgagcatcacactctgccctgatatgtattacacccttaagaagcagttacataaatgcattctataattatggaaaatgtatatatctatattttcccctacattttccctccccagggatatgaatagattttattttcagttaatagaaaaaaaaagaaaagagtttctgattcttgaaacaactgttgtagctgttttctacttagcaaaacagttatctgtagttaggaatggtacataatatatatttaaggatttttgtagagcttgagaattgttccccttgtttagtttcgtgtctataatgtaccttaaaaagatttctaagtgacaatcaacatataaatgcattaagaggagaactttaagaaagaaaacattatcttgggtttacaaatccaggatattagcataaagatataaatgtacagcatatataaaagataaaattgtttactacattttacacatacagctcacatctgatttctttttgcttttgttggagcattaatttgaaaatgataagcattctgaaatgtttgctacaacacaaattcatggtaaaaatatacatgcataggcaaaaattgaaatggagaacacaaagctacgtggcaatcagaatcgttgacaaaatctccatctagactatattttgcatgaactagtgtatcatagaaggggcaagaaatctctctgggggttttgtcatttacataattagaaacaaaaataaaatacaaatatctgctcccttactaccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtgagtagaaaaaaaatagcataaagtgagcataagaacagttggatttggaaagattaaaagaggagaaaagagcaacatatgcaacttaactagtctttttctttttaattttttcatgtacatatatgtatatattgggatgatggggagaaaagataactggatttcttttgaatgtctttgtgtctttatagagtgaatgttctgttcctgtctctttctttttaggcgaaaaactaataaaaatagaaaaacatatatcagacattaagctcactccccccccccccacccttccctttgtaaagaactctttgttctctagtgaaaatgctgaaaaatccccgggcagctactccctgaaacaagtgcaaaacacttagaggcttttgggctggctgggagccagaaaccctcccgctgtctggttagaagaggaaaaaaagaagagagagggagagggagagaggggaagagggatggggggcagagagagaggaagagagagaggaagagagaggaaaagagaagggagagagagagagagagagagagagagagagagagaaattggagcttcctttaatagacataggaagcagcgtttttttctttcttttttttcaaaactggcggtcaagcgttaagtaactcccgtctaaatccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaacaacaaacacagcaaaatacatgctccctcggtctcctaaaaaaaaaaaaaggcttttccatctcggttgcgacacagtgataaggggtagcgaacatctcatacctggtgtgaatgctaatcagtcaggagttctccttttcccaagacagggaactgtttccttccaaatttattagaacctcctccactgcctctttgaaaaaccttctttgtcaccctctcccaagtcccgatacttctttaaaaaaaaaatggcttcggagctccttctattcttgatattgattctctctctctccccccacccctcctcctctctcctgtctgtgtctcttctgagtggtctattgataagtccctggaggcactgggtcagcctgcccgtaggaaaccagacacaatgcacaaatctccgagtgccattctgccatcagcaagcagaccacgtttaggagagagagagaggaaaaaaaaacagtagagcaagagacagagagagagagagagagagagagacaccaaccgagggagggagagagagactgagagagaggaagagagagggggaagagagagaggggggggagagagagagagagagggagagagaggagagacggagagagagagtgtgtgagaaaaagactgattggaacaggagggagagagagagaaaaggagaaggagagagagcgcgagagggagagcggcactgccagtcaggttaatcatccctactttaattagctgttcggcttagacataaaacaattgaatttgaatgatctgtcagcaggctcggctgaaccaaaggggaaaagcgaatattacaaaaagactgttggtgtgttctgataagcaatactgctcgtactgacaaatcctcaaagggggaactattaaaacttacaactaaacaaaaagtgcaaatacaaatggcactagatagaggtctttaaaaaatggagttttctcctctagttttatgaaccatagatatttatgtgcaggtgccaacatattaggggttttcgtgtaatgtgtgaaagtttattaacgatggtctaggagtgtagcagacagatgctgcagagaacaagacaggtacagtcagatgccgaatctagatcttggagggagaaggatgctggaagaagaggcaccgtggcaagagatcagcacagacaaagtcagtgggcagataggcagacagattttaggcacggcacgatctcatctaaaaaggcaaaagttctgatgcaatattaggtacaaaacaatccatccatcctcctctcccgggtgcactccaaggtacagttaaaatggattaatctttgtgacaaacagagctggcaaggcagacactgaaggcgatttgcagacccagagaatacagagctagaaaaagccccagagatcaatctctccccctcccaatttagtagagaggaaactgaggcccagagtcgacactagacactaggactccaggagcccaccaggccagtgctctttccaccacaccagctaacctagagtattctttgaagatctggcccaacaggtatgaaaatcacccttacctcccaaataagaagattactccacctatatagttagtgcacaaacctccaatttctcaaaatgtttaaatagccaaatggaaatataattacatatataaatacatttccactttatatatatgtgtgtttatgtatatatatatatatggagagagagagagagagaccattttgaatgctaggaacaagggatttaagtctttaattcattctaggagaaaagcagaaaaatataatattgtagaggcctcgtctcagcaagatataacttgtgtcacattttcaagctaatgaaggctagtggtttgatctacaaagacctcaccctgaatttacaattcgctctatgaacatcatctgctatatatcaccaagtgagaagatgtggtttttctcatacacctcgtttctaaaatataggcacattgtgggtgaaagagattgagtctttcagcatactatgtagttttaaagcactgatgagattttccacctggagaattaggtatgtacaacctttccaatatatttcaattgaaaatgagctactaaaaaggggaaactatattttccgcccatgaaagtgatggtatctttttcgggacacatatgatcatgttcactaaggattcccttttgacaatgggtaattgaaggtccagtttttaaatggtgaaagaggtgcttatgaagagaacagtgccatcagatgttactggagagattaagtttcttgccctaaaacaagactcaggatgtgtatgaaaccgaaaactatctctcagtcatgcttcagcaacaacattgctacttagggagaaagaagaaaaccgaaagaaatgtcaggcacgtgggagcccactcaaagacaagtaatctgagagaagtcatagccagagtaatttagtttatttgcacaccaacctctttaacaatggctgctatgccatgcctaaaacacacggcctacagttgactgatttggaaagggggaaggaatcagtgattttgataatggcagatcctttggcaagccccaaaatacctgataggccagagcccagaagaaagcagtggagtgcttagtaaatgtctgttggtgaactgagaaaaaagaacaagagctttggagcaaacacatatttatatataacactgcaaaagtcacagctactctgaaagcctcagttttcctttctgtaaaaggtgatgatattggtcccatagagttgtcttaaggatgacatgaggaaacatataaagtacacagctagtcattacacggtagttattatggaggaaggtgtgtaaacaaaagtgtatattatggatgtgctgagtgtgttatattcaaagcatgtaggttcaagacatgaaagcatatagcaaagcaaggatctaatatacagatctctactagaaaggattggcagtagagattataaagtttagaactaaattcctaaaatctaaacttcaaggatgttaggtcatctggggttgtattatttctttgttcccagattttactatatttcctggctcataataataatgatggccaacatattactaattggcttgccctaagcagtctgctaaggactttacattttaaaatcatactttagcatcacaagaatcctatgaatgaggtactaccaatatccgcatttcatagaaaagaaaactgaggtatagaaagattgtgtaacttgctcaagatcacacgcctagcaagtgaggagctgggaattaaatccagccaatctgattttaaagcccgcattctcagccatggtactaaactggcacacagtaggtattcagtcaatgtgtgttgaatgaataagcaaataaaaaaaacactagaatttttatttcattggagatcagtaataatctgtgcaaaaccacttgagagaatcttgttttcgaattatagaatctgtccttcttctgtagctcacttcaggtgtagtcctttgtcagaaaccagggtgagccatgtccctgcatggtgctgaaaatggatgaagggaagagtgctgaccatgaccacccagggcatttaaatatctgacggcattttcagcactttgaggacagtgttagcacaagggttattaattggcttaattccagttcggataattacatcgtgtctctttaattttcccccgactatgccattcttcacttcctgtcacaaatgtgctctttaaaaaagcatacgaatacacacaaacatatagttatatttaaggtttgcataatcatttagggtgcttttttttctaaatgatcagtgtatagtagctatgtaataaatgaatgggcaaaagaattaaagtcattgtaaaataaagataactagttgaagctttttgtttggcaatgaaacagatttttaaaacatttccttggtgacagaattccaatcacatttttttctcatgggcagatatttccagagctgatgacctgctcatgataagctgattttcttacactatgtagtttccagtataaaaaaataccaatgaaaacttcgatattttagagtagaaaatgagactaagtcctgagtggtagagcatactgaacgtacgggttttcagtgaattattaacccatttattagctctgacttacttgacaggttttttttttttatctccaaacatatcactagaataatcttcaaattatgaaagaaaaggacaacatatcctaatttaataagcttaggaaagtttgacagtcataaacagacacaactccttttcctttttccaaagaattcttggcctttgaaatactgtgcctgcattatactaaagaaacactcccagaaaaatatgcttaaaacatgtacacaaataggtaaatgcacccatggtagaccatagtttattaggcctttttagtgtacatttgtatgaataagtcatcaaatatagggagtgtggaaaataagagaataaagggttaatttatttattatgcaggaaggtttctagatctttgctccttcagcttttagttcaaaattccatgcatattctgcacataataataaatgccataattcaacgtatctcataatttgatttactttcaagcacctttttttctggttcagctcttgaagccttccttcttataaacttcctccaagttattttttgtagcgctctgtaaaatatcatttaaagttggtgttcataagataaccctcatgctatagagagatttgtatcaaactagtccatatttccttttgagaaccagtggtcaagtcccatgctcttatctgagaacaagccacaataaatatataaaacagccctttcccacctgtttgacccctgtaataatgatagcagtctctcagtgactgccctctggttagttactcattccttaagactgagctcttccaggacaaggtctttccattctaccttgtatatttaatgtattgtccagcatcacacctgccatggtggtagatgatctcccagaaaagctggaagcaacaaattttaattccctttgttcttcatgagtaaatacaaatttttctctctgtgtgtcaagttttcaacatgtaaaaggggcatactttatcctaagattagtgatttgatgttcagaaaataatattggagggtatagtatttaagaattagctagtgaaaagcacttgttttggttattttcatagtatcgccactatttttatagcaagaagtacttagaaaacatgttttaaattcaaaatttaggtgaattttgaattcaaaagaaaagtggacaagatttatcctgaatattagagatagtaagcacttggtttttaaatgccatttaggaacagcctgacagattttatacaagcagaaggtatttaggaaattctctggttctctcagtttacagagaagagctgagtggcagagatattttatctgacaagcttaaggtaaaaaaacttggtagaagtgaactagtgctggaacccagtctgtctgtccctggttccacactcttctcactcatactttgaaagatggcttttatactcttgactccagatcccctcttttttggacatattttactgacggaactcttaaattctggtgctgataaaggggtacaatattcctaatgtagtctgataaacacactacaaaggaactatagtaggctgaggaatggccccccccaaaagatatccatgtcctaatccccagaacctttgaatgttaccttacgtggcaaaggggtcttgcaaatatgattaaattaaggctattaaaatgaggagattatcctggattttctaggtggactctaactgtaatcacaaaggttcttataagagagaggcaggaggatcagagttagcagatgtgatgacagaaacaagaggttggggttatttgaagaaggggtcatgcaccaaggagtgcagggtcctccaaaagatagaaaaggcaaataaatggatcctcctttatagccgctaaaaggaaccagccctcccaacacctttactttagtacagtgaaactgatttgagacttctggtttcagaactgtaagagaatacatttgcattgttttaaaccaccaagcttgtggtaatttgttataacagccataggaaattaacacagggaccatcagctaccttgatctggacataatctttcaacacagttgaaatatttcttagctctttaaaaaattattttagcagatatattaccttactggttcaaactgagcttgtgatacaagaacccttaccagtcttcagaaaaatattgactaggataagtcaaggagggtcttttctcctgacactaagagcttccttctaagttgacataaagcaatcaatctaatgattattggttaattgatcagttggctgcagatccatctaatcacatttgcccacctcctgtcttatagtaactcttcactggtggtttggcaattgtatctccaagttaatctacaacagtagttctagttagaagcaaagagaagggtttcagtgtccatttcttgagtgccagagacctgaactcattcagaagtgagtgctctcttgctagacccccaccccacatttttttctgagctttcttaacagaggtcagaaaaaagaagcatgaggcagcttaggcaaaaaacaaacaaaacaatctcctcccccccccctctttttttttgagacagggtcttgctctgtcaccgaggctggagtgcactggtggtgtgatcacagctcactgcaacctcaaccacctgagctcaaggaatcctccagcctcagcatccagagtagctgggtgtgaccacaggtgtgtgccaccatgccaggctaatttttaaatttttgtagtgatgaggttttgctatgttgctcaggctggtctcaaactcctggcctcaaatggtcctcccacttgggcctcctaaagtgctggattacaggtgtgagccactgcgcccagcccctatccaaactttaataagactcttttgccatagtgtatcattgccattcagttaccgcttacattctataggatagtgctcctaaaagagtagtccttgggccagcagcatcagcattgcctagaaacttgttagacacgtaacttattgtgtcttattctagacctactgaatcagatgctcagaggtggatgtctgagtgtgtatattttaacaagccctttaggtaattctaaagcctagctgagaacaattgtcataggacaaatctgtgaggctcatcaaggctaatgaaaaaacacgttggactcagagtgagatcacctgctaatctaggtgtcatggtgactctgtcatttgccagctatgtgactttagattatgttcttagtctatttgtctcatctgtaagatggaaataataataattaataataataataaattgctttatgtgaaaagttaatgtagaagttaacaagatcatgcatatgaaaacactttacaacctcagggttattattgtagaagaaacatcaatttggattgcaagtatcctaggaccacattgttggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatctgctggcattattagtctctagaaccaagtgctaaatttcttgatttgaaagtctacctttctatttatcaggtagcagaatttagtgacagctttgaattctgtatgccagtgaaagtctatggcttgtgggattcagaaccacaattttttatcaatttccaatgacactcagttttagtaaagtggcccatgatctcttgcatttccataccatattctcaaataagtaagaagctccagggagctcgctcaacaattgattatggtcacatattttttcaatagaaaatatgtatatcctggtaggtgggaaggatggtcctgatcaggactgagatctttttagaggttcaagtccaaactcttagtaggttgaagggaactcagatgcaaccagattagacacaactatgattttcatggaaaatcatcagaattttatccaatctctgagtaatgaaaatttgcagtatttctcaacagctctatatatgtggagaaaaccacctcataagaaagctaaccatgtcttttccttctttcatgaaataatagtgacgtatgcctcttggcctgaggactcgtccttcctctgaagactaatgtctgcacgtcaccttttggcaacccctctgtgccttgcaggacagttgtgtagcaaagattctgtttgggttgctgtttcctctgagccagtcacactggtgcatcaggagatgcagctgcaccttttaagagctctgtgtccttaagcaagtcatctgtccttttacatttcatagatttttcatttgtaaaatatgaataatatgtgccttaccaatcttacaaattgttctgaagatcaaaatggatgatgtatccaaaatgctttgtaaactaagaatctcattcggttggtgttactgatgttgttattatttactctttagcaggagagtaaagatatatacagacatattgggtacggtagcttgaatatttttagacatctacgttgtatatgcctccaaggtttccccctgaacttacattaatccctttttcaggttacagctaaggtggtaactaaggatgttaatttcctttaggtccctataggatctctattttgatcatgattagtttatacatgaaatagacactgctgcagaatttacaatgtttccattctggccaactcaactttgaacatattccctaagtaagaacaaattcagtactataacactgaagaaaacatagcatccgaagctggtattgagggagtgaaaatatcttcaaaggctttttcttgattgcttaatataaaaaatctgcttagaaatgtccactagttcaacaagcattcctgaaggaaatctgtaacaaagctactgtgcattaacatttaaaagaacaggaacatgtagtctacctcaaaacaaattattattgcttgaattgcccaaactttgttaaccaaaattgaatttcgcctaagttgaattcatgtgaagagctcataatgcattgttgctatttagatagttgtcatagtatgtggtactcagtaagtcctctaaaatggaagggaaattaactacatggtataatttcaacataagtcattaatataattgtgcgaagaatatctctgaatatattgaactgctatttgaatctttaattgtgcatacaattctaccttttctgctatgcatccttaactagactatatgctccctgaggacaattcctgatttacacatctccaaatttcccgctgccttcagtacagtggtttacaagtagcatttgctttcaaactatctgctgtttaattatattcactttttattggcttttcttggggggcaatttatgcacataaagtgtccatagataaatgcatcattatcactgaggtgaaagttgtgattcttaatttttttaaaaaaacatatacattgggccacttatttttcctgtgtgacactcaatctaattatagaagtgaatagaaaaacatgatctcttttaaaaggcgcactttacgtgaaacaattttaggaattcagcttatgtgtcaagtacagtcattctgcacagtgatggtgatggggaggctctatgtactatggttttgacagaaaatattttaacttaaagccagctacccataaaattacgtaaacataaatatgcactctcccacaaacacatttgcacatctttaaacttagattaatgcaaagaaaagatatattcttttgttctagtggaatacaaatgataaagactaataaatgaataaataaagctctaggtaaccaaatcaatgtctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaaaaagccagttgtaaaatctgtaatataattaattatttccataggtaagagatattttattttttataaaacctggtctgactggtaagtttgttctagattaaggatttagctacagtttggtgagtgtttgttctctgttaggcttggtgcatattaattcgtacatattttaacatttcactactgtattaaattattaataatttgaaatcattagcttgtactgacaccatttttctgaaacagtaccacctgtttcttctaagtttggtccagaacaaaagtctgaaatctaatttgtcaagaaaacaaatgtgtagttcagaaaaaggataggggccaggtgcggtggctcatgcctgtaatcccagcactttgggaggccgaggcgggtggatcacctgaggtcaggaattcaagaccagcctggccaatatgatgaaaccccgtttctactaaaaatacaaaaattagccaggcatggtggcacacgcctgtaatcccagctactcaggagtctgaggcaggagaatcgcttgaacccaggagccggaggttgcagtgagccgagatcgcaccattgcactccagcctgagtgacagagtgagattctgtcttaaaaaaaaaaaagaaagaaagaaaagaaagggataggaatcaccaaaagaaggaggtccaaagtccaatgttaggatgattatgctcatgacacggccatttaatctttaaaacaaatataaaagacaggtattccctgtggcagagctgagctttacctcaggtctgtgtgacagagtctcatctcttctcttatacatcctcaatcttcagacatttaaggtctctgagtatccaggatttcctttgcgacaataattaacaaatacatgtatgtacatttgtgtgtgtgcattatgttttaagcatatatatatatatgcaggaaactcacatctggagtaccagagtctacaggccaggactagatacttagatctctagggaagtgatccaaatatctagttgcagctatgtagatttcaagaatgcagtgaggggagaaagagtatacttaatatatgagtacatatacactatatatatcccatatatgtatgacatatgtaactaataatagtcaaccctcactaacacaatgtgcctaatattattgtaagcacttcacaccccgttactttgttctcataacatctaaggtaggcatcattattattatcatctagttttacagatgagacaagcaaggcacacaactaataagtggcacagtccaagttcctatctgtgatcctgtctttttcatggaccttttcctatctgttgcctccatgagaacatatctgaactttggcctattcttttttaagactttgctccctcttaggagataacaagtagcagaactcacatgttacccagccaatagtgtacttagcttgggaacaaaagactaaatttgtggaaattcctcacatttgtacaagagaacgtcccaaagcaagatactatggcctggaaaatggaagagatagtttgggcaggtggatgttttgggtctcccaaatcacaacacatgtgcaatgcgcaaccatcaatacataaatccaatttaattcagtatatatttaataagcacctgctgtgagcaagggactctgctaggacctaagctctagaaagtagctacaaagattagaagcaataatcctaatatttagaacatgggagaaaagaaataccacataactaaaacacgatgcaaataagttaataccgtaaagcgttgctaaaaaaaatctgtaggtttcagtgacttgaggaatatcatttgctattcagcggtggacactgacaaagttacctgaagcaggcagtgtttgagatggactttggaatgtgggaaaattccaacaattagaaattggagagataggttttaggcaagggaaacagaaagagtcaaagcaagggataggaaagcacaaactgtgtctggggtcaatttgactagcttctagactactcaaaggatagcagtaggagtttgagatgttgtgggtgaaacatgtggaaatgtccattgagcagcaggaaacccacatgtgcagtaccagagtctacaggccaggactagatacttagatctctagggaagtgctccaaacatctagttgaagctatgtggatttcatgaaactgtccacagatttcaagaatgcagtgaggagagaaagacagacaaacttacattttgtgggcagataaagggaggatggatgaaagatcattcagatgaacaggagaaccataaaaacagacgctatagagtgtaaaggtgaagaatgcttcaaatgcttcaagaattagagatagatagtcaaaacaatcaaatcataaacaggatacctaggattgctgtgaggaagaggtatatttaagagctagagtcttcatcactgtactcatctttgaaaggaccacctcttattgctttctaccctttccctaaactcaagcatgcatacaatcacacacataaacaaacattattttttcctaggaaaaatgttggcattattaactctgaagcaaaactatatctggaagtttttagagtagttagcaagatccaaactttatggtttgattttaattcaaaagataactgaatttttatatgcaggttaattattccttggtgggaatgtgaatttatttgtattttattcaggaagtatttttgagcatttcctaactccaaggtattgtgctaaacgctgggatcagaaaaatttccataaatgcttggatggcttttacctgggagcactccttcctatggttggcaaaaagctgacgcctttgtgatgatgagtttcagtcctagcctctaagagtttttgtggtcatgttattaagtgcaatgtttatgtgtattttttctgttccaagattttttttaaagttttgaatatttttttatgtcaccaaaaggtgctttagaagaacaaactaactcaaagccaacacagaaactggttctcttgctttgccaaagtggcagtgtagcatgtgggcaagtaagaatacttttctcaagtatttaaaacaactacagaaatcttattcttcattgtattctctaaagaataaaggtaagaaggaaaatcaggttttgatagagaattaaaaaatagctttagcatatgttcaaaccattaggtcaaaagggactaacaaagccctgtagaaggggacccacaaaagctgcccttgggacttacttattcacttatttgtttatattttttgtatatgtacatatttttctgatactgctttgacacatcactttagctctttttctatatgtatgaatattcttctcctacaacataggaatcttgatgtatacatagtttagtaatctgcattcattctttcaagataaacatttttaatcctacatggtattctattctaaggatataccagcataaaatacaatttaaacaatcacctatttttggacattttggttgcattctgacttttattcttttcaataattctttgtccagtatcattgggcatagtctttgcaatgctattatttaatgaaaagaaaattttggaaactttaacaggtaataccacaagcgaggaaacttaatacaacgaccacaagcaatgaaagaaaagtcaaatgcctcaaggagccagggtggaagagcaaatgagtgaagtaggtgtggcataaaatatggggtgatagggactttgtcaaactggagagaacatggtttgtctgaagtgagcagctgctactcagttccagatattggtgccacatgtggatgcagatctaatgttgtcagatctccaatttttcaagagaagcaaaaaaaaaaaaaaaaaaaaaaaaatctagtttttttttggtgtgaaatctctttaaccttaaaggttggctcaaattattttaaatattctgtggaccaaacatacattttaaaaaattctatctgctagctagatgcagctcataggccactgatttgtaactttctaattaaagaaagggcaagacggtgtttggaaatatatttctaggtagagagttaagcaaataaagttttacttcaagttttcctagtcacaaggaatgtaatgtggagagactgaacctcaatgtgcaaatcttgaaagatgggtaaatactgctccccacttaacacccatgaagaatttaatagaagaggggtctaaaatgcttttaatttcacaaagaaacatgctttaatgatataaaactctaacccagtgcactgtatgatgatatctaatgataatttcccttcatttcccatctgaacaaacatttcccattaacatccacctgcactacttcctttcataaagaggaggtggtatttggctatgttctggttctgattcatgagaaatcagcccaagcccaacatttctgttcttaacagattttggtttttaaatctgtagaacacaatgtttccctgggctgagttctagcatgccaagttttggctggccacagactttgacatctgagtgaaaaatctttcaacaatggcatttaaactgaagaatcaacagacctttaattataacactgcttgtaattccctccctctcttatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctcaagatttagattaaaaacaatatttccacttggaaattaagcattaaagatatagaaaaagggagtctctttttagtgagatttcactaaatacctctggtatctctccataaaatgttaggtgatcatttcttaacagctttttaaaaatgacacagtctcagattaccctatgtttcccttatataataacaaaagacacttttatactactaaagtacattaggaatcctttgaaagtttctgttttagaaactgatgttgaaaaagtacttaatttatatttaacctgcctatctgaatatacttagtggaaaaattagggttaaaaatgtaaatgtggaaaatgtttatttccatgttttatagtagttagttttttatttgcttttaaatatagatcttggttatatgtggaagacaggcataatttcagctcctttttcatcttgaagagaaacctggctctcaatttccaggaaatatatttatttagacctaacaatataccagaattttatgcattatttctaatcttcataataagtctacaagttgggtgtcattaatctgttactgataaggaaattgaaactcaaataaatttaatgcttttaccaaggtgatttagttagtgtctttttgtccatggattttaagtggtagaatttgcatgcaaacccagatatgactccaacggctctgctttctcctttagaagaaaaaaactccttcctgaaatactaacatcttttctttgtgtaattgaccatcctttcttaatacaattggttatcagagctatcatattcttaattatcagtattaccttacgactctaaaattcatctttgtccagtgtatagaattcacatcctaaggttagatataggagattaagtctctgatctcctggagcagacctggtttcaaatcttgtcttttattatccccataaatatgcatgtatttataaaattatgtcctaagtctttgttcagaaaatatgtagtgtctgacattattttgtgtataaaatgctgaaaaggtcacatccaggaaactagtcctgaccagcatacaacactcaagaaaggttctccaaggtagaatcaggggagaatcccaattgaagttgttgaggggagtaaagataataaataatattaacaataataactccatgcattgaactcttaatattcttcatcctatctatatatcatatttaatttttacactactcccattttgcgtgtgagaaaacagaggcttagagatggtaaataactagttcaaggtcacatgactagtggcattttactccagagctttgctttttgtactttgctaaactctctcccagaatatgggaacaaaatctaaagaggtaaattcaaagatcaatattaagatgataaatacaagatgcagccaggaatcaggaattggagtgggaacagatgaggaaacaaggtggtgggtccagcagggttgcatggttgaagtcagcaaatgtctgatatatgggggtgtcatgtcacattgaaagtacagctacatcagggaggtggagcgactgagagaatatgtagagggtgacagatataggactgcttggctgatttcatgtttttcctttacaaatgtaaataaaacattgtgtgttggaggtcagagggcaaaggagatataactgaggactctactcaaaaaaacatctcgcttcatgtgtcattaactgaacaggggaaagaaactcagttgtctaacaagatatttttaaaatatttatttctccaagagggttaaacctcatttacaccttggagtaaattactttaataaggttaccagatcacctaactgaatgtaactaaagtcaagaagctgcagtttgaatggggaaaggaaatggataactgtggaactgaagggtgggagaaggggatgatagtgacacaagcaaggataaaaaggatttccttaggcgaataggagggcaccaaagataattttatgaaaagacagttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgcgcagtggctcatgcctttaatctcagcactttgggaggccaaggcgggcacatcacctgaggtcaggtgttcaagatcagcctgaccaacttggtgaaaccccgtctttactaaatataaaacttagccgggcgtggtggtgcaggcctgtaatcctagctgcttcggaggctgaggcaggagaattgcttgaacctgggaggtggaggttgcagtgagccgagattgtgccattgcactccagcctggacaacaagagcgaaactccatctcagaagaaaaaaaaaaaagatacctcactgctctccttcccttctgtgtggcccaatacagcatgctgttgaccctggggaagcttcagaatgtatgatctaggaaagctgaggcaatgctgtaataacaagagctatgtgaaaggtaaagtatgaaatgtatgatggaaaccaaaccaaagagggtatgttaaagataagcccattaaggaaatagctcacctgttggactggaatctcaactggctcttttatttcacgctaaacctgtgctgagtctgcacagaaggacttctgaaatgcttatatatacaacctgacaggtacaatcagaaacagtacaaggactgcgtgcctcaacaagaatagccagagcactgaaatcaattgcagagcacagacatacttcaactgtggctatgcagacagtccccaggtatggctggtgaacagcacgctttatgtgtgctatgtcccagacttcctggctttcttcccttccgtcctaccccttcggcacacactacatatctttcacattttataaaatcacaggagatttccaaattattgtgtctttcaaatactttaaaaatatattgtcctcctaatataaaggagagaggtggagtatttagctgatgaactgaatttgaaagtaagtttgcatttttgatatatttccttccttatgagtgagtcatgaaaaatgcatattttgtctaaatattgataaagctttagaatataagagctggagtgaacctaagaggttttgtagcccggcaatttccaacccaggatgtgtctcagaatcacatagagaggtttcagattcccagccaggcacagtggaatgtggctgtagtcctggtgactgggaaggctgaggcaggaggatcactggacccccagagtttgaggccagcctggggcaacatggtgagacccctgtctctaaaaaataaaaagtaagtagaaaatacaaatcacagattcctgggccttttccttcccctgccttccccaagtgattctaattctatgtcagttttggctgcttgcaaccagttatggagaccagggatcttgatcaatctcttcatctatctgatgaggaatctgagacccagagaagtaagaggtacagtgatttctctaaggttacacagtgtatgagtccatttgcacactgctgataaatacatacccaagattgggaagaaaaagaggtttaatggactcacagttccatgtggctggagaggcctcacaatcatggcagaaggcaaggaggagcaagtcacatcttacatggtggcagagaagagagagcttatgcagggaaactccccttttcaaaaccatcagatctcttgagacttattcactatcatgagaatagcacaggaaagacaagccccctgattcaattacctccctctgggtctctcccacatgtgggaattgtgggagatacaattcaagaggaggtttgggtgggggtacagccaaaccatatcccacaggaatatgttacaagtgaagatagtctatggacactgtaaaattgaccccattagctatatcccaaactagttcattattttagaatctattttgtgtgtttgcatgcatacagcaatgcttcacatatctgcacaccacttatgtggcattccaaatatggttaagaacaaacaaagtgaaaaagacctgcaagcagccaaaattggtactaaataaaccacacataatcctccaagtctttttaaaagcctcttctcttgcttctctatctagtgaggcataggtgactcaaaatctttatctccaagcccggcccttctgctgcactatagtgtcgtgtctccaaaagcctagtggaccactcacagatacccagtcggcaccttcactcagtgtgttcaaaattaaacgtgtgctttcccctcccaacccttctcctgctttgctgctctgtttatgactctactaaggttcaaaatcatagagatgtgtttggtgtcttcctctcccttgctccccaaatataatggattaattctcccgccacatttcataaatcagtttgccatctctgttcattccctctgcccctgccctagttagtgccttcattgcctttcacctggactattgtaatagtctcctgcctgatcttgtgtcctctggtctctccctactccaatccattttactcactgttgccagattaatcttcctgaggcacagctctgattatgttactctcctactaaaaactttcaatagctccccactgtctcctgaataaagtccaaattccttgccctaataatcaagtcctttcactttctggtcccaatatacttttaccgctttatttcccactacttatcttcacacattccatgctcaagttaaactcaattacttctttgcagaatctttaccctttgattcttccatgcttttctcatgatagagtaatgttctttccttctatctctgtatgctcaaatcctgcttgtttttcaaagcccaaatccagtgtcatcttttctgatgaagccctcagttagccctcctctgagctccaagaataccttatctgtactacttttatagagcatttcacttttcactattaattctagcaaagtagacacatgtctcagctccgttgctagattaaaacttctagggcaagacatgtcttatctgtgtatcctctccagtgccaagtatacaagtgcacgactcacaatatttgtcaagtgaatgagttcatgtatgtactttacacacaatcaaaacatgtttttttgttttattgtctaaagaagattagaaataatgcatcagagaaggaatgaggatcttagagacttgcacaacagaaagtaacttaatagctaaagaagaaaaataaaaactacgaaaagaaggcatgagaactaaagatatagcagtcagagggtaaagaaacacagaagcaaataatcttatagaataaggaccaaatggttaattgagaagcttggaaaccataaaataacattcaaatatgtagcattatttttatacttccacaccctcatcaatagaaacaaatttgaattgtagttcaagataacaaccctgaatcatttagaaaagtttgaattatggtaagtatattcttttttttgagatggagtcttactctgtgaggctaggtaaataagctgcctttattaatgaagaaattcatatttttctgaatattagagaaatattaatttttcccaattaagatatgttcatgatatacaatttagaaaatataggagagtaataaaaaatcttaaaaatcctaaaaaaggtgggattataccatatgtattactatgtatgctgccttttaacttaatatatagtataaatagttcatactattataggttcttcataaacatttactggctcaaaattctatctaatagatatgtcgtactatacttaacacagcactctagagttgaacatctagcttatttccagttttataatacaaatatgtctaacaagatttaccatgggctgacaactgttgaagcagagtgaggaactcatgagagttcactatgatattcttcctacttttgtatatgtttgaaatatctagaacaaaaaggtaaaaaagcatatttatgtcttaattcatttgtgttgctgtaacagaatattataaactggctaatttaaaaagaaaaaatatatttctcacagttctggaggttgggatgtctagtatgaaggtactggcatctggtgagggccttcttgctagatcatcccatggtggaaggcagagggcaagagagcacaaaagccagagagcaagaaggagccaaactcacttctataatgaacccactctcatgataactaatgcacacactcctgcagtggtggcattcattcattcatgaaggcagagccctcatgactgaatcacctcttattaggccccaccttccaacactgttgcatcagagattaagtgtccaacacaagaacttttggagacacagtcaagccacagccatatgataaatatcttgtgcataatggcttttgtttacttgtaattattttcttaggttgcagtttagggctagactgcctggatcaaagtcttaccccatcattacctagttatctaaccttgggcaagctgctgatgctttctcagcttcagttttctcatttgaaaaatgggtataatggtaacttataggggctgttctaaggatcataagagaagatgtgcttctaatcccttccacagtacctagaacactgttagtgtgcaataaatgtcacctttgaaaaagcaaaatactggttgcataattatgcgttgtgcttataaagaaacatcacatataaactgaaaaacatacctgaaataacatgcttaagtgtgcaccatttctatctccaggctaaatgcttatttcaaagatacgaccactgctaaaataatttagatccataattaccattacgaagcattttctatgtggttgatattggccttactgggctacatgtttgatgtgtactatctcatttaatcatcataagagttttctgattactttatagataaagaaactgatgcttaaaggtgaattaatgtgcccaaaaggacacagggtctgttttcaaacacaggattgaacctctggaattcatctctaagctactgaaaatgacctttgttccctgcactttttttttttttttttttttttgagatggagtttcgctcttgttgcccaggctggagttcaatggcacgatctcagctcaccgcaacctctgcctcctcggttcaagcgattctcctgcctcagcctcccgagtatctgggattacaggcgcccaacaccacgcctggctaattttgtatttttagtagagacggggtttttccatgttggtcatgctgggcttgaactcctgacctcaggtgatccgcctgcctcagccttccaaagtgctggcattacaggcatgagccaccgcgcccggtccgtaccctgcactcttttgcatagacttcagtctttctttctttcttttcttttttcttttctctctctcttcttccttccttccttttttctttctttctttctttcttctttccttctttctttctttctctgtctctctctctctctctctccctcccaccctccctctctctctctctctctctttctttcttttttttgaggcagagtttcattcttgttgcccaggctgcagtgcaatggcgcgatcttggctcaccgcaacccctgcctcctgggttcatgagttctcctgagtagctgggattacaggcatgcgccaccacggctggctaattttgtattcttagtagagacagagtttctccatgttggtcaggctggtctcgaactcctgacctcaggtgatccgcctgcctcggcctcccaaagtgctgggattacaggcgtgagccaccacacccagcctagacttcagtgtttctaatctttattcctcagaggcagatatgaattttggacaaagttttggtccaattttggatgtttaactggacctttgggtaaagtacctttctccttcccattcactttaatcagaattatttatttaacaaattttattctagcaaacaattttagagaagaaaaagtagtactccataacaagctgctcttaaaaatgcatatctcattctggaaaaactaatagctatcatggttttaaacaataattttccattggtttgattatcttatgtccactgtgaaacaacagttcattattaaacaattcattatcaaacacacaaacacatatacacatttaataactttaaaacagtccatatttacatattttactttaaatatgtaatctgaaatgtgtatgcatatgtgtatgtgtgagagtaagacatagaccccggaagtctgaatttggaaaaaccctgtgaaagtctgaaaaaggtggttttctacaaaccttatgaaaaattaagtcatagaaggtcacaattttaaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacataatttgttttgttttgaaaaactgctcagcaaatgcatacaggtcataatggcaggtaacagaccatttattgaagtgctgaaacaaatagaaaacaaagtccaggacaccatcacagagcagtacttcccttgtgagatactctcagctaagtaagaattgagtgagacaacaataaaacaaatacccataggcttttcaaacagtaacaacccgctcagggttagcagcatttctagaccttgatggtacaatgatgttctcaacctttgctttcagacactggatcactgcttaagtagcctttatcttttccccctaatttttgttgaagatgcccttgaaattagattatatttgttcctaacaaagcatatgtatattgtggcatcactcttaaaaccaacaattgggcttagttttatgaagaaaaaaaatccaccaacctttcatgctgagatttctcatgctagttctcagcacagaagtgattttttttttttaagttgcataaagcctagcaaggtttaagttttcccagcaaggagaaagtgtttttcagctgttaaatttttcagatgctttttttgaatttggataaaactcaaaaacatgtttgttttaaaatgtaaaccttttcatgtacagaggtttgcatatagagaaatgctattactatgtttaaagatacttgcttttgaaataaggaggtcacatgcatttaaaaataacaaactgcatgttgctttatgaatgtcctattaagccctaacgtaaatatgatgttctggaggagcactgatgcacacgtttgctgataggatcacttacaacactgcttgtggatgtatttccatgtgagagcaaagggtggtcaggtttgaactgaagaacatccatatagtcagctaatatgctttttaaagaccttttacctcagttgcaacacacttctttgtcctaaacctgctggattactcaacttgttggctggactaaagctgacacaatacatatttcaagcacaaaaatgatgaggaacacatagggatgtcagcaaagaggcaaagaggatggtaagtcatcggaaggctggtcatttttttttttttaaacagttcaatgtctttactgttttctgtaatattatcattttccatttttcaaacaatggaaagaacaacaattagtttcatttttaaaattattagatcataaaggacaagtttaggaatattgtttctagcatactaatagatgaagttagttgtaaatcaatagtcttatttctctgttttaaaaaaatagcaaaatacagtattctgaggaaagttctgacagattggagtgttacaggatagtctgaaatctgtttcattatagaagtttggccaatatagagataatatattttaaatggcttaagtatatattttttgtggattgcacattctgtaagacggtttgagtgccttgagatccaagtctttaggtcaagactgaactctagaaatggccccatcgaatctacaaaaggatacattaaaaaaaaaaaaaacctcatttcctgtaagctgctgatgctactcaacagagttgaaactcaggtcacacgcatcctactactctagtgctgccccatttactaatccaaacgaggataaaccctgagagatccgttatgtttctacataaggagtgtacaagcttctcttgaaaatcattgcattgggagagacacagagaaataacagaggtgagaatccctccccgatttgcttgctaaatccgtattcattcctgaagatccagatcaaataccacctgactgttaggccttctctgagaaactctattttgcaggcaagtattggaacgactctatgcgcatctccagtcccaatgcatcctttaaataatctgtttcctctctgtttcttgctgcattacagacatctgtgttacacatccatccttccctaatagtcagtggactcttttaggtgaaggactgtgtctctatgtccctatgctgaaaggacaatgggaagagatggtgctattgatgcccagaggcctgggtcaccagggaagctggagtcacagcaggtttgttcagagggagtaaaccacaaaggaaatgtggctggtgatgatgatgatgcaaagaacggtgggggaaatctctggcctatgccttctactgaccctcttgccactcacaagtgtctcacaagcaccaaatccaacttggaatctagctgacatgggtcagccactgttgtagagcaagggtagggtgagggttgggtctgagggtaaacacatccacaatgtgggagcaggaagatgtctttgcaggggggtgtctaggactatggacttaagataacctcacagggtcaccatgccccagcatgacccagaagggcccagagcaaggaagacatgacaaaggagcctgaagacttgaggaggccttggagctgggacaaggaagacacatcagggatctacatggacaggaaactaaagatgaggtgggctctcagacatctcagggaatttgagctcagaagacaacactgagaagaccagacaccatagtgagtagactgtatctaactgctctccaccctcactttcatattgcatttggatggcactccaaggaaggggagaggagaccacctagcagaatggaggccaaatctgagttacctcatagataaggaaagaaggcctgtgatttttaatgggtcagtcactcttaaattttaagcaaactgtagattttctgaataggagaagatattatcttaatctacacaaattttttgttgtttttttggcagggtttaaaatatttttattcatgacttatagtagaaactacattttatattgtgacccagtaactgtttacacacatacatggatgtatgtgtgtgttctggaggtagaaagtaaccaatctgctcaaattttaaatattaagattattcataattctttaagtagtttattgtttggaaagttatagaccaaggtctagaaattcagcagacctctaacctctaatcaaggacttttaaaaattaagaacagtacctgattttctgatttagtctttgaaatgccagtgctattcattctttgccttattcactcataattatttattcattctccaaacatttattgagagcttactgtatgctttatactatagacctgcagcacaaatataggcctattacttcacagctgctttaggatttatagcagtactggtcagatagttcttaaaaaggaaaagttttcagagtgcaacaacctgttcacaataattcctatgtagcagtgaagagccttgacagcatctcttttactttctcattgtggttctagtttaataacataagtctatttttacttttcatatttaactttaattaaacatgctatgagtgcaatcatgagattttaataaattagactatttgaaaataattttcccataatgatgtcttcctcatatctttcatgatacacaaaaagaatatttgtacaaatattttgttgcttcaaatatgcagaaaactgaccattatttacagtgattttgaaaataaatgagtgaaagcatgcgaacttataaggagagtaaataagcagcacaccattaccatctgagacagcatggctgctcccctcttggtgagggcagtataggtacagcaagcagaagacagatcataagtatttactatcagaccttctttaagtgaatatgtcctattccagtagaaagtatcatataagcatacggcctgaatccaattcaattatttacatggctctaccagtaaatggttaacactgtagaccagaaatttagaaaatgcagaagactgaacgatatgtaagtgactgagaacatgagtctctctcctcatcatgtaggacatgggtcgaggtcatagacttaattggtaggagttgctactttcgaagagtgaaatgctttgaggcttttaagagaattttaagttgattaactttttatttgggggaattatgatgtgagctttattaaaatatcacaattcggcattgtttcataaacataattataggccaccttttcaaaaattgcaagagtagtactaagaaggtcctttgaactaaggttcaaaggaccttcttagtaactcttgtaatttttatgggtacagttagttgtctgcataaagtcattccattttccaaagctgcttactctttgcacaaatgacaaattggcacatgcacaatggcacaggaaaagaagtaactgctaaggtcacatatgtgaggacgttgcagcctttaagtactggaggccaaagttaccagaaacatgggcagacagattaaaattttcccttcttatgtttgtgcattgtttctatatggaaaattacatttttctgagagtatatgtgtaaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccctggaccacagacaaaggtaacagtagctgatctagaagtaatccccatataataatataatagctcaggtcttaaaaggaactttgatcttttaaatttgccaatgccgattgttgagacaggaaataaaggattgatttggtagcttttggaagatggtaaggactcctgcatacagccagtcctgactctgcccctcctgggtcactcagtctattttccctggatccgcatgctggtctgaaagtcaatgcagtctgccaaagtggtatactgttcccatgaaataatccaactgtggtatggagaaatctttttttcttagaccaagttatttttacaaaaatacttttgcgaagaaatgagaggaaactaaaaccctacacaatcctagaagtggattactgtctagagtgcatgttttttattccatcttataaagcctaactcattttagggtggctagtgcagttaaggtgcagacatctcttggttgtttttctggtgcttttacttgcatgctttcctgtttccaaatctgcatccatattgggggttacccacagagagctgttgtctcctctctgaagaacatctccatcttttggtcactacttgagtagagatgagtgatgcttaatgaaatatcattttattacaacggtcaaaaattatggattcatttcttattagattatatgctctgaatgttcaccaccccccaattcacatgttgaaacttaattgcccatgtgatagtattaagaggtggagtctttaggaagtgattaaatcatgaaggcagagccctcatgaatggatttgtgcccttatataaaaggtgtgaaggagctgtctctctcccttttcctcttccaccctttgccatatgaagatacagcaagaggtgcgatcttggaagcagagaggacttcaccagataccaaatttgcaggtgcctcaatcttgaatttcctagtctctgtaactatgaaaaataagtttctgttgtttataaattacccagtctcaggtattttgttatagcagcaaaaatggactaacacattaggtacaagcatttatttgacatttaaatgtaatccctcattttctaagaaggaataagccagaatccaacatcaaaatgtttcaaaaggaatacttcaaagtgttttagctgtagttctttgtcgattaaataaaaaaaaattccaaataatggtggtcagtaagagtgtgtgtgtgtgtgtgtggggggggggggcggtgtatgaattcctgtgctaagattcagatctttgaaactgttttctagaatgttatcctacatgtctaaaactttttttctaagtgtatcagagatttgggatggagtggtaaacacataggttactaggaggtggcttgcctctgtacccattctagatgagtaatgttaatgactgatgataatgtaatgatgaaaaaattggttctttttaagtaaatagatagtctacagacaccctgtcaacagatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaaggttaattttaaattagaggtgagaattattcttcatgtatcaaaaagcctagaaatttaccagggattaaaggtagaacccattttagcctatcgaagtgtgagaggtaaggtgacctgtttagatgaatatcttgaaatgattctctggagcatgcctgatctgttctcaatacccacacattagaagaaatgaagaataatatagagactacacaaagagaccatgtaaaagaagaaccctgataaaagaaaaaaaactcttaattttatcactgcaaagacttcttgtacaagatgcctctgcaagtgtcctagtagcatgactccttaaacaagtaggatgcgtgtatgtggaagatatatatatgtatatataacatttaaaatctccctcgaaccccagcttctgagtataaactatgttacagaagcatgtggataatatgtgaagctttctaggagcatcattaagaaaatgagacatttgacactctgagccctaggtacactgagtcagtggcatggtctccaagggcactgctggcagcactaaagcctggctcataaccatatgtgcacacctcaagaggtgtttgactgttcaggtagaggataagccatttcctaggcctggttccttccattctccttagcttgtagttggcctgaagggacttcctagactctaacatgtttgcctctcttttgcttcctttctggacactgtctaaggatttaaaacacacatgactttcatgtccacaattttctgccaaagagggggaaaaatgccccagagcatgtcatcccttaccatctgcaaatgaacttctgtggtcaaggaatgctccaattaccacccagaacagctttgtacaactcctgaccctcgggaagactcgaggaactcactcccagaacccagatgctccctgtcccagaacacagggaagacgccctgtcatcacagtttgcacggcagaggcggaggtgatgctgttagtgtggtatttccaattctctagcgtctttcactttccctgaagttgctgaagaatattccatttcattaagtatgtagtaatacacatgggaatcagagagcggggaaagatggaggacgttgatgacatggcctctagcactttatttatgagaacatccagaaatctctatctacatctgggagaagaataatgtcaatcctgccctggagacatggatcaggcaatgttgccagtgtgtatttttcccttcccaataatttactgattctggagtctaaggcagagcgctgatgataatttttacattcatgtgagtgagcctggccctttgagggctggtgatgccaaataaacataaatgtatgtaaccaggtgaatacttaccacctcccaacccagaaatgtcataggtctctggtggtgctttgcttcccacaacactcccctgaagggcggtgagggtaggtgttgccatcagagcataagaagcagagcttgaggtggccttggaggacttcagggagcactgcctttgcagtaaagaatgagactaagcaaacaaacctgttagacggctcatttgtcttttccaatttttttattgtgttattcatcctttcatcattgatttatagctattcttaaaatattagggatatatcacaaatatttttcctagtttaaaaaatgattttctaccatagtaatttttattttcatgtaataaaatttaaaatacatgtattttttaaaaagttttcaggctttggttttatgcctggaaaatgcatctcatacctccagtatgaaaatattcatgtatatggcaaaaattatcactgaaaattacagaattagtgaggatgcagagaaatgggcagtctctttttttgttggtgaagatattaaccaatgctagaggacagtttagtaatgcattttacttttgcagttccactataattaattgatcctaaggaaataatcatgtaagtgtacaaacatgtgtacatatgcatgtgcatataaagacagttattgtggcattgtttagtaagaagaaagttccaaattcccaactgtccatcaataagtgattgagtcaataaattatgcatatactgaagtgcaacgttgttgtcaaaagataatgtagatctatatttattaacatggtaaatgactattacaatgttaagtgaaaagaatagaatacaaaacagcaagtaacttctcctttcagtctggaaagagaaagacaaagagaaagaaaaagagaaagataaacaggactgtatggaaatataatatttcctaagttattaatagtgattatctctgggctgtgagatttcaaaggaatttaaccttgctctttataaatactatcaatgaaacaaattcaagcaaaactaaatgtatacttttttagaattaaaaattagaacttttattttgggggaaaaagaacttacctaaaacctgcaataaatacttaaaaattccaatatgatcttcagtcattagcaattactaactagctctcttagtagggtgacatcaatgtctgcctcaagtttcccccaagtttgacactttgagatgtacatcatagttcttcccttaaagaattttaaaatataaaatttcaagtagtgaatataacccaaatatttttatctagggcatggttaggtaaattctgggggctttatgtgatattattcagatgttatagtgctatttataaagagtttttaattataccaggaagtatttattatataatattgaattaaaatgggatacaactgtatacatgcaatgtatgctcaggcatgttaaaatctagagaagacactagaaggtgatctaaaaaattattaataatagttggttctgtgtagtggaattatggatgtttcccctttactctatactttctaaatatttcacaataagtgtgaattatagaatcataaaaaaagtaaatattaaaaaaaagctgttttgctcgacagctgccaaattttaccccagatgtatcagcaatttagcttttagtcaaatgaccctaacatcatttcctaaagggaatatcacagaatggaatgtgcccaaataaagataagccatcacggccaccacctctttctaagctatcattttataatgcttaaaataaatctgagtaagggatctttcttctgttggaagttataaacttccacctccttcagaccctctccatatcttctcttgcattaccagcacctggaatttataattaacctatagtaccctggtacgtttctaggtctggaagctgtttttggaggctgatggtgtagatcaccattagggatggaggattatttattcattttaaatgggagttcccttgaataacaaacagggatgagctgctatataagatcttgtgtagttaatatgctttcttacccttcttatatatatatttattgattgattgattttttgagatggagtctcacactgtcgcctgagctggtgtgcagtggtgcgatctcggcttgctgcaatccctgcctcctgggttcaagagattctcctgcctcatcctcccgagtagctaggattacaagcacccgccactatgcccggctaattttttgtatttttagtagagatggagtttcactgtgttggccaggctggtctcgaactcttgacctcgtgatctgcctgcctcggcctcccaaagtgttgggattacaggcgtgagatcccgtgcccggcccgcttccttcctcttctttccatccctcccttctttcttcccttgttccctctctcacctgtctacactcctgtctccagccctcttaaataaatagcttttctgtagtgttagatgccagctcttaacatttagagacaattcacactataccaataccatacttcaagtagatgatctaattgtttctaaatcatcatattttagcaaaaagataatgggagaaatcaaagttgtctctcacatatgtatgatgcatactagaggcttggcaataaggcagagagtagatattttttgagaaagtaaataacaaaacaaaacaaaaagccaaaacacaaaaacaaactgggtattgtgaggacagggcagagggaaggagcaggcataagaaagaaaaggaatgacatcggtctcctggtccttgcaaaggttattcaagtccctgttcctggtgttttggaccagatatcagcctacaaaccaccctggactgtgagctatttgaaggcatagatggtgtcttactcacctctgtattttctgtaccaaacacagtgcctgatacaatatactcaacagatgcctggagaatttaactaagccctttcactgccctttcttactggcctcagctagaaccaaaacaagaagctaaaactcctaatgccacaaatgctaggtgaaaccctatcctaattcaaactcatttcttctgattttgcaccttggtccccaaactgctggagaaaatcccatgacagagcagataggtatcaacatcaacccaccagactcacctgcaccttccacactgccaaggagagtcctactgtatttctctggtcaacttgctgtcccatttgtctcaagaacgatttcaaatctctactttccttaaatctcttccccgcttattcttagcaggaccttgcccctcagtgcccatcacttgggaaacctcttaacctttcagtaccaaatctacacgtgggcttgcatctgctcctttcctttactcctcctttcttacaaaaatagaagatgtgtccctccttccatctctccacttgtactcaggattccatctctctggccttatcagtaatcttatactgccagtcatcctatgctcttctctcttctgcacattggatctctcctctctacggtattcttcccatgaaaatacaaaaaatactagtgtttccatgcttttccaaccttcttttgacctcacttcccccctcaagatattgcagtagctcattttcctttccttcatagcaaaacttctgagtggcccacatttgctgtttcttcacttctcattctctcctcatcccattacaaacacgttattgttttgaccacttcaacaaaacagcttttgctgaggtcaacaataagctcaaaattaatataagcaatatatatttgttagtctttaacctacttgattgctcagtaacatgtcacatcactgaccactacctttgaggcactctcttggcttctgtgcctatgttttctgattttcctgccaccttcttggtggctccttctgagggtattttatggcctcatttttttctaccagcggattaaatattaagagctcttcaagtctcagtttaggtcttcttctcaatctaaccctgtccctaggcaatgttattcatgccaacagattcatttaccactatatgtcgattaccctgaattcatgtctccagccttcatgttacttctgaattccagttttatgtatataaatacctgtgcaatatgctcactatgtatctatccaaagtacctcacactcaacatctcaaaaacagaacttacaaacttctctccactccagtcctcctttggtgtttcatgtaactgtgaatggtattatccttcatatagtttgataagccccaaaccaggagtcattgttgccacttctctcttttatttcacataaccaaccatgaaaaagtccaggaatattttacttctgaattatctctcagttccatcaatttcctcccatttccactgtcaatactctagtctgcctcttatgtggtctactggaatagctccctcactggtttcctcatatccatttttgatccttccaaattatttaccaaagttaagctaccttgatatatatttttaaatttttaatttcaagataattttagattaacgtgcagttgtaagagataatacagagagatttgttattctttttacccagttttgcccaaatggtaacattttatataactgtagtacaatatcacaatcaggaaattaacattggtgcaatccatctgccttactcaggtttcatcagttttatatgcacatgagtatgtgagtgtatatttagttctgagcaattttattacatccatacactcatgaatactaccacagtcaagctacaggacagttccatcacaaaagatcccttgcgttatcctttatagcaacactcacctccatttctatcccaactccctaactttgtcatccacaagtatgttctcaatccttacatatttttttcatttcaagagtgctatatagataagaatcgtaacagtacatcatcttgagattagctttttcacccaatgtaatacccttgtgattaaaaccagttattgtatgcatcaataatttattctgcttagtgctgagaggtattccatggtatagatataacagtttgcttaaccactgacccactgaagaaaatgtgggttgtttccagttttgggctattacaaataaagctgctatgtacattggtgtaacataatgtacaggtgttgtacagttatgtttccatctctctgggataaatgccccaaagtttacccttttaaaaaacaacaatgatcatgccacagtccttcttaagtttgctcctctactgtccttaggataaacacaaaaatccttaacatggcctaccaaggacctgttatcatcaggccttacgtatctcttcaacctcaacctgggctgctagtcacctttttctctctgtgcagctctcttcagggacttcatgctgttccctctgcctggaatcctcttccaccatccatccttactttttgtttttaaccttcaggtgtcatctcaaatgttactatttcagagaagcttctcctgaatttccagactcagttaaatcttcttcttttatttgcccttagagcacatggtacttttattatatagtggtaagcacaatttgtaattacaagttatattgtgagaccatttgcttagtatctgtcttacattccccagattataagctccagaaggagagagactatgttaatattcctttattatatatacctttagtatttagtagacactcaactttgtgtccagtaaaatttggctgaggcttttaagacatagtcctggaatcaagttctatctctaccatttattagatgttcttataaaataaatcaaacatgttaaatctcagttttctgatctgcacaattaggattatagtagcatctacttaatagggtagttttgaaggttaaatcagatagccatgaaaagtatttagtccagtatctaaagcaaggcaagcactcaataggtatttcttattgttattattagttgaacaagaaactagagtttttgtattttttttcctaactaggcttttgtccattatcttcatttcttgcctgttcccccaggttctgattcttgtaacttttgagactctgaaaaggggcccttagtttagatcttggataaccagtaggactactggttcttaccccaggtatatgctctcagaccagatgtggctctggttcccattttcatctcactcagtacttcctcctcttgttttccagtctatggatgtcagtgtgggtaagaatgcctcttccctactcctagtttccagatgttttctaaacactgctttcctcttgtctcattccttataattccccatggaggcaaagtatcccattggtgggaaagcccttggtctatatttctcaggtaggtagaactgatctatccaaatttgtaagcacaggagtttaacctctttgtccttccttttctactgagactatcgggaggtgatgacctggaaagtgttgctcatatgcagatccacattttcctgtaagagagcttttgaaaggtttgactgaagggaagagagtcagcaaacccatttcctctttacactaagctatgctcttcaaccaacctttataaaaattttggttccctagctatcagttcttttgtcttatttttcaataggtttagaattcaagtggggaaaagtgatgctatttatgggccccctcgaagattccaacactttggtatatgattttgcttggaatatgattctgtttctcttcatcttttttacattttagccagttttcaagactcagctgaatcagttttacatgaaactttctagcctgcaaggctctttcatgaatgaaaccctatggtacttcctggactgtatcattccttttggaacttagtcatttattatcttatgtgcatacacaacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagaggttgtcgcagtgcagtggtgaaagaaagaaaaggttactatgggcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagagggaggtaatattcctggctatagtcgattggtgttcagagtgttttgattctctgaatgagtcaaaagattgaaaaaaaaatagccactcttatcactaggaaaagaaatgaggaggaagggtcctgaaaatggtgtctgagcaatgaaagacagtgaatattttaaagatcacaaaatttaatttattcaacctaaatgcataaaagtacaggtggggacattatttatgcaggtatatgcaaatcactttataaaataggcaaagcccttctgctttttataagttgccaaggtggttcctgatattttaaaagctatgcacctttaatgtaatttcctaagagttggaatccctctgtcgaaatcatagtcattgtcagagcaagttgatttttttttttcctatcctctgggacatttacaaggatcttataaccatcacaaaaagagtggtttccacagagatgtgactggaaaaatcccttggaaattgctgaggagcaagtcacagtgttcaaagcaaagaacataggctttgaaaacatgaacccatctgacctcttgaatttagtacagtgaattcctgagctctgaaacatggggcccggctgtgcatgccatattggtgctataagactggcagtaggttggctgtggcatggtctatttcaaactccttcacagtgcccagtgttgcatgttcccagatgacatttggttggcagaagctgggcttccaaagctggcagcctggaatgcagcccactgtgttttgacaaacacataattgaccatctgatcaccagcctacgttctgcactcaggtcactgggggacctgggctttcaataggtccctactcctcgtcttgttcatcttcccaaacctttctccagaaagcaatatagagaaggcttaaacacacccacgcatatcctcccatttgcaaaagagaacatagtacatgaaacataagctgttgaaaatttcctttaaattgtcctggcagcccaaagtgaacaagagaaaagcacacttatggtgaactctaattcagagagaaggaatgaatacactgaattgtttcaacacccggctgtgcataagttgcaattcagttcaatggtttggaaattttgcttagaaaaagggagcaatgagaaaatgataggaaattggggcattgattgactttaggggggcattatttagaaactgtttcattttcaggtgaaagaagagacaagcaggacactgggaatgtcttctccttatctgcctgctcctccctcacacccactatgggcagtaggaggcacgcgagcctggtgaccagggggcagtagctcaaagtgaggtcatattcaaattgaggtctttgctgaagatcccataaggatgtattttggtctgaaatttgactccacacaatgtttcagcctttctcctagaaggcaaagattatgcaataggccaagatatgctggaattacacaaaggttaatgtctatttcaacactaccaaatagcctctccctccatcctacccctactgcacagttcaggcctttggcttttacctttgacctggtctccctattctgagtcagcctctccactttcaccaagtgctctttctaaaacatacatctgcttacaattcttcaaagcctccttgagcctgcaggatcaagtccaaactcctctgcacggcatacaaggtcctccgtatggcaggcaaggtcccctgcctgctttccagcccaatctcatactactctttcaaccaccatgtttcaatcacactgaactattcactcctctgaatctcgctgctacttaacgcctcctgattttgtaaatgctcttacatttttcttgattatgatccccttttctttctgctctttcatatctacctggtaaactgcaatttactcttctgactttaagacccagcctggtcaccttaccacatccaagtgggcactcctccttcattcctcttactacgtcttgtatatacctgcatttcagtgcctatcatatgctatagtctttattcacttatgtatctcccctatcagactgagatttctaacaaaagaaagcatttcttatttatcccggagtttccagaaccaagcacagtgactagctttccataaatgtttgttgaatgaaaactaaataaagagctgtacatgataattaatcaaaacgaagccaagtagtagtgttagcttttataagcatagtaggagcccattagcaatctaatgaaggcagaagatcccagcagtaaggcactttctgatgggtatggcaggggctggtgactggctggggtgacagtaagagtgagggataaattctgtgatggaggaaggtctttttaacagagactgccactaaggctgtaaattaacacccttttcaagacttaatattcaatactgaaagatattgtcctgagaataaatctgaatctgaattgtatagagacctaacttataagaaccaagtttcccaaataaggtaagtctgtgctacctgcttcaaggtagcatggcagattatggagggttcctctttgtttctgctaaacagtaatggaatgggaaattcttgggggaacatctgagagctcttcagttcctattgaaatccaggtcaaatacagattgtgatactggactaaatgcactgctaagagaagatcgaacaagcagaattctgtacctgtttagaggaggccattgaagaggcacttggagtcaaagcactggggagataatgttctgatctgttctcaagggacattggacatttcttttccttttgtcgagcctctggggcaccactctggagccatcaaccatcaactgtgtctatgggatacttgaggacagtaggactgtcataagcccggtcaccctgctgatatgagggcagcttcaagatttggaacaagccaagcaaacatgaagcctggcccagggatggcacaaggtcatgggtatatgaacggattatctgctcattataggtcactcccccagccttatgtgtggttaaaaaataggatatctctagaagctatgcaactgatggctgatgtagcatagaatcagatttgcattttcctatgagccagagacagcctttcaactacactttttatctcaaaagtctcccccttgattcctaattggtgacacaggtcccctgtactgcttgtgtctgaggctcgccctatagcactgacgtcacaatagctgagccgtgcgggcaggagtgcactgtgctgactcatcccggtgatgtgaggattaatgccttgtctaacacagagctattatgtgaactgtttttacacaaaagaactgtaacaaaaatgatttgccagtcagaggactagaaatatgcagtgctaggtaactgaggggagggctgtgcagatataaagtggtaaccataagcatgcatattgacatcctccaaagcatttacagacccactctatcaacactgaaatagagaataacaagacttgtcagggacaggtaggacccacccctgttgtataaatgcattacacacagctccagtctttggggagtttaatcaatctcctttctctgtcaaataaactgtcacgttacactttagccttagcatcctttggaggattctgcctccctaaatatatttgccactatcttctaggaatgttagtggaaggcacgcataaacaaaatagccatgggaacctccattctgtgcaaatgattataatacaagaaataccttggagtgaagagtcagtgaagcaagatataatgttgtgaataaggaacagagctcaccagagagtgagaagcagccagaggataccgataattatttatcacattaggtgactatcactacctgtaggatcttttgggtggtgtctcttataagtgactttgattatttgggttcattggcctagaatctttttcaagcagttcaaaataaaatttatttaaacccattcagtgcagcctggtttgaattttaaataatgaacgttctcttttttttcatataaaatcgtgtttttttttccccccgaatacctttccatcttttctaaaaaagagtggtacctttataaaccttctggcacacgtgaatctgggatttctttttttcccctgtagacttcataattttgcacaaaagtttagtctatttattttacagtcttgtacttcttagtaaagggatattagaaattttgtcaataaatgaaagctctgatctagaagttaaaattaaaaactattggacctagggatgggtacataactgaagaatacataattgcccaatgattgacaggggagcaaaagcccaactgttgctggtatttggctgaataatgtaagctatactttaaaagagcagtgacttttgcaaacagcagctgcagccaagtaaagggcagcctttatagaagtacagtatctgggccactggtattttctgcaccctcatggatagcaacttagtattaccaccaacagcatacactccaaacgcaaaagaaactaatacacactacagaagcactagaaaccacaacaaagtcaactaggaaatatgccagtgaaaaccacaatttcctaaatctgacacttttttttttaaaggtaaagaaatcacttttacttacgtaaagagaaggggcaggtcacagactgatggtcaaagatctgaaaatcaaagaaaaaataaggaattaaaagcaaaccgatatatgatgcaaaaccaatatataaaagcaaaatgatacagtgggaagaaagaaagcaaatctaggcatagatgggactggttgttcctaaaggagcctattttgtcacttctagcctcaaaataaaggagacccagcttcataaaaactttctaaaggtatgaccccctgctatgatgaccaagacagtacttcccagcacaaggagtgcaaagacctttctttgttcatttcattctaatctgtatcatataggatttggtagagctatgttaccatttaacaaaatagccactagccacatttgtctatttaaatttaaattatttaacatttaataaaaagctaaacatttagttcctcagtcttgccagcttcatttcaagtgctcaatacccacatgtggctggtgactgccttactggatagcacagatagaaaatgtttctattattgtagaaacttctattgggcagcactgactagaataggtaaaagctttactatacagtacatgaccaattttagctaattttgacaaagatgagtcaaaccctgataaactttgtctcttttaaggtatatttagtatgtttaatgtccagaagttcctctgaacaaattcaatacattcgtgtgtagctaagaactcagtcctaagtttgccccggacttgccttctaaaactgcctctaccccttctcaccagcctagaatgtcccctctatggtggaaaataatctgataaagtgattttaaacaaagcttctctcccaccaaacacaactctgtttggtgatgaaaatttcagatgaaatgatgaaaattttagattttggagaagctgaccctaacagtgttcttgttctatgtttaaaatctgatatttcactctttaaattacaagccaggctaggcgcggtggctcacgcctgtaaatcccagcactttgggaggccaaggtgggtggatcacttgaggtcaggagttcgagaccagcctggccaaaatggtggaaccctgtttctactaaaactacaaaaattagccaggcatggtggcgggcgcctgtaatcccagctacttgggaggccgaggcaggagaattgcttgaacctgggaggcggaggttgcagtgagcccacatcacgccactgcactccagcctgggtgacaagagcaaaactccgtcaaaaaaaaaaaaatcacaggccaaaaaaaaaaaaaactattataggactggtctgcccatcattgtgctttgtttttttttctttcttttttttttttttttgagatgaactctccctctgtcacccaggctggagtgcagtggcacgatcttggctcactgcaacctctgcctcctgagtttaagcgattctcctgcttcagcctcctgagtagctgggactacaggcacgcaccaccacacccagctaatttttgtagttttagtagaaatggggtttgccatattggccaggctggtctcaaactcctgaactcaggtgatccacccaccttggcctcccaaagtgctggaattacaagtgtgagccaccgtgcccagacccatcagtgttttgatagcttctcttagaaggataaaactgaagtaggaggagagccatgacaaattaataaaccaaaaaaagatactgagaaaacaaagcaggtccccctacctctagcccacttaaatatatcaagaatttaatacagggtgattcaatcttgcctctctgacaccatgattttaacaacttcacataaggcctccagaaatatgcaaaacaaacttcactaaaggagatcaagtagaaggacctgattaagtatctttgcattgaaaaggctaaagcagaaaaccagcaattaaagacatcacccttcctggaaagtttctgggacaactgcactattgtagagatttcttcaaagaaatgatttccctttgtggtcaatgtgaaaccttgctcaagtacatgcaggtgtacttgatgcaggatggtgacaagacgagttaagatgaaaatctccagcctggattattataatgctaatacaagagaggctggagatctccaatgctttcaaattgtttcacaaaattcatgagtttaatgaaaattttaggcaagagaattagattatgtatgattcattgaaagcacatacaaatttgaaatatatatataacactgactagtcttcaaagattttaaagctctaagttttgctatattctagtcttctctgcaagccaggatattagactatggcacaggggcatattttcttaccattttcctccctccctctctcctttcttccttccctccctccctccctcctttcttacattcctctctctctatttctctttctttctttccctctccttttttgaacttgctgtcttctctaaccttggggagaagaagaaaatattattagcaattttctatgaaatatgttcaatgatcatttttctgttgcatgttataaacccaataactctcaacaatattatgctcttctaaaattatacctagtgtttatgttcttatatctaaacacataactttcttttctaaatttcaaggtgcatttattcataaaattagttaaaattaaatttttgatgtgatcaaaagagatcaatgtaagttgtacccaaattgactaacacatccaatgtctggaatgaaaaactatctttcctggatgtcaaatgacacacaggatggctgtcaatgataggaatccaaaatggagagaaaaattacagtgtgtatgtcacagtctaaaacaaattaaagccaagttagatggaagttttattggatataattgttgtacttatatgttaatataaaatgataatatgatcccaaacttaatagtatggctaaaaatttaatctcagagttcttacacaattcataaatgttcataggcatcaaaagacacctacttcttgactgaattataatctgctatgtaattctgagaatatgtattaatctacatagatttatatttgctcaattcaaattgttatttcattgatacatgctctttccacctaagtgatattcaccttatatgtctataagttgtttttatctgaaatgcaaagaattatctataaaagtttcacagaggattaaaaacatttgcattaagcacactttgttcaaagcataaatatatctagcaaagagtataaaactgtaaagcccaagtaattcaggacgttaaaatatcagggtggaaggtgggggatgagcagagagagggggatgacgaggggtgaagtttaatcttcgtattataatgtctgagtggaaattattatatagtgtcaatctccaagaatcaaaaatattattaattataactttaaagtcaattctagtgtagtttatgtaaagttctacagcagtggttttcaacattttgaagtgataccgatccctatgagaatctctttctccagaaaactcctcaaaaacaccaagtttcaaggaactcctagactccatgaaggccattcatgaatcccaggttaggaacccctggcctaggcagacaggggagaaaaaccctctttcaatcccatagctactcacctctacagagttttcatgaaatgctataaactaaagccagcagcaaagaaaatgtataaaaaagagttctaagtgggtaagggtatgtggttagagccacacaggcttctttgaaggcctgccagactcctaccttcctagtcctttataatttcttttttaaaaaaatctacaaagccttagcaacaatggagtagaggagtaccgagcagagagatgataatgatataagaatcactatctactgagtccttcaggtaccttgagaaataaatccttcccaaatttggatatgagtatacccaggaatgtgagcagtgtaacgggagtagaaaaagccacaaaataaatagtaaatacatggctgtcttcctggagggtcagtattccttgtgggcaagtaatttaaagtcttatttgcacacgtgttcatttatccaataactacttcttcaatgttataccaaaaagaaaacagatactgttcttgtcctcatggaacttccggttgagtgaaacaaacaagaatatattgaggagctgaaaggaaaatctgtgtatatattttttgggtgaaacctgagacttcactgaaaagtcttgtttgtggcagactacttcaagcaatgtcctggcaggcacccttagtattggatcactcactctaacttgaggatcacccaagtggaagagtttgagaagcatggttagcagtgtatcatttaatccccactacaagagaaaatactgttacttccaatttactagagaaaaaagagaaatttgagaaattaggaaacagctcagatcataccgctgctggcgtctgaataagtgtgtgccattccaaaatctacatatttttaaccactaaattacactacctttaggagtttcccactttatgtttccccttgaatctgggctcattcaggattacgcaggctagtttaagcttctctttggaagcagacaggtttggcttgatttgcattctaaatatttcacagtggtaagcgaaagctattattatacccattttatggtgaggaagctgaaccacttgccagctgaggtatctggctgggttaaaaacagaatctgggtcgtcagactctcattcctcttgactaactccaagcctaggcactattactgtccatgggcttttctgaacatgagattcacactgggtgataaagagtgagacaaattctgctaagagaaaacaataatagtgcaattgaaaaaaagggaaaataagtaatcataactcacaccaaaattggttactttcagcattgtgaatagaaaagggagagattattcatcacaaatgagtcagaaaattagaatgtgtcactgcactgatgacagagctgaggaatttggatgaactgaagtttgacacttatccttctagctgaagagggtaaatggtgtgacaacaggacagaaatgacctcttatttccaatcttaattaatatttccaatcttttttccttaactactctgtctaaaagttagatgggtttatatgtttgttttctatcggtagagataatgttttaacatccctttaacgttctagaagtattgcgttaattaattcttatgtgggagtcattccaaatagtaggatgatgatttttaccttattgattttcctaatacctttctggtttccagtgttttcaaaggatgaggcactattagatttttagatttatatgtctctcaaaattaagtgcctgtcaactgatattccatctttactctggatacatgatttcctttatctgacagattcaaaaaaatttgtactagatttaatgacatttcatgcatcttgaatttgggagtttttaattctctattttctatttggcaaaaggtttacaggagaaagccagatgcaagggtatttatatgtgcatacagaacctgtgccatcactctctaggtactttggggtttcctgcaggacagattcttgatgtattttcattccttttggtcaggaagaagaagactataaatgccacaaatggtcatacatatcttggggtctgctttccaaaacgcatattattttggatccgtctcaagaagaacaataagagaatgatactgagatctttttttcttaagatgctatgataacaatcctaaaaaatggcctgccttcaaaattttgatgatgaaataaggttataatcaataaagagagaagattttaaagttcagcaattaggtctgggactgcttctgcgcctgagacattgccaagatacaatgtaacactccatcccaccccatatgaatctccctgttccttcttgattcttacggggatagggtctgacagactagaatgaaatgaaagcagtagtgctgggaggggtggcaaggaccgaatttgtttaatacatttaggatggttttttattgctgctaaactagacacaattccttagcatgatgacattcaggaatcctttacaatctgattccaaagaactttctcttctatatcttaaactactgaaattgtagctctataaattccaaagggattgatgtaccaggacctttgacttatagtaaactgatcttaagggatgctgaaaaggtttggcactgctatcatgtggtctaatcatttagacttgtcactaccaactatttgcttaagagcctccaagacctttcacaatctggccccggcccacctctctacttttaataaaaaattttcccactgctgcttctttatatacggtgacagcctatttgctcttccctgaacatggcctgggacatctatgtctctgagtcagctaacggttcacacttgaatctcccaagcctagcatagtgtgtgaaacacagcacgacactccaatgtttgttgaataaatgctgtccgtctattttaggagacagagatgacagaagaaagttgttaaatcagtaaataaatagcaccagagagaggtcaaggaaaagttaattttagtgcattttaggagtgggggcaagatgagcttgaagattaggaaaactgatgctctttattcttgggtctagccaatgctatgagtcagttactttttcgggaacaagtttaaacctcaaggttaaatgaacacaaatgccctgtccatcagcatataatgaaaaagttgtggctatttccacatcagcacagtgaaattaaaatatgcagtgcctctctaagaggcatcacatatgacagagcttttaaaaatagtcccctttgccactcaggtatagaaagagctatagaaacaaaagcaaatgtttgaaaaactgagataatttagcttagggaagaaagagctgaggtgtgtctttatggttttttgactataagaaaagttgttacaaagaggataatgatcagcatttttgtcctagggcaaaatgacattaaaccgtccagtgcagaatttaagacttaaagatgaacattctaaatatgcaagtggtaaataatcaaatagattgctaagagcagttctgaaatttctttcttcctgactctcttaaaataggaaaaatcttcatctattttggataaaataaatgcagctctgcctccagtcaggagaatgaattcaataacttttctagtcttgtttaactctgtatgattctataaaattctataaaatgttcaccctaaaaattatacagaatcacaatacagttgagtaaaatacattctacagtttaaaaagaaataagcaatacagatagttgataagttattacattcaaaatagtaatatatggtgctcacgttttttattcaatttgccaagtgcatataacacaaataaaattgggaaaaatgtacttgaatctactaaggctttaacatagcgattatctagagtaaaacagtctaacaattaattctttcatgtctaagaaatttgctgaatatttcataaacctcatattgaatatgtatataaactcaatttccaattaaagaaaaagttttttgaaggtccagaaagtaatatatgaactcactattattatttcctggaccatcttcaaagacaacaggagaaccactaaacaattcctttaaatgaccaaaatgtgccccatatgattaagaatgtaaatctaataacagactcacagataaggtctaacaggggtggcaagttactggctttctttgtctatttaccttttagctttggagctcagcagaagtgtccattacatacagcacagggttagatgaacagctccaatgaccttgtctgaaccaaattcatttaaagcagtttgccacttttcttaaatagaagatgagtccattctatctatggcccagatttggactggatcactgaactattgcccaactcttataagcaaagcactaacatgtaccaatcaacaggcgaaggcatcaggaaggtaaaaatacacatacataagaaactggcagtagattaaagaagaaagctatatctaaagatggactttggcttttaaagcctttgagtgttattcgaatcttgttaacaaaaacaaaaacaaaatctgcattccaatgtaacttgtagagaagatccagtaaaaaaatgaattcaagagagagagagaaagaaatgtagttttattttgcaacccattatttccataagaacatgaatcaaagagtcagctatgccaatttcttcatagctgactagttataggatattgttctagtcttcactaatgacttcttgaggttggttattactgtgatcaggagttgggaggatagaggtctaagacctttcaaaagaaacgttttgtttagtatcactacagaaaataaagtcagcattaagctaactttgacaacctaactaggataatggttggtgcatgtagccattgcttatgctgcttcataatgaatggaacagtaaaggtgtcaagttaaccagcaacttgaattttgaaaagctgtggcacaataagctgataacataggttgttagaattagcaaaacttactttctgcttcccccaccttctagtcctacttatttccacatccacattcctatcaccaggcagttaaagaaacagaaacaaatgcggctgagactgcttctttggggatactcttagtgagctctccatctccccaaccacaacttgctctcagtttgctaaaaatatattcatttaattgttttaatgcctctacttaggggaatttgcattttcttaactgttgatacaagatctacattcagtttttttcacaggtaataagcaaagtatttggggagtgtgtgtgtgtgtggtggtggtggtggtggtggtggtggtggcaaattccgtcctagatgcttcgagttttccaagtatactgctaaaaggggtcatttgcttccccacctcaagaagccaattgtgcttatagttttacttcaaataaagatatatacctataaatgcacacatcatacgtgcacacacacatattcttcttctcaaaagtcataaacatttggtgactctctgtatactccatgaagtgctgttactactaaagtcagagtaatttaggcagaaacataagaaaccccaaatggtttgcactgaaattttattaacatatttgtcagtgttttcctcatggataatctccattggttcctggctccttgtcagcatatgctccaggagcctctcacaatatctttctgccctagaaatcctggcctgtgagatttccttgtaaatatctgaattcttgtattcacctattaatgatccagggatcgaggatgttttctatctgctccttaacctcccacttcaaggattagattgtaaacaacctagtgggaacccttcaggccaaaccacagctgaacgaatctcagcaggcagggaacccgcagcagtctgtgaaataccgtgaaacacaattacgaaaatataaagtattcacccatactttggggaagaaattatgttgtttccaagatgagacctcaaaaataaggctagtatcctaattgagaaagacatgattttaaaaagtgtcagcagaggtaaatttttaaaagtaccagatttgccaggtccttctcaaaccatagattcattttcagtatatgacagtggcctgagccgacacttcaagggaagtccattcatctctgaccaatgaagcccaaagtactcactgcatgaaagggttcctttcttgtttccaaaggcaatcaatttttgtcctagagtctgaaggttcatgggctttcttttaattttgtcagtctgcacatgcatggttcctcctgcatgatttggtctggaggaagtgacccacccacaacgccacagagctaattaaccccacactgagcttttttttttttctcatttcacacatccactcaatgctttaaatgacccagcagcagcatgatcatatgatttcttccccctcagtgaggaaagcatggtgatgggaggagcagggatatatctgccctaatcaaaacagcagtgtgatcctaaaatattatctaattgcattgcatccgagggtgcaaaatactaagaaatccctgaacgaatctctttcatgtcattcatttaacttcttgcagtgtccatttgaagtagcaaataatacataagaaacactgaggtagagaagtttgatctatactcagaatgtttaaaaaacatccgatcttacagggggtaaaagaccgagagctccttccctatcccgaatagcttcaagagaagggccttttttccatttgaaggaacagactcatgtttttccagatttattttttccaaagggaatgccttgaaaactctaagatgatcactgttttctaacttttcaaaaaagaaaaaaaaaagtgaacatgatggtggtgggtgatttaatggaatcagcttgtcaacatgatgaaactgaaaaaagcttttatagactctgtccacatgctaaaaaaaaaaaaaaaaggcaacctttaaagttatgtgtatagtatagagtggtttttgtcatggcaaagaaaagaaatataattatcttatgcagtaaatgtaaggctctgctaagaatctcattggataaatcatagaaatacatcctggccagataaatggagccagacaagttctaggtcttgtaagaagctttcaaaagaatcatcatattgtaagtctgtcatctctgtaagtgacaagaaaaattctaggctatttccctcggttctactagtaacatggcttcagagttttaaagatttagacttaaatggacaagaaaatgacttctgaatatcccatcttaggcaaactatcggatttctctcattcttacaagtaagtgtagcaaattggttcaccttggaaggacttggttagagatcatatatgtcttatgtgaacttttaacctctctttcctttgcaaagtgatttatgcatacactattaaatacacaggaattctataattcttagttcagtgaacagttagtacaagggaaaatctatctaatattttaaatttttgtttagtgtcttaaatcctacactttagaactggagaccttatagataagttctataaggtcttcagtgtgctgaaaaacacatttgctactgctccctaagcttctcttaggtaaggctgccaactggggtaaattgatggataaaactagctcaataggcaaaaaacaaaggtccagtgaagcacagtttatttttatttatactggtcagaaatatcacagttaacaaatagcctaaatcaagctcttatatctagggctccagcctttggctgaagtgtctcatctggtaattctgaaaaaaatagggttgttgtgatttcaaagactctcctgcccagtagactttttcaggctcactgatgcttaggattctaaagcctttactatggtctgttagaccaatacagtatgtcccttactatttctctgacttcatctcctaacattttcatgcaaaattggtccaacagacaataaaatagacagggataggaatatgaatggggactaaaaggaactaattaataaaaattagttgctttatgtccttgttaaatatcaactctttcatgacagcctaataaagtttctgaacttatcttgagagttggttaagataggggagaatatacaaagtatttccaacaccatgcattcattcattaattcaacaaatagttttcccgagtctattattgattactctgccaactggattctacttctgccctcaaggaccttccactctaatgtatgttttggagagtttctgtctctattatcactgacaggttattagcccactttagacaagttataaatataaccacctgccatgatgattcctcttcttgttctttatttgtttttattcatttgccctgtaacatccattaacctttcatgaatgacctgatcctttgtgagctatactatcaacacagctaatttttatataaatgagaaaccccttctccactcccaactaacttttctttctcaaacagccatgaaaatataaaagtctacccagaattatttaagtttttgaaatgagtccttacaatctgatctgaagcaccatttttttcctttcttttttgaaagagggaatggagcctcagcccctaagatacatatctcaagttacaggcaaattacacacaagttactggtctcccagacgtagtactcactactctctggggtagaacaatttctgcattgaacagaggaccataatctagctcaagtaatctcaatctcagagaacagttaaccaagtgcatatttctggtccctatattctcttataaggagttaccctctccactatattttggtattttctgaacctggctaccttaggtaaatgacagtggacatggtaaaaagaacactaactcttcctcaatttgttaaacttgtttttcctcctcatatgctttataaacaaaaatgggagaatttaatgtatgtatagagcagcaaatgttctctctgttgctttcagacatttttatcttatataaacagtggtgatgaaattataaataccattattccacctctatgttaatactcttattatcttgcatcaacagacgtgaacaaatacgtacatgacaccaatcaatcccttttctaaaaatgcagtttttgtatttctaaacagtggaggaagaattttatgaattcaacatgtagtttacctatttatattttgaattttaataaagtaaaaccaaattatcgcttatgttctttcacacttacatcagccattaacactctccatgctggcatggggtagggggtgtgtagaactaatggcaatgggtccaagtcccctgggtcaggtggttaggggcttggcaggctggagaggatgtttagatgctggggcaggatatttcaacctgcttgacaggtaagagatattttctggcagtaagaggaatattttttatggaacaaattgctagggagaggtcattttggggcactaggtgagagaaatatcaaaaccaaacctaaaagcagtctaagggaactcgggaaaagaaaatcactactttttcaatctcctcactggtttcccttattccatagtgtgccttctccttccatcttctagcacttcatactcttttctcctccatttcttcaggttttctttctcctacctctttattataacaaaaaaaagcatttaggaagaattctaggagacagggagacaaaaaaaaaaaagaatttagagaagacataataacatactgcataaatatgtatgtatgtatgtatgtgtttatgtatgtgtatatgtatgtatatataacagatattcgatttaccaagaaggataaactgggacttttgagatttaaaaaattcatggtatgtctggtcatattaatctccaaaccagcttgtttttagcattgctagagctataacagaatcaggagtagaaaacaaaaggaaaaaaataaaatttaacaaaggatttatatttgcaaaggaaagaggacttatttagagttgtttattgaaattcccccaaagctattttttgaacttatatattgacaacatcaagagaaggagcttaggaattctcatagggtttaggaactactaaaccttgtatattatgttcatctcagtccactcaagcaagtaaaggataactagaggatggtatctcacagtgcataacatggttggttactttgctaggctgacatatggagacagggcccataggagcagagcttttcttacgaataccagagagagacacccaggttcatctaaatgtatagggcatgagggattagtggtacagtgttatctgcaaagtacctaaaagtgttttctaaacaagcactaacttcttagcccagtcttcttggggattaaacaaaatccaatagtaagtaatggggaatactttatttggtcactgggttggggagggttgctgagacatatgacaacattcaatccattaagataggaggaaatgaggagaaagagaaaacaaagaaagggagagcgagggccagaaaagaagagtgtcacctctgtagactctctaacagaataaatcgataatcttaagaaaagtaaaagagcatgcctagagggaaacctcagcacacttttggaatccaaggcaaaaaataaaacaatttgcttcttgtcaagtttattgccattgacccatgggaggttcctatttattctgctcttacatgcacaggtatttcttctactcttacattcttttcctaaggattagcattctgtgataatggtggtaatgacagctgccttaaattagtggcaagttaggaatgaaacactgaccaccaggctatgttcttgaatccagtctatgccctgtaatgtgttcattctactttctgcattttctctgagacctgtcgcataagacttgttttgtaaggccgggctccttacggggacacatatggctccagaaaacaagtactctactttctcaccctgactttttggttttcttgttttttcctcttttctcccagactattattttccagtttcttctctaccagtctggacgcccatggttgttaactttagagatacccaccagctccatcaattccctcatctacagttctcaactgtatttacctagttctggagctcagatgaacccacatgtatgttctcctcagcttccaggctgctgatccttgctggagaaaaagcacaaaactgtacagcttgatgctcctgcagaattacggtttccagcataagttcgaatttcagaattagtttgcaattttaaaatttgctcctagtcagtttcctttttcactccacagtttcattcattactctatttaactggttataacccatcccctacccttcactctcagctagtaaccttgcctccttttgcatagagaaaacagaggccatcaaatggcacttcctatcactccacctttgccaccaatgaatccgcctgtaacatttcagagatctttctgcctagcactgataacctcatccaggatcttattatatcagttacttttcctttcttttgtattttcaattttcctactgcctgccaacatgctttagctgtcttcatttaaggtaacaacaataacaatgataataaactaacaaacaacaaaccatcttttgcagactttatctttccctcttttgtgccaccttcaagcttcctaagctcccgtttattcctcaaaccattacaatctggtttctctagctgtgtttctaattaaacaatttttttttttttttttgccaaagtcaccaaacacttctgaattgttagcttccaaaatccattcttcaacctcattgttttctttcttttaaaggtcaggttcactgaggtataatttacatacaataaaattcatccttgctatactcatttaccattcaataagttttgccttatatgttggaggcctgtaaaatgaagcccaacccccaagccgctttgcttcatatacaaatccctttggcacctctcagcagtcttccccacataacccattgtctggtgacaccacactactcagcattcaaggatatatgccatgtacattcatgccccttgtactttctttatgtttcctctctataaacatatatgtcttggtataacacagtaaatgctatttaatattaccacatcaatttccatatagaatcataaatctatacgttattttgagaagctgaggttttccaaatagaagtcatccatcaaaatgctactacctgaagatctctattattttagtattatgggttgattatgttcccttaaaattcatatgttgacattctggcccccaattctttagaatatgaatagatgtgtgaatagggtcattgaagatgtgattaagatgaggtcatgctgtagagtgggcctgcaatccaatatgactagtgtacttataaaaaagagaaacttaaacacagacatgcacacagggagaacatcatgtgacgatgacggcagagattggggctgatgcttctataagccaaggaacaccaaagattgccaggaaaccaccagaagctgggtgggagtcacggaactcacagccttagaaggagccgaccctgttgatactttaatcttgaacatctagcttctataactgtgagacaaaaaatttctgttgtttaagccactcagtttgtggtagttcgttacaaagccccagaaaactgatatactcagtaaaagaaaaaatcttcagtatattggaatcagttctttcactcatcaggtacttactgagtgcctactatgtgctaggaactgctctaggatattgaatgaatgactaagaacttcatcacgttactgcattttttgttcactaataagtaatcaatctatcaatcaatatattaatagatgaaatgcctatcatttattttatcagcaaacatttgttgagtatctcctatgtgtcagacatcgttctaggcacagaggataacattattggcagatcaagttctccaccttgtatagtttaaattccagtagagggaacatatattaaacaagaaaataagtaaataagatatgtaattttactctgtttctgacactgagagtcataggcatttatcctctaaatcactgaacaaagcttggaactagatagcgaacatgttacttcacagtttacaaagtaataaggaagacaatgaggtctcatactagaggcacgttaaaccacaggcagtgtgcaggcttaaagtgtttgggaaggacatcccaaaagctaggtttcttagtcagttcgtcagtcaatcaacacatatttcttttttttttttttgaccaaatttctctctgttgcccaggctgaagtgctgtgacacgatctcggctcactgcaccctctgcctcccgggttcaagcaattctctgcctcagcctccctagtagctgggattacaggcacctgctaccatgcccggctaatttttgtatttttagtagagatgggatttcaccatcttggccaggttggtcttgaattcctgacctcatgatccacccgcctcggcctcccaaagtgctaggattacaggtgtgagccactgcacccagccatttgacatgtattttttaagcgcttactgtataccaggccctatgctgaagatagtagaactgtggacagagccaacatggtactattacccactgagctcacattctaaggggaaaaatttgaacaacaaatctcacagtccgttctttatcatatatcctcataagaatacataaagggggttaggagatcacctgggtcagaggactggcccatgaggggtttccaaggggccttccttgaagatgtggtgcccggacactgctttagggctggggtatgggtattggtttgagcagggtcatgaagttttcggtttcttcttcctcatcccctttcaaccatgtacacacatttcaaatacttaaaagcattcttcaaatatactaagaacaccaagaactaaacacaagagaaggactctccagaggaaaggggccaaaaatagaagagaaaaaaaacccctaatctcaccatttgttttgaaaacacccaaaatgattaaaacatattataaactaaaacatatgaactaatcacttgccaagtttcatttttaaatcaaagccgttttgaggttcataaactgaaaaaagaatcttcaaatatgaacttgtgtttttcttttcttggccctcagttggcttgaagcatttgctgttatgctgtgtggagggaaggggaacctgctagttaggaacatgtggcatgcatgtactagaaggtaagctccacaagatcatgactcttcacagtggtatccctggtaagtagaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaagcctcattgcttcatcctcattcccttcaagacctaatagaactgcccccactctaaggcaggctcagagagagccaattttgccttttgtcctccctgggtcaacaatgcaattgctagggaaatcatctgaaaaagtctgtctctacaatgcaagtaaataatttttacagtacattggtaatttccctgagcttacctaagcatatatactaatttagtaaaattctcttgtttacaaactagtcatgtatctgcaggaaaaaaaaatctcctcaagttcaaccagtttatccatgtctgctcaggatcagtacatgactctagctttattcatgataaataagatcaacttcaagaattccatcaaaccccagtaatgtgcctttagagagactgggcttatagcatttcctctgccaccctccttgccctgcatattaaaatacaggtatctgattccagtttcaatggggaaacttctgtcgtgccagaggagggcatgcgctgatttccccactctgatggttgctctagtaatcttggtgttgtggcatgtttcccagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatgaaaaagaaaaagaaaaaaagaataaagatggaaatagaaagaataaagatgacttctctctcactgtttaacaggagtctctttaaatatctcaataatttgacattatatcagttgaatatgatgtaccccccacacaaaaatcagacaaaaacacttaaagggggtgataaatagggggacgtcattaacaatgcaaattgactcattccatagtttcttagagtaatgagtcaactgactacgtgatctcatgtacataattttgttcggcatgagattttgaggtatacaattactacagaaatcaaggtatacctgcaatgtaaagggtaaatcgtaggcattttaaatgaaagctggggataggatgtgtgttggtttgagggatgagtgggagtggatttaagagaaaatcagtctaggaaaatatcacataagtgtttgtaagttccttgatattcaggtctgtatcttgtaatgctttattaaacatatttcagactaatatgtccattgcctactggacattcatatctccctgtttttaaatacctttcaaatctgtatcttgagccattacttatctcttgacctctaaccctttatatcaaatgaattactagacaattacaattagatattccaaaagcatcctaaattcaacatgtcaaagctgaactcatcttttccttcaaactttctcttcctcctatgttccctatgtgagtaaatattaatagtattaccattcacccatctgccaaagttccatacctaggaagaatcatggttgcttttatctcaccttcaaataatcacccgtgcatatagatgtgcaatcctaataaccaaaggaggccttttttgaatagaaagcaatatttacagttaattgggttttgaactaatattaatttattaaacttacaaattttaaaagcctagttttctttacacctttacctgttaaaaacacacatatatttttctatgtcttaatatagcaatttttgcataaaataagaaaaattactttcaggaagggtgagattactagacaaaaaaatttgggacctcaaactatttcaactgtcagtcagaatgttaaaagaatgagagttagggtctgatctgggaacacctttcaaatgattttgccaaggtcaccagtagacacactgaatgtttttatagtcactctgaaaatgagaaattttacgtctataccctacaaaggaaaatttacaatccaggtcctctatgtttaagtttcattcttatctaactcttttataatcactttccactttatagcctgataaaggtagacaatattttgtgtctccactaaccaggtttcttgaatctagtgccctttcacttcataacgtttttcacatttctacctctctcatccccattgcaccacattagctcagagcatcattatctgtcacttgtaatattgcgacagtacattgtactatattttcttaagtttctgagtctttgcacatgtcaccacctgtgtctagaacacccatattccctgataaacatttactgaatgaaaaaaaagttaataaatgctttggatgttgctgctttgggtgctgaacagaaatagtggcctatctaagattctggataagcctgcataaagcactcttactttcaaaattaattttgaagaataagaaaattttgccatggagaatcatggagcctatgccacaatattatgttttgcatttaataaaacacctccaaacccagggaaagaatcagttattacttccttcaattcatacaacgaatatttactgaacactctctatgtgccaggctctgtactaggcactgaggatttcttagagcatagaacaggcaaaaaacaaacaaacaaaaccgaaaaaaacctcacaatcatggggcttatattccatggcaagaggaaataaatgtgtaaataaaatatatattttgtctgaaggcagtaggtgctatgaaccaaaaggggtggaaagctaaatgttaaatacagtggttatgaaaggccttacttagaagtgaaaattgagcaaagacctgaagatgataagcaaacaagccttatctggggaaaacatttaaggcggtcagaaaagcaagtgcaaatgtgaaatcatgcatggtaggctggaggttaggaagggggtcaatgaaggttgaggggagtgagctagggtggagcgctaaatgaagacagagaggtaatggggaaattgaatatggagggtcttgtgaactactgcaaaggcttttcttccaagtgagatgttgagccattagagagttctgagcagagaagtgatgtggtctgactgaaattacattacatatattgcaaagcatcactctggctatcattttgagaatagactgtaagtggtaaggccagaagcagggaagacaattaggaggctactgcaataatccgggtaagaaatgatagttgcttggattagggtagtagtggtgatgaggatgaggagtggtaagattctggacttattctgaaggtagagctgcaggatttgttcaatggttgggtttgtgagagaaatacaggtctgggagagaaataaatttttgatttgagtaaccctaaaggtggagcgttatttaccaatattggggaggctatgtatttgcttggtaaaataaggaattccatttctggtatgtcaagtttgagatgctcattagacagacgtggagatgttgaataggcagctgaatatgtgagcctagaattctgtgtaaaggcctggactagagatacaagcttgcaccataagcttgggtgcaaatattaagagagtgaatggagctgaagagaagagcttcaaagattgagctctagggccctctaatgtttacctgcttgggaaatgagaatatgctagcaaaagagactgaggaggagtagactgtgaggcaggaaaaaaatcaggagagtgtggtggactgaacgccaagcgaagaaagtgttttaatggagaatgaataatgggccatgtaaaacaattctgagacatcaggaaagacaaagactgccgaatggttaatggatttagcaacatggaagtcattggtgaccttagcatcaacagttttactagactggtaggtgcaaaagctaactagaggggcaaaagagaaccagagcataggattggagagtgtttatagtgactatacgcatttcttgagaagttttgctgtaatggaaatcaaagaaatgggacaggagctgctagggagtatggtttataagggtatttttaggatgagataaattatgtgtttgtatactgataggaaagttttgatagaaagagaaaatttgataaaacagaagaaagatgtgagctttttcaggagcactgtttatgcatgtgcaagaggagagagattctaaggcacaatgagggatgggctgagccaagggtacacagagtttatccatagttgcaggagagaaggcaaaatacatgggtacagataaatatgggagggtaggtgtgctggacagcaagtatttgtgaagttgtcttttgatggtttctattttttcagtgaagtaaaaagaaaggttctaagttgagcgtaaggatgggggaggaggtgttagaaatttgagagagggaaaaatatgaaatattcttgtacagatatggaagagtaaatgacaaggaaacatattatatttgctgggcagcattaacggcctccttgagggatcatgaatttaaactgagagtcatacatttgcttgtgtgtttttctccagccacattcagctggcacacaggcatgaaatagatggcgagttgcatatgatcagtatagttgagatttgtcaagagagcacagttaagtcagagaaggtcaatggtgttaaaggcgcatacaaggaaatgattaaaatcattgtccatggaatctacgctatataatgaagtgagcatatgagaagctatgggtaaaatcaatgaattaggggtcctagtgggtttaaggaattggtgtattaggggtaacaaagggattgaactaccaagacattaggctgtggttggaaaatggaatgcttgaaattgagattgtggaatattgtaattattagtaattaaaacatcagaaatgtagccatgggaatgagtagctatggcagagtggagaatcaatcatgagaagttcaagaaattgagaggaggtattagagggagcgtgtatttacacagtgaataaccaataattgtaatggggtagaaatggaaagagtgttagtgagctaggggctaacgttttcaaggaattgggaaacttgcctggtagacaactgcatcaagggggagttatgggaacacttagcttttctactacctcctcaatgtttcctctctctcactttccatctttccagcttatatactggcattacaaactttaatttcctagactagatagctacatatcacctgtgtctaccctttctcctccctatccaaattatctccaagtcttgagaatttccaatttttttttctgagatggagtctcactctgttgcccaggctggagtgcacagtcatgccatctcagctcactacaacttccgcctctcaggttcaagcgattcccctgccgcggtctcttgagtagctgagattacaggcacgcaccaccacacccggctaatttttgtattttagtagagacgaggtttcactatgttggccaggctggtctcgaactcctgacctcaaacaatccacctgccttggcctcccaaaatgttgggattacaggcatgagccactgtgcctggcctccaattttgaatactctctactctccccctttgggaccatcactactctagcctgtcactctctattttatcactcagattaatgttcttcatggcactaatcgctctctaaacttaacttgttcatttatttgtttgctttttttgttggggggggtgtctattttccttcattaaatataaatttcataaggggaaaagttttgtttaatttgtgcctggaacataatatgccctcaataaatactttcaggatgaattaataaatgccccctataacatgctgatgaatccttatattcttgggttcacacaacagctttgctttactatcctaccagcttctccctcctttcctgctcaaaccatccatttcaccgagtaaagtcatttcactactcccccaaaacaccatgttcatttctattcagatgatttcatcatatttctcccttgtttatgtctattccccacataccaattctttgagtcccagcttaggtcttacttctcggatggtttttctatgattaccatgaggcctgctgatttctccctcctctaaaatcctgctatccctaacaacaccagctgctttatattttctaattgtttcatatgggttattcttaccttttcactttaaaataggtttatttttggcctaaggatcctgacttacaactacagtatactcagtaaaaactaacacagtgtagggcagataacgggtattcaaaaaatactatggcctccttagatagcttcatagacttccatcttcctcaacaaacattttctaccttttaccctgctgttagctaaatctaactattcttcctgctctatgatactgtctttgagaccagaaccaacccctatgtccactacacagaattctacactcttgcactgcaattcccacagctaaatcattgtcattgccattattgttcctggattctcttggcaattttagtatattcaaggcatagctgccaagatcatcatcctccttgattgtttggaatctttatttttttaaatccctgcattttttccatcaaactttaagtgttcctgtgggatttgtttttccttggctccatccttggcctggttcttctccactttcttatgttcagtcactcgatttgccctttgtctcatttgaaggaatcagctttcacaccttcttttaaactaccttgcatatttagaatattttctcaaataatataaaatttataatatttatgaataaatgacacaatgccaagatattctgtctcttctttcaaataacatctgaagatgcacctgcactagtgagttctatatttaagatattgaataagtatcattcacccatctgctttcattctgtcctgcattttttaggacctgcttcagagttgtattttgaggtcttttggacggggaactgtctggcatagttcacaaactggcctttgctctgtatattcatgttcctttgataaataataaataataataatagcccactgtgcatttttacattccactcataaatccctggaaaaagaaaaactaacaaccagggattataatagaaacacagaaacaaaactaaccttttaccaggttttgctacagtaatatatacttccatagacctatattctaacaaataattacctgcttaagtcatttgtaaattgttcctttgccaacattatgtataatagcaaatgtctacgtggtttataggacagggaaaacaactagaacattacagctatgtgggggatcagtgcaaaagcagcaaaataagaggtttactctgttgggtgcacagtttggaagaattagtctcacaagtagaactacttgacagaatatatgcctgctctccagctcccccttctcccctcctccagatcttttttcaataatggaagaagacttactttcttttttcaaatccaggtgggaagtgtatcattttgcgtgaaaaatctgtttttctttgaacataacaaatggtctgattgaagctgctctatgaaaacggcagcatatctaaccagggaggtgggaactatagtttaatgggtggagcacctccatatttagctgcagatgagccacatttaactttaaaaaaaataaaaatttaaaaaataaaagaaggccaaaatgtaatgattgtcttgttactgcagtggccactagatggcaggtccaaaaatctgatgggagtctcacaggagggcaaatcttagggagcagaatgtttctggcactcaatccagtgttggttcatcaataagccttggcagtttgctaaaatatcaggtgggtaagacaatatccatgttatttcacagggctgaagggggcaggaagccctttggtatctaggtttgtagagtattgtcatcacatactcacacatccagatactgctacccctttggacttctgtccacagacattcttggagctggtttttatatatgttcagctgtattccattatctaatggtctgtgcaatactgagccataatctcaggagtgtaaaaggtagttgtctaatctgcctccatggaaacaaatgaaggaggctgtcaggctagggtaagggaacatacagctgtactgtatttaacaacatatatttaccagtaattgcaacttcatgttaaatatgtgtatttcctatactggaggctgaccatatattcatgttaattgttttgaaaaagagaatgttgatatataagagacttattatttaataggataaaataactaaggcctatgattaaaaatgaaatgagtaaatttagaacaaattatttgttgtacacagtagagttttcattttcttttactaggatgggagacttctagatgtgggtcttatgagactataaaaaagtcattcttggaccaattattctgaagatagattgtgtctttcccttcataatttttttttttttttggttactagattatcctgataaaagtgatttcactacatggacaatgcctacttttctttatcttttaattaaagaactgaccttatgatttttaaaagtagagaatcacaagctctgagataatttatcattctcactaaagaaaatgtgctctagagtcaaatttatctttgtacaagagctgtgacatgcattttgatatacatttaagcatctatgtcaattaaaatattataaaaataaaagcaacaaaaactcaattatagccatgcaactcagtcatcactcaccttttgttccctttttctttgaaaatttagatagaataatggtaaacatgttgatttcatctattcttgctctgtatatttggactgtgaaatgtctacatgagacacaggaagagggcacgggtcttcaggataaaaaacaaaaaaaaatttttcctaaagaagaaatatgggctatattgaattatgatagatgttttaaatcagtaccgttttcctttagtttggagtaaaatttaaaatgagatgactgaaataatttacgataaaatatcatggttatttctacatatttaaggtttaaaaatgctcaaacttatactttcctcatagaaagagcactggaatgggaaactgagaggtctgggttctattctggctttgacagtgactcactgtgtgacatccagagagcatgacctccccaggctcctcacttctgaaatgggagggttttgaggacaaagtctctctctgctttaacattcaatatccaagtaagtaaattgctacgtattgcagatttttttttcctcagaaatagactaatttcctccgatgaaagaataatactgttaagaagctgatgttgaaagctaacatgtccctaccaacactgtgggctctacccatgcaggtgaagctagagcttgttcttccttcaatcccccctttccctattctgcaccactcttccacacactcccccatcatctttaagtctaaattctacctgagaggtcctctgtgacccctaggtagttacttgctaattattactaattattcaataactgttttacttttcctcttgagcacatagctaagttccatttcccagccttctctgcagatagctatggccctgtgaccaaattctggtgagtgggatgttggtggaagtgacatacgctgtcccaggcctggtccattaaaagttcctgtgtaatcattgctctctcttcaccagatttctggctggatgtcacacccacagcaatcttggaagctatgtactgaagagcctctgtcaacctgggtccctgaccagtctttacatgagcaagagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaataaagtgtaaagtctttttctaaatgctgtatggcttgccttttttatatatttgtgtaaagaaattcgtagtagtaattctctgacactgagttaaaggaagtcctattttttttcacaattatgtgaaaacacaattatgtgctgtataatgacattttagtctacaatggaccacatatctgactgtggtcctgcaagattataagataactgaaaaattcctaatgcctagtgatgtcatagtgatcataacatcacagcacaattactttttaaaacataaatttagtgtagcctaaatgtacagtgcttataaagtctacaggagtatacagtaatgtcctaggtgttcacattcactcatcactcactcattcactcacccagagtaacttctagttctgcaagatccattcattgtaagtgccctataaaggcatacacttttgatcttttatgctgtgtttgtactgtaccttttcaatgtttagatatgtttagatacatgaaaacttaccattctgttataattacttacagtatccagtacagtaacatgctgtgcaggtttgaagcctaaaagcaataggctatatcatatagcctaggtgtgtagtaagctctatcatctaggtttgtgtaagtacactctatattgttcacacaacgatgaaattgcctaatgatgcatttctcagaatgtattccctttgttgagcaatgtgtgactacattttgaaaagttaaaataatactaaagggagggacaagtgaagagctaacttgagaaatctaagaactaggtaatttaaaagaagtgcttttagttacatagggtttttaacatcattaccacctatgaaattacaggtattaactactgtctcaaaatgatcatcgcccttttgatactttactctcagtgtcatggctgacctcttttgagtcaagtttattggacattttcagttttattttttaattctcatcactgcccctccctgaaatacttcatccctggtttccttaataatactggcctaatttccctattctctatctctagttttctctcctcttttgtttggctcctctttctcatctattctttaagtattagaatttcctagtgttctgctctgagtttttctttctctcataatttttccttgagtcatcttatctagtcttatggctttacctactacttcctcacaaataactcccgactcttgatctttagcccagacctttcttcggagcttcaaaacctgtattgcctatagtatcctgggcattttaagaaaatctaaatattttgtgccaccttaaattcaagtcccaaaccaaaagcactccttgccctttcaagtcaaaccttcttcctcctgtgttccagctcttggtagatgacatcaatttagaaacattaaactctccttttctttctttcttgtcccttatctaaattatctaattaagttctaaatcctgtagtgcttttatagtccatttgagattttagcctaagtttgaggactagataagtgaagacagattaaaaataagacttcttttaactcagtgtcagagaattactactatgaatttctttacacaaatatacaaaaaaggcaagacatacagcatttagaaaaagactttcatacccttccatcataccagagttccattatcagcctgaagagaaccaggagagctgtcctgagagggagctttctcacaatcaggactggattgaaacaaaatagaatcaatggaaagaaagatttttggggaggggagagaagttttgcttgctgctggtcctttggtaacctctgcaaaagaaaagtttaaaaaatgaccctggctggcaagatggccgaataggaacagctcccgtctgcagctcccagcaagatcaatccagaaggcaggtgatttctgcatttccaacagaggtacctggctcatctcattgggactggttagacagtgggtgcagcccacagagggcaagccaaagcagggtggggcatcgcttcacccaggaagcacacagggttggggaattccctccgttagccgagaaagccgcgagggactgtgccatgaggttcggtgtattccagcccagatactatgcttttctcaccgtcttcacaacctgcagaccaggagattcccttgggtgcctacaccacgagggccctgggtttcaagacaaaactgggcggccgtttgggcagacactgagctagctgcaggaattatttttcataccccagtggcacctgcaatgccagtgagacagaaccactcactaccctggaatgggggctgaagccagggagccaagtggtctagctcagtggatcccacccccatggagccaagcaagctaagatccactggcttgaaatccttgctgccagcacggcagtctgaagttgacctgggaccctcaagcttggtggggggaggggtgtccaccattactgaggcttaagtaggtggttttcccctcacagtgaaaacaaagccaccaggaagttcaaactgggtggagcccaccacagttcggcaaagccactgtagaaagactgcctctctagatttctcctctctgagcagggcatctctgaaagaaagttagcagccccagtcaggtgcttatagataaaactcccatctccctgggacagagcacctgggggaaggggcagctgtgggcgcagtttcagcagacttaaacgttcccacctgccagctctgaagagagcagcagatctcccatcacagagctcgagctctcctaagggacagattgcctcctcaagtgggtccctgacccccatgcctcctcactgggagacacctcccagcaggggtcaatagacagctcatacaggagagctctgggtggcatctggtgggtgcccctctgggatgaagcttccagaggaaggaaccggtagcattgtttgctgttctgtagcctctgctggtggtacccaggcaaacagggtctggagtggatgtccagcaaactccagcagacctgcagcagagatgccagactgttagaaggaaaactaacaaacagaaaggaatagcatcaacattaacaaaaaagatgtccacacaaaaaccccatccgaagatcaccagcgtcaaagaccaaaggtagataaatccacaaagatgaggaaaaaccagcttaaaaaggctgaaattccaaaaacccgaatgtcgtttctcctccaaaaaatcacaactcctcaccagcaagggaacaaaactggatggagaatgagtttgaggaattgacagaagtaggcttcagaaggtgggtaataacgaactcctctgagctaaaggagcatgttctaacccaatgcaagggagctaagaagcttgaaaaaaggttagaagaattgctaactagaataaccagtttagagaagaacataaattacctgctggaactgaaaaacatagcacgagaagttcatgaagcatacgcaagtaccaatagctgaatcaatcaagcagaagaaaggatatcagagatgaagatcaacttaatgaaataaagcatgaagacaaggttagagaaaaaagaatgaaaaggaatgaacaaacctccaagaaatatgggactatgtgaaaagaccaaacctacgtttcattggtgtacctgaaagtgatagggagaatggaaccaagttggaaaattcttcaggatattatccaggagagcttccccagcctagcaagacaggccaacattcaaattcaggaaatacagagaacaccacaaagatgttcctcaagaagagcaaccccaagacacataatcgtcagattcaccaagattgaaatgaaggaaaaaatgttaagggcagccagagagaaaggtcaggttacccacaaagggaagtccatcagactaacaacagatctctctgcagaaaccctacaggccagaagagagtgggggccaatattcaacattcttaaagaaaagaattttcaacccagaatttcatatccagccaaactaagcttcaaaagcaaaggagaattaaaatccttgatggacaagaaaatgctgagagattttgtcaccactaggcctgccttacaacagctcctgaagaaagcactaaatatggaaaggaaaaaccggtaccagccactgcaaaaacacaccaaactgtaaagaccatcgacactatgaagaaactgcatcaactaatgggcaacattaccagctagcatcataatgacaggatcagattcacacataacagtgttaatcttaaatgtaaatgggctaaatgccccaattaaaagacacagactggaaaattggatagagtcaagacccatcagtgtgctgcatttaggagacccatctcacgtacaaagacacacataggctcaaaataaaggaatggaggaatatttaccaagcaaatggaaagcaaaaaaaaatgcaggggttgcaatcctagtctctgataaaacagattttaaaccaataaagatcaaaaaagacaatgaagggcattacgtaatggtaaagggatcaatgcaacaagaagagctaactgtcctaaatatacatgcacctaatacaggagcacccagattcataaagcgagttcttagagacctacaaagagactttgactcccacacaataatagtgggagactctaacagcccactgtcaatattagacagatcaatgagacagaaaattaacaaggatattcaggacttgaactcagccctgggaacaagtggaccaaatagacatctacagaactctccaccccaaattaacagaatatactttcttctcagcaccatatcacacttactctaaaactgaccgcataattggaagcaaatcactcctcagcaaatgtaaaagaatggaaatcataacaaacagtctctcagaccacagtgcaatcaaattagaactcaagattaagaaactcactcaaaaccacacaaccacatggaaactgaacaacctgctcctgaatgactactgggtaaacaacaaaattaaggcagaaataaataagttctttgaaaccaatgagaacaaagacataatgtaccagaatctctgggacacagctaaactaatatttagagggaaatttatagcactaaatgcccacaggagaaaacaggaaagatctaaaattgacactctaacatcacaattaaaagagctagagaagcaagagcacacaaattcaaaagctagcagaagagaagaaataactaagatcagagcagaactgaaggagatagagacatgaaaaacccttcaaaaaattgatgaatctaggagctgattttttgaaaagattaacaaagcagatagaccgctagccagactaatcaagaagaaaagagagaagaatcaaatagacacaataaaaaatgataaaggggatatcaccactgatcccacagaaatacaaactaccatcagagaatactataaacacctctatgcaaataaactagaaaatctagaagaaatggataaattcctggtcacataaaccctcccaagactaaaccaggaagaagtcaaatccctgaatagaccaataacaagttctgaaattgaggcagtagttaatagcctaccaaccaaaaaaagcccaggaccagacgaattcacagctgaattctatcagagatacaaagaggagctggtaccattccttctgaaactattccagatcatagaaaaagagggactcctccctaactctttttatgaggccagaatcatcctgataccaaaacctggcagagtcacaacaaaaaaaggagaatttaaggccaatatccctgatgaacattgatgtgaaaatcctcgataaaatactggcaaaccgaatccagcagcacagcaaaaagcttatccaccacgatcaagttggcttcatccctgggactcaatgatggttcaacatacacaaatcaataaatgtaatccattatataagcagtttagagccaatgacaaaagccacatgattatctcaatagatgcagaaaaggcctttgataaaattcaacaccgctttatgctaaaatctctcaataaactaggtattgatggaacgtatctcaaaataataagggctatttatgacaaatccacagccaataccatactgaatgggcaaatgctggacgcattccctctgaaaactagcacaagacaaggatgccttctctcaccactcctatttaacacagtattggaagttttggccagggcaatcagacaagagaaataaataaagggtattcaaataggaagagaggaagtcaaattgtctgtttgcagatgacatgattgtgtattcagaaaactccatcatctcagctcaaaatctccttaagctgataagcaacttcagcaaagtctcaggatacaaaatccatgtgcaaaaatcacaagtattcctatacaccaataacagagagccaaatcatgagtgaacttccattcataattgccataaagagaataaaatacctaggaatacaacttacaggggatgtgaaggacctcttcaaagagaactacaaaccactgctcaaggaaataagagaggacacaaacaaatggaaaaacattccatgctcatggataggaagaatcaatatcgtgaaaatggccatactgcccaaagtaatttatagattcaatgctatccccatcaagctaccattgattttcttcacagaattagaaaaaaacaattttaaatttcatatggaatcaaaaaagaacccatatagccaagacaatcctaagcctaaagaacaaagctggaggcatcacgctacctgacttcaaactatgctagaaggctactgttaccaaaacggcatggtactggtaccaaaacagatatatagaccaatggaacagaaagaggcctccaaaataacaccacacatctacaaccatctgatctttgacaaacctgacaaaaacaagaaaaggggaaaagattccctatttaataaatggtgttgggaaaactggctagccctatgcagaaaaccgaaactggaccccttccttacaccttatacaaaaattaactcaagatggattaaagacctaaatgtaagacctcaaaccataaaaaccctagaagaaaacgtaggcgataccattcaggacatagtcatgggcaaagacttcatgactaaaacaccaaaagcaatggcaaaaaacccaaaactgacaaatgggatctaattaaactaaagagcttctgcacagcaaaagaaactatcatcagagtgaacaggcaacctacagaatgggagaacatttttgcaatctattcatctaacaaagggctaatatccagaatcaacaaggaatttaaacaaatttacaagaaaaaaacaaaccccatcaaaaagtgggtgaaggataagagcagacacttctcaaaagaagacatttatgtggtcaacgaacatatgaaaaaaagctcatgatcactggtcattagagaaatgcaaatcaaaatcacaatgagataccatctcacgccagttagaatggcgatcattaaaaagttaggaaacaacagatgctggagaggatgtggagaaataggaacgcttttacactgttggtgggagtgtaaattagttcaaccattctggaagacagcgtggcaattcatcaaggatctagaaccaaaaataccatttgacccagcgatcccattactgagtacatacccaaagtattagaaatcattctactataaagacacatgcacatgtatgtttattgcagcactattcacagtggtaaagacttggaaccaagccaaatgcccatcaatgatagactggataaagaaaatgtggcatatacacaacatggaatactatgcagccattaaaaaaggatgagttcatttcctttgcaggacatgaaactggaaaccatcgttctcagtaaactaacacagaaacaggaaaccaaacactgcatgttctcactcataagtgagagttgaacaataagaacacatggacatagggaggggaatgtcacacactggggcctgttggtggctggggggctaggggagggatagcattaggagaaatacctaatgtagatgacaggttgatacgtgcagcaaaccaccatggcatgtgtatacctatgtaacaaacctgcatgttctgcacatatatcccagaacttaaaagtataataataataaaaaaaagatctaatggctaaacctatagaaactctagctagacctgtggtttctattccttcctgggtataataataaaggctcacatttattttaagtgttacatttttcattgacattgaaatgagactcccttttcgactaatcggctgctttgatttcttcaccctaaaaatcactcttcaatgttttccacaattcttcaacattagtaataacttcctatatagtatctgtggtcctttttctttccccagtgtgatatatttatcatctattacacaaacttcctcttttgcttcctcccttttcaccaccagctctaacatcttaaattttcatttgacatactgcttacctaaattatttcatgtgtgttcccatccatggaaattcatttttgtgtgacataaatccctaccctactctatttcacagtaataaaactttatactgaattgccaaagagataggtaaccaaccacgcagtttaaattaagtgcaagatacacatgtttgaatattctgctctctgtctaagatgtgtagagacaggtcctgtttgtgtctgagcattctgtcatcttattcaaactgttggagttaaatcacctaagaactgttttctcactttgattcaaaagtaacttctgctatgcaaaaaaagcacagttatgaaataatatgtgtattaaaaaatctcaaaaataatgattagagtcacattcagtctgtgaaaggagtagctccatgacttgagcacatgccaatgagattagaactcatcgggggttggcattctcattgattgttgtccctctgtaccttcaatggtttccagtccttgtccaagttaacctttgctagttgttgtagccatggtaaatatcctgtttattggattttattagcgttttaaattttgacatttggaaaagcacaatcctccttctttttcatcctgtcatctttagtgtataagtgtccaggctccttccaattttaagtttctctttcctagctttagaagattataattttggaaagtcacaattattctgctagttggtggccagaacatatcaattgcatgtaacaaaattttattcagatgcatcattcatacattttaagtctcacggtttacttctttcataattatttgacatttttggtgaaataagtttagttctgaatcacccattttgttatgttgattctccactatttttggcgatacaatagtaataatgttagacatttgtatagcagtgtaaagttttcaaagtgcttccacatacacagctcttatttgcttctctaccttaggacataagcaatgtggtgttatacccattttacagataaagaaacacaggaacagagtattactttggatcacacatggtaagcctcgaggacagaatgagctcctgtgctagtgttctttccattgcatcgtatcattagtaatgtttacttacacctacatacttactgcttttcaaatatccagacgtcatctcctctactgtaccactctattatcactcgtgtcatattctgtttttatctctttgctaaggctatacccacccttccagttccccactgccctcattagactctgagctgctcgagaaaaatgattcatccatctttgtatctctagacccaagtaagatcacaccacatttttgccaagtctctcttgtgctataaatgttcatcttctcttagttgtaaattgctttcaacccaccttttttttttttttctaacttttattttaagttcaggggtgtaagtgcaggtttgttatataggtaaacttgtgtcatgggggttgtacagattattttatcaatgaagtactaagcttagtacctattagtaatttttcctgattctctccctcctcccatactccatgctccgaaaggccccagtttgtattgttcccctctatgtgtccacgtattctcatcatttagctcccacttataagtgagaacatgcggtatttggttttctgtggttttctttggttgctgtgttagtttgcaaaggataatattaccactgaccccagagaaatacaaacaaccatcagagaatattatcaacacctctgtgcacataaactagaaaatcaacccataatttttaagtttatgttataaatattagtattatctgagaggaaggcattacatccataagcagaaaggtggaaaaatcaggagagtgagtgatttatttgagagtatctggtttgttagtgaaagagatatgaaacaaacccagggctcctcatacctaggctacatctgtaacaccaaagtccaatgtactggtaccaaacagactggcacttgtgggatgctgtgtaagcagcatggacagtattcccttatccccagtgcaggctacagttgcttaaaagaactatggaaaaccggacattttgttcccttctaatttatctgtgttcctgtagccatgtctccacttctaaacgctaatcacttctctaggtgagcttaagtacctaattattaagagccctccaaatttctagtgtcatcttcaatatagttagtgccctttctgtcccatttgccccctgtgcttggcactgaatcagtatagcaaatatccctaatgaagaatcatggtacagggttaaatttacaaattaagcaattcctttagtttttatgtcaattccttttatccttgtatccccaccctgcatttgcttaaaattcatcccactgagaagctaaaaaaacaatgctactatgacgatttaaagagaaatactgaaccctaggactttttcctgagattcttgttacctgtaaactcttgaatataggatcagattacctaggcttccagggaatagtaagaccatacattagcagatttaatattaatctctagaatcccagatttacttcttgtccaggttaaatgcccttttgattattttagcaaaaaataatacaaaaaattgattacaaccattaatggaggcttaaaatgttaactcccatagctttaacccagtatctatgattaaatgcaaaaaatctaagttaatgcaatgttaaggttgagcttctaattgcacaaaagtcatgaaatttaaaattaaggtttctagtgctactctctgtcatttctacaacattcctccaatggttttctacaatatatgtttcatttaaatgtgtgtgttgtagagttcccaggaaagaacataaagcacaacagatcaggattcaacttgtggatacctagttttacataatcaatatggctggaaaagtgtgattcttttttaaactacaatgccctatttgagtgataaccatattcctgtttacaaatttgcccatttcctctaaaaatccttgaatcttcacttctgattacacactagccatcccctagagaaggaaagagcatttatgtaataaacaaaccaaacaacctgtggactgtgatagtacctacagaccttttcttcaacatatgacaaagcatattcatgtgggattaatgttgaaagagtaactcagaatatttaggtttatgggtgcatctagcagaacaagcaaaggtgaatagggactggaatcctgttaatactattaataggactagctgaggaaactgtcatcaaattattaaacctctctgaatgttattatcagagtaagaatacctgcttgtaggattattaggaagaacgagtgaagtaatatatgtaacacatgctctttaaaactctcttggagtttatagtaatagatcaactattactattaaagaatgagtaatcataatttaatgatcatctggatgtctacaggtattttggaaatatgaaacaatgataatttaaaattcattttattgaaagatacctagaattatttttttcacaatagtttcattaagttaggtatttgtttatagcctactatggaatgcccagataacatttaatacatgatgcactgagctgcatcagctaactctgaaggcaggtgagttaaatgaattcttggatattgggctgccatgcccaatattttcttcaaattttatgaaacatttgtgtctaaatagaaaatgtgcttgagaaattctagcccaacatgcaatttagagagaaagttataaatcataaatataagagcttagagctaaagtgccacctcaaccataactataataaaaactcctaagtgcattctggcaggaataaataaaaaatggcaaagcctgttgtggacggtgcagagcccaggaaggtaaccaagtgagtaaacagctaaggcaggattatcctcatttgggaggactccattccagacaggaattaaagaggaggggctggggaagggagaatggaggttgtgggagaaagtgtttttgcatttgaaagcagctaagttaccttgtgtaatgaaaaggaaatttgtttttttcctttcaacagtaatctcatttgaggtctagcagactgctacacaaaagatacatgtgttctacctacttggtttttctcctctggcagtgaggtacacaggaagggttcaggtgaatcagaaccattcagaataacatagtcaaattcctttccaaaggtttaaatacctattctttaatagctttcttcaaaagactggtaacttactgcactgttcctggcacattcacaaccaaaatttgttcctgggagtactataatacgatgcaacaaatgggtttaaacgaaagctggaaagatctatactgaaactatgaatcacaattactgaaagcaaaaaaatctcatacacatataatatccagaaaaacatacaactgtcccttggtatcctcgagggactgattccaggaccccactgcagatactaagacttgcagatgctcaagtccctcatatgaagtggcacagtatttacatataacttatgcacatccttcccttatacttctcaccatctttaggttacctataatatctaatacaataaacactaggtaagtggttgttatagggtatttttaatttgtcttttttttggtatattgttattttttattgttttttttccaaatatttttgatgtgtggttgattaaatctacaaatgtagaacccataaatactgagggctaactgtataaccaataatttctgagtccttttgtctctccctatgttaaagcaatggtgtagatgagatttctctgaatagaggggagcagctggaccaataagctgcattatcacttagagttatcaggactatatcaactgattcaagccttagcccccatctccgacttgctgtgatatgcaccaagttgcctttcttcttggtactttcctttcttaacaacaactagtaaattgactataaaacccttggctactataaactctattagaaaactggctgtttccagcatgagccaaggactctagctttccatactcaaagatttatatttctcaagtttcttaacaacattggcatatatttattacaatacagtttatacttttaaaatcaagcaaacagttaagattttaatggtcataaaaatgaagaacgcattggctattttctgagtagtgaaaaagttctcttttataatagcttaactcaagaacttttgaagtctttttcttcaaagatttttcatacaaaaattacctttgagagtaagcatgaaaaaatctcaggaagtaggtaagtattgttaatttaaatgcctcccttttcactccaggaaacataaaaccaaatgacaaagtacagatgatttattccacaactattcattgagcacctactattctctggcactgtggtaggcagtgaacaactctgctttaacagtgagaacaacattcttatctcctgtgacccttaaggaaagactagctgtagttagacttactggatttggtcataaagataaattaaatataaagcagtgaccatttaagtttaattatgttaaagaaattttgaaacaatagcttatttaaatcatttaagtatttgtttacaaatttttaccttctttctaaaatgccaagaattgccaaccatgaaattatgaaaacaaatcaataaaaatacaatgatttgaagaacaaatctatttaagataaaaaggcacataacctaacaccaataaaattacctgtagcactcttaaaaactagatttcttctttctttctttctttctttctttctttctttctttctttctttctttctttctttctttctttctttctttttctttcactttctttcttttctttctttctttttttttttttgacagggtctcactctgttgcccaggctggagtgcagtggcatcatcttgggtcactgcagcctctgcctcctgggcccaagtgatccttccacatcagcctgtcgagtaactggaactacaggcacatgccatcactcctgcctaatttttgtatttttttgtagagatggggttttgccatgttggccagggtggtctcaaactcctgagctcaagcaatccacatgccttggcctcccaaagtgctggaattacaggtgtgcaccacaacaaatggccccaaaactaggttttcaaatatgtgagagtatctctcagctatgtcaaaaatcctatgagtcattcattcagtgtttatttaataccaaaacatggaagatagtatgtctaggaactaattttactccaacaataaatctagaagaatgagtacctatttcatgtggttatcatgaagaaactctgtcagaaaactaaaatgaaatggctcatgaagttgacatatgtatgaaaatataagaattctgctcacacctcttctttcttcctgggggcattatccatgagcatcatctctgtatatgaaggacggaaaacccgctttggatatgtatgcttctgggtagtctagtcaaaaaggaatatgaactcttttatctctgaatgcttccaaataccagagaagaatgatttatggagttctgtatatgactaaaagagctgctagtacttttagagtattcattctttctttattccttcttcagggtgatctggaaattgcccttcccaggactttctgtctctcatataaactaccatttgtataccactttttaggttgcaaaatgctttcacatgtattgtgcaatttagttaaaaggcatcagggtgcgaggatcaagaacactggctttggtaccagagacatcagtgtttaccaaagctacttactagtggtacaccattgtgtgagccacttgatcactttaagcaacaattttctcatttgtaaattagggataacaatatccaccttgcaatataaggtagagattagcaatagggcagttaaaatgttattatgattaataacccatagtagggacaccaaggacttctcaatagtctgtttctcttcatcaggctggaggagggggtcttcacagttacttatgagtacatattacaagcttctagttaaagtaatggcctcttcaaatcttagatctgaaccatcttcataaaacagttctttaattcatggccaaaaacatcgtttccatatactctcagagacagagtccttttggagcaagatataaagtttaattctaagtctttttttaaccccgaaactattttccctgaagcaatccatgtgctgccatcagattttattaggtgggctaaaatagagtcagaaggagatttctttacataatagctgtccctacagaaacttgagacagtcagcttaaaaattatttttaatgaagaatttttgagatccataagtacaggaaaaattttgatggtctttctcccttactgattcattgataattctcaaacattgggctggcacaactagagtaaatcggtacatcttacacagtggaaagcggtgggtgtagatgtttttggagccagtcagtctctggcagcggatagagtcacacttgtgctttgttgcccatttacatcttcagaaagcagcctgggtgggcatgcttatcaaatgtgctcatttaaggataaacccatttgaatattataacaacatttggcaaacttcctctaccgaatggtggacctggcccactacctctgaaaactattgcctggccaggcaacataggtcctttgactttctttacatggtagaacacatctgagaccttccaatcaaacacccaggaggagtcctgagtgctttacctgttcctcaagcattctgaaggttctagtctggactagtgggttatggatatatggatatgcagtgagtccttccttttgcaacatacaccttttttttttttttttaatccagactggagaattcaaatgccttgttaatatctagtggtcacctttggcatgaagaagtcagcaaacatttactgaaaaagttgcacgtggagaattctgtatcataattaaggagatgccctccactccctgaagatgtttataattcttgctgggaatgagggaaaaacaaaacctatacaggcaaaactgcacagcacttatagaccaacacaaaagtgtgtacacacagtgtacaaagacttaagcagagcaaatagggttaaaaaaagaatttggaagaaagtaatggatatacattttccaaggtgagagagaagaataccatagagtggagaaagcataaacaaaggcatggaaatgggaactggaaagcccaccaacttggctaacatagagaaagcagagcagtaaagagtagggggtaactacaggggcatggggatgcatgaggaaccagtttgtaaagattaccaatgctaagccaaagctcttgttcattccattccagggaaacagaagttgatggagaccttggagttgggaaagaaaaggaggccaagaaggataactggtagtagagtggccttacagctagatgaggaattcggattctagtcttcaggtagaaaagcagcagtataaaatccaaggccaagaaatgagacatagaaaattatgtgtgggagcaggtatcctagatgcttaaaaaaattgttttgtgaagatagtttgaaggaagggtggcctattcaagcggttcagaaaggagataaggggccacttggtctagtgtcagcccttgaaaataaataaaagaaagaggctgaatgaagagatattactgggtgagaactggcagaatttagtgactgactgaatggtaatgaagggcaaaagaagaaaagatttaaaaatgatcgtagtgctggggcctcaggaaagggtcctatggacagtaattgaaaaagaaaactggtggctagagcagaagatgctctggtcagtggtagagcatcccaatgattaaggggtgtatgcatgtgaatgcatgtgtgttactataggcacacagatttaggagtaatacctcctttgccctaatgttacataacagcttacaattttctttcaattgaaatctttatttcaagtatttattaagtgcatactaggtgtaaagtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactcagattagccttatggccatggtatcagaactgcaaatagttatattgtggattctttcttgtttgtgggtgacaggagaaaggaaaactcacactttttttgaacaaagcaccatgtagatatccaactgaagtgggctctgttcatcctcaattcaggtgtgatgaaaacctacagggagttgaccttcagtactgaccttttacattatctcatttctctcatgcaacttctgtctaaggatgggaagagacctaagagatctattagtctcagaattacattcatctacaggtgtgccaaaaggatatcaagttttaaaaacacaactgcactatttcttttgtttttctttttattttctttttttttttttctttttgagacagagtctcactgtgttgctcaggctggaatgcagtcgcatgatctcagctcactgcaacctctgcctcttgggttcaagtgattcttctgcctcagcctcccaagtagctgtgattacaggtgtgcatcaccatgcccaggtaatttttgtatttttagtagagacggggtttcgccatattggccaggctggtctcaaatgcctggcctcaagtgatccacctgcctcagcctcctaaagtgctgggattacatgcgtgagccaccacacttggcctatgactggactgtttcttaacattaatataaagcaaaggttgcataaacaatggatgtaggaagctcattccttcataattattaagaactgaaaaggtacattgaagaaaactagccatgaataagaaaataacttcttcacagtggttaaagagaaaaggtactgaaaaaagtaaacaaacatatgaaagcctcttaatatactaaggtattactatatatatttctgacctttggctactgagaaaatgtgaaagatgacaattctatagctattctatataacggcagatgctcctcttattccaggaaacaaaatccttttatgacatttcactaaatatctaatcaaagagtattttatgtgctcatttcagatagtctcattcacttgcccttataactttaaatgagttcttttcttaagcaggccagcttgtatattatttatgataaaatactttctttaagatggattcagtgttaattttgtactatatgacttagtacagtgggacaattacatataacacttcttctatcagccctatgtttctatgttctttattaagatattatcaaagtaatagcaaaattctgttaaatgttcaatgtatatctttactgctaattttttttcaacatggtaatattactggtaccacagtgactcctcatatcttgaatatatgcagtacaattcattctctactagcatcaatttctttttgtaaacagaaatttggctttaacacagcaatttccaccaaactatataagtgctaatgatgaccaatttaggacataaacagtttactactgtcctttgagcctctctcttttttcatttctctaatcatcacactaaggattttttttctagaaagctatgggcagagttgatttcacagagttacaagttgacctttttcttttttttttttttttgactgatgctgttaatagagttttggtgactctatcagttaagaggtataccttgtacctgacattttacttgcttgagcaactggccccaactaactgatttttaatattttgcttttctgtttcctcaattttccttccataaaatattttttctacttctatataacttcttttttatttttttgagatggagccttgctctgtggcccaggttggagtgcagtggcgcgatctcagctcactgcaagctccacctcctgggttcatgccattctcctgcctcagcctcctgagcagctgggactacaggtgcccgccaccatgcctagctaatttttttgtatttttagtagagatggggtttcaccgtgttagccaggatggtctcaatctcctgatcttgcgatccgcctgccttggcctcccaaagtgctggaattacaggcatgagccactgtgcccaccctataacttctttatttattttttcttcccttatcaaattccatctcatttttcttacgcaattaaaatatttcctcactacagtttgggtcagcggtcagtcatatttacatcactttttccatagtttggttgatgatgtgcatagagtatatgcactagccaaactgatccacattcactgtggataggctgaagtccaaattgtaagctgatttgtcaacagctttgagtaagcctgatgccagacaatattttaattcttcagtgatatttcctcttcacttatgaaggaagccttgaagatggcaagttaataagtgcattgttttaactctgtaaataatgctttttggggggttgtctttaaagattctcatttactttttataaagaaagttataatttcttattttctggttccattcttgatctctttattttccttcagtttgtggatttgctctacttttaaaaactcataacttatgagtaattttacagatcccaagatatagtttgtttgttttttgagacagggtctcactctgtcacccacgctggagtgcagtggcgtgatctctgctcactgcaacctctgcctcctgggttcaagcgattctcgtgcctcagcgtcccgagtagctgtgattacaggtatgtgccaccatgtccatctaatttttgtatttttagcagagacggggttttgccatgttggccaggcttgtgttgaactcctggccacaaaggatcggcccagctcagcctcccaaagtgctggaattatacacataagccaccacaactggccaaaataaatttttttaaagaggatactgagcatctgaaacaaggggggtttgtagactcacaaggattaaaaattatttcgattgtctttaaatcgattgttttttaatcgattaaaaatatattcgattgaatatagtgatgcatttatcagtctatcattctgtaaatagtatggaaaattctggaaaaaaattcctgttcacaataaaagagattcaatttgcgtaacgatatttactgtgtgcctactgtgtcctgtcctaagacacagtattaaagttctttcacttaaagagttcatacctagcagagggattagacaaatttatagacaattatgcaaattaagtaataagctttacaaaagaagtgcacaaaaatttattgtgggcgggtggtatatacaagtcaatgactttcgttgcatgggagagctaaagagaagtaagcaataagggcctcagaaagttagaggcatttgggatgagcctttgaggataggtaatatttgatatatggaaatgaagatagagatatacataagcaacaaagtgaagaatgatagattggaagtgggctattcaggaaaaaatgcttttctttggaaaccatggataatatttcagcttctattcttataaattagtctcagcaaagttgccacttatcatatgttcaatatgaagtattttccttgcctataagaaacactacaaggatgtgagtagaggtgaaacatagagtagacgtgtcccaattgtaccccagatgtgtttgtaaacttctaggtatggtttccaaagaaataaagctcacagaacttttattaagaacacttttatttctataaataaatggaaactcatcttcagctaaaaatatagtggcggctcacatctataatcccagcactctgggaagcccatgtggggggatcacttgaggccaggagtgtgagaccagcctggacagcatagtaagactccttctctacaaaatattattttaaaacattatttgggcatggttgctcatgtctataatctcagctactcagggggtgaggtgggaggatcatttagcccagaaggtggaggctgcagtgagtcatgatttgtcattgcactccagcctgggtgacggagcgagaccttgtctctaaacaaaacaaaacaaaacttggaaattctagatatccaggtatttattcactaccacatagcttaactgtatttccttattattttgtctctagctgaagttctctggaatggtcatgaagagagaaaacatcaaagattaggaaatctatcccaaaaagatcacaaaatcaaggacagtgacacctttttgagctttttacttgactcttcctgtttttttttttttccacttcccttagtcattcactaatcagttctgctttagaaccattaaaataatagaaaagttacagaaacttggtaaaatgtttctctggcctatttccaaaccgcccaaaattaatgggaaatggttaaagtcaaaaaagctttttctctgacatggatttctaaacaatataattatggttcactccatggttatgagctttgggagctcccacaaaaaagtctttgctgcagatgtggccactggctgctataccaggcaatttgattcatgtttgttgttgttaaaaaaatatataaaactctcttatgttggattaagaggcttttaagaggaagctagacagaaaggccaggtctctctctatttgctcattcatgacaaaggtggaagcttcaaatttgtgatacatgtgaagaaggtgtctgttacttcgtgttacatttttgccttcagaattattgttttcaatcattctattttatataaatgcacaaaaaataagtccaagctaaactagtgatgctgggtcactccaagaagtgtcctcaatatagcttcacaaatttacccttttctctccaaatccacgtttatttcttgagacagttatatgatgttttgccaagaaagcaactgggagcaatgccttatgtttaactgggcttttagatttgagaagcaatccaatccaagacttcatgataagacttccacagcaattggatattagtgacatataaggaccttaagaactccaccattttatactctatataaatgtatgatgtggtacacaaagtattaatcaatacttcatgagcatagtagctctgtttataccaatttctagcaatgtacattaggcaattttgtagaaaaaatataataattgaaagtataatttaacttccactccatgaacacttagcctcttcataccatcctcttccaagcatttctttggtccttggaaaatcagtgaaaaatctgaaaaattgggattttgtgtttgattatatgtacatttactacaagtatactgggctttccttttctgatgctatagagatgaactatagctttcctaactcagtcttattattagccaggtccagtttatattagttaaaatgaacatcataaatttacagtataacttatctggtacattccttctattgtagtttgaaaatgtgccattcaggactgaaatgacttaaacataatcagattttatttctagagaagtaaagtctatacttctataattctgtgaacccatcagcaattaactttgtcccagtagaattaatatagtgttcaagttcaggattgagtagatgagaagaggaaggaacaataaaactcattcactcccatgctaggttctgcaaaatagcttccatattcccataatgtgatatttatcttccttataatagcacatttaaagtcagtaaccctaaaaatctcctacataaaggtttgcatctttccccttaaaaatgtacagatgagcttgtgataaagagatgatgtctcctgccaaattgtaatatcatatagaccagttccaggcaaagtattgaagaagcagtcaaaacttcatatacctatctatccttgtcagcctcacgtattcatggatggggtcacagcttatccctttattctttttggttagaaagtctttccagatgaggtcatcattttcattactctgtttcttcctctctcactagagtgtctttctaaaggaaaccaaggaccacttcagtgaaatattgaaggcaggggaggccctaaatgattaaaagaaacaaagctttcccatagcacgtgtccttttctttgtaaggagatgaggtaatatataatcttcccacgttactaccacaagggcattttgtggcagggagagatggatttctgggagtgaaatccaactgcaaagcaagggctattttcagaagggcttatcttcaatatcctcatttcagaattggtctctttgctcagagcaataccttgggcaacactgagaactcccatctctaaggtaagaataaaagttatttcctcattgatggaatatctgatgaagaaaaaggaagacaaaaaacaataaattattctcataaaaggtgatgcatatgaataaatgtcaaatccttctagtatttctcatgtggcttgtacacaagacttctatttgatctttggctctgcagtttctaccactagatgacccacatgtgtaatctggataggcagctagtttgcttacatataaattaaatagcctcaagtgtcagcagatctctgtatctttttaatatcccccaaactgcttcaagtaggaacagctacaaagaaccttaccaaaggacatggaattcacacttgccaaagaaatcactgcacgtgtaaattagaaactaatcatcacttcctctctggttacagtggcagctttgcctcatagtttatgttgaaatatacatttttatgaaatatttctcactgtagtcagcatcaatttaggagtatcaaacactaattcccagctccagcataccagaaaactagagacagagaagtgcagacaaagggaattgacaaaggcctggacttttcttatacttgaagaagctaattgtatttgtaaatttctggttaaaaacctgacaattatcagatctgccactgcaaggctattcctcaatttcttcatcatatatttttccctaaagtctctcagagaagtaaagggcttctagagatgaaaatgaacttgacaatcacgttgcaactcaaactgatcttgattcttttcgtcactttttaatttattgcagatggtgtaaatgggatgtttactggttggcaggtaatgagtcttgttgtagataatagtgatggacagaatctcacgcctgtcgacatcccagcatctcagcagctatatatggttatcatccattgctttgaagcacatataatattgtgacaggatgcacaatatttcccccatagaaacgatgattggtacacctgaatctcactagttcacatgtcatttgtcctgattccatcctcactgtccacatgagtagacattctaagatgtgatctaatggaaaatgtaatctgtttaaacatccaaacactcctcttccaaggtatcaccatttatcacaactgtcagtgcccctgtggaagagtaatgaccctcaggcatgggataatgctccatagaggccttatgaatgccactgtgaaacacagaaattgaccagttttcagttgggctggtatgtgcatcatgaaagatctgcacttactcactaaattacaagtggctgtttaccctttatacaataaagtctaggttgggaagccacagaccctgctgacttcaattgtcccaaacatgtgagtactagatttggacctgcctttgaaatggacttaagcagcttgaaactggaagttggatcacagtcattcaaaaatacattgggagataacataggtgtcattgccttccacttttttgcctttttaaaaaatcctctctatcaatggaggataacaacatctcactatccactattagcaattaaaaactaaacagggtaagcatgccagtgaaaagttaactatttgtttccttcttgtaagcttcccttcatccagaagaaaatctggatctggatctgttcatatattgtttctacaaagcagaacaaaggtgaacagttatgtggtatgaactcatgattttcaggtccctcccaatgggtccatttcctcattgacgatttccttgaagtcccctgtaccttcccaatcttatctacattttctatgaagtcaccttagataataggatcacttgcactctaagactgtttacatctcagtaaatgctctatcactatgaaagtttcatctaaaacatatctattcctcagtgctcagacaccctgaagatacccttcaggatgtagcatccatatgaagtcacaaaataccagttgatcttcccgtggaaattgttttccaatctgtatgaattgaatggctcaactaaataaatgaagaaaatgaaatattttactcacagtgattcattccatattaagaaaatacactaagtaatgaatggcccctatgaaatcattacagttatgagcatcttttctacttgacagatctctgttcccctcgcagatgagttatgccaacctaactatacttttggtattcacaatattctgattattagtatctccaaagatgggacttaagacactttcctgagaagagaaatttacaattagatacatcttaacaattaataaaattaatgagataatgaaataagaagctctcagtatactgctgaggatgcagaaatctttttgagaattaggaatgttctagaagacaataaaaaagatcagattgtgaactgagcaaaacaacctttgatgtgaagtgtcagccagaaatgtcaatccaattcaagactgcatacaaaggggcactgtgtctttgagctgagaggtattatgttacctgattatcttctctggaagaatgcattatggtttagacacttttattacctgaaagatgtagacaaattagggaagattaacaaccagttttattaggaagtagcagatgagctggtgtgaatggtactggttgttatgagttctgtattctcttttcagctttgatatgctctcatgtgggaatagtcatccttgaaatttagataggataatttatattcttttccccagagaaaagacagtttgggaatgaaagggaggggaagtgtttaaaacagcacaagaacctgggataacagaagggtcagaaattctattatagaatttttcaactcccatttacaaaaatacaaccaacaataaccagttcttaagcctttatttgaataagctcagtacatttagtatttgcagtatgtttttcatatatagtacctaattgtttttggtccacagaataaggctattctatgatactatgttattatgttcatgttttcctggaaatataatttgcaaggtcattctaggaactctgattatgaaattcaacatcactttaagtcagttaccctgaactctaatgcagtttcttgtctcttcatacttaccctggagctataacctatagtcttatagaagtgcccttttcaaaaaggctcccactccttgccttctgaatgactgtctagatatattttcacctgtaattgcatactacaccaaatttgcattatatatgaatgtgattgagaaatgattaagataattgtttagtttattagtgaaaataagtggtatataagctaaaataaattattatttttacacatggcattattcctagttgtatttattatgatttaccatttactaaagtatttcagttggttgacaaggaataatagcactaaacttccttcaagcaatactggtgactcactacagccctaatgttaatacattccctcagacttaatcttttaattctattgggaaacacctataaacacaacagaattttttccttttctgatgttcattcaaattacattacctatttccaccattcagtgtagtaatttctgggaactaccttgaggggtggatggtggtaaagaatcaggacatttaaacttctattaaaaagggacagaagaagactttaggtcacctgtgatcttaggcagctttcaggaaacagaggaagcacacttgtgatgaaccttcataaaattggcccatattcccaataattcccttacctattgagattcctggttgctaaggactttatcagttacttcaacaatcctccctccccgctaataacagtacctcatttgcgaacaatactggactgtactcacaattccttttccccttcctttcagaaagaacacttttacgcccctaaatagtcctataaatggccaaagacataggacatgctacatgattcatctcatgaatcagtttctgttctcttggctgttcaacaaaagacatttcaaattctccacgaggcaatgtattacactgccatgagattaatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttctcactctacagcctatatagtctggttcctgattccttctctgaacacatcaccagtatacttttccttattcactgacctgtcataattcacatgcctagctcacttgagcctcaaggcctttgaagttgctattccaatttgcctgaaatgattttccttcacatcttcatatggctagtttctaacatcattcaggtctcaaccaaatgccatctccttacatgccatccgtgtgagattttactcttactttcttcatttcattcttcattgtgtgttagtgagtttacatgtttattaactatctcccttaactagaatgttccagaaggaaggaggactttgtgagttctgatcactattgtatttccagtgtctggaatagtaggtgctcaacaaatacttgctgagtgaatgaataaattaatgaccaaacagtaaataaatagtaaacaaggccaatatcaatgctctttattacagtagttatttaaatgtacctcaaaatgctctaaaaataaatatgtgctttccctgcacattaggattaaaagtactcattttactaattaaaagccaggacctcaatttacattaatgactggtccaagatcatatggtaaatacgtattgcacaattctggtctgaaatcttgttagcccagtcagtcctacagtgatttacttagaacacaattgtgaaccaggtataattaatctgaggtccaccaataggcttgagggggtttgtgaatcctttgaaaaggtattgcaccctcttttgggaagagggtccatagctttcatcatattatcaatggaagccataaactaaaagaggctgggaatctctttaagcaataccattctgaaacaaattattcttaacctccctaggtagattggaaggctgctggcttcaacattttctgtagagaaggaacacctatgaaaatcctatcactggctgagtagacatattttcctttccagcaccaactctggggaatggtgggcctcacaggctggctaacccttcttggagttcacgggaaaaagatgtctagttcaaagacgatgagaagggaggtatcattctaatcatgtggaaagcccactgtgcttttagtttgtgtttgtagcattcttagcttaatttcagggatgttattgtagctgtgaagattagataataataagaaaaactaattcttaggcaccagacagacaatatgaaaaaaatatataattctaaatgtaggtcaaattttatatttatcagcattgatgcagtgttgttttggtctgttcttaaatttttgttttatgaaaaacaatgaatgcaataatcttctaatacagtgattaagaaacagtgtatatttttccacatactatcaaagcagagtaaagagtgaattttgccatgggaaatagtgtattgctacagtaagtaagaatattaagtttaccaagtttttctagactgaagacttaacaataaataaggcacatcttccctgtaaggtttctcttgagtctgttacttttcagtagatgatgatgatgacagcaacagcagctaacatttgttgcttattatgtaccaggtcctgctctaagtgctttacatttattacttcacttaatcctcccagcaactatgtccatgaattaggtattattattatctattcttagagatcaggaaagtcagatgaggggttatttaacttggtaatgaggggtaaaaccaagattcatatcccacctgtctgatgccatgtccaagcctttcaccactacactttcctgtctccctctgtggtagtgcagggatactttggagatgtaacacatcttaattaaaaatactttattgctgaaaagtgctcaccaccctctgagctttcaagattaccatctgagtggtaatctttttgctggtggagggtcttgctttgatgttgatggttgctgactgatcagggtggtggtttctgaagcttggggtggctgtggtaatttcttaaaataagacaacaatgaagtttgccacatgattgactcttcttttcacaaaggatttctctgcagcaggtgatgctgtttgatagcattttacccacagtagaacttctttcaaaattggagccaatcctctcaaactctgccatcgcattatcaaatgagtttataaaacattctaaatattttggttgtcatttcaaaaaatgttcacagaatctttaccaggagtagattccatctcaagaaactcactgctttgctcacccataagaaactactctttacctgttcaagtttgataatgaaagtatgaaagtacaacaattcagttacatcttcaggcttcacttctaattctagttctcttgttattttcatcacattatgtacagttacttcttctactaaagtcttaagtgcctgaaagtcatccatgagggttggaatcaacttcttccaaatgcctgttaatatttatattttgaccttgtcccatgaatcacaaatgttctttatgacatcgagaatggtggatactttccagaaggttttcaatttactttgcctatgtcgatgatagaaatcactatctacggtagctatagccttatgaaatttattttttaaatataagacttgtaaatcaaaattaccccttgatccatgggctgctaatagatgtcgtgttagcaggcatgaaaacaacattagcctctttgtacatctccatcagagtttttcggtgaccaggtattgtcaatgagcagtagtatgttgaaagaaatctcttttttctgagtggtaggtctcaagagtgggcttaaaatattcagtaaatcatgctataaacagatatgctcttgtcctggctttattattccatttatagagctcaggcagggtagatttaacataattcctaagagccctaggattttctaaatggtaaataaacattggctcccagttaaagttacctgctgcaccagctcctaacaagacagtaagcctatcctttgatgctttgaaaccaggcattgacttctcctcaatagctataaaaaccctaaatggcatttccttccaagtagaagactatttcatctatattgagaatctgttgtttaggtcagccaccctcatcaattatcttagctagatcatccagataacttgcttctctatcagcacttgatacttcactttgcacttttatattatagagatggcttctttaattcatcttcatgaatcaatctccactggcttcaaacttttcttctaaagcttcctcacctctcttggtcttcatagaattgaggagtcagtgccttgctctggattaggctttgtcttaagggaatgttgtggctggtttgattttttttttttttttgagacggtgtcactaggctggagtgcagtggtgccatctcggctcactgcaacctccgcctcccaggttcaagcgattctcctgcctcagcctcctgagtagctggaactacagacacgtgccaccacactcagctaatttttgtatttttagtagagacggggtttcaccatgttggccaggatggtctcgatctcttgacctcatgatccacctgccttggcctccaaaagtgctgggattacaggagtgagccaccgctcctgtttgatcttttatctgcaccactaaaactttctccatatcaacaataaggttgctttgccttcttttcattagtgttttcactagagtagcacttttaatttccttaaagaacattttctttgcatttacaacttcattactgtttagtgcaaggggcttagctttcagcctttctgggccttcctcactaagcttaatcatttttagctttttatttaaagtgagagataacgtgactgttcctttcacttgaacacttagaggtcattgccgggttattaactggccttatttcaaaattatgtctcagggaacagggaagtcccaggagagggagagagatgaaggaacagctagttggtaaggcagtcagaacatataaaacatttattgattaaatttgtcatcttatatgggtgtggtttgtggcacctcaaaacaatcagaatagaaacatcaaagatcactaatcacaaatcactcaaacaaatataataatgattaaaaagtttaaaatattgccaagaaccaccaaaatgtgacacagagacatgaagtgagcacatgctgttggaaaaaatggtgccaacagactcaatacagggttgccacaaactttcaatttgcaaaaaatgtaatgtctggaaagtgcaataaagtaaagtgcaatagaaagaggtatgcttctatatcctattttcaatacaaagatgctgggtagccaatttctaccactgtctttgtctatttgacaaaactttcccatgacttttatactgttaacttttttgaatagcagatgagacacatacttgcatcctcaaatctgcaaagacaccttgggccagtttgaaccgaatcccatttttaactgaaaatgatgaaaataaggtacattattagcctgaactttgcataactctaaaatgtattaatcttcggtaaaaattttaatcttagttttagaatcctcatgaagtacttagaatgtttaaatgagataacactgggtatattaaacattatgaaattgccatttctgtagcttaaaaatggtcaattgttgccacagtcaagtgattaaacctaaggtaagtaatcaacttaccttattaagttaactgctattgttgtaagataaattattctcactctacaatcctccctccctgaaaacttttctagtctggaatgtactgctgataactagtgctagggacatagggttgaacttgcccatgattttaatttgtaatacataggcttttaaaattcatatcatagcaggtatacctccaaatgatgccacaaagacagcctagaaaatgggccttagaagattaagttaataaaggcttattatttttcctatagctggatgtactcttaactagataactttcaatagaaatcaagttcatgaagcaggttcatgggaactgtattagtttcctatcgctgctgtaacaaattagcacaaacttatagttctggaggtcagaaagtcctaaaatcatggtatcagcagagttatgtttttttctggagtctttaagagaaaatccctttccttgagttttccagttattagaggccacctgtattcattggctcatgatctattcctccctcttcaaaaccagcaacgcagcatctttcaatctctctctctctctgacctctgcttccatcaccacatctcctctgtgatcctcctgcctgcctctttcctttaaacggcccttataatcatattaggcctaaccagataatctggcataatcttcccatctcaaaaatccttaatttagtcacatctgtaaagtctctttgccatctaaggcaacatactcacaggttctgaggattaggatgtgaacatcttcggtggggtggggaggggggcattaatctgtctgtcacagagaccgaaatattctaggtacccaaatttcaaatagcaagcaagatggtatcttatttctttaaacctcatagcatggtaagctgcacagacatttttacatataccctcataatttttaaggagattgtgatgtacaactctccagtttctcttctggcacaagtgtgtggaaatcatggtcttagctttggtttgtagaaccagattttactcctttacccagttttagtcaatcccatttatatttaaatttgtcctttttgagcattcatactgctatccttagccaaagaattattagtacagtaagtgctttctgcacttccttctcctaactctaggaataaaaggcacacgtgtttagctgagaaccaaccaggacagaattctagcacttctcattacatctttcttgtgctcttccttcaggcactacattgacatctcaataagcaaataacaccagcgttgcaggtgttaacaccaatgactataccatgagaaattcccttatgtcacgccttgcatgggtaaagttaactcaaatgtcttccttctcttacctaaaatatctgcttgcctgacctacatctcccttgtccattgtttccaatgaacactaacccttaaacatttaagcctcatcagcacatgcccatcataacagcataacatccttgtcctgctggaaactattcagcatccagaggaccatctttatgctgataacactaaaatataaaataatgccaacagctggtgctacaaatggcttttaaaaacgatgttcattcactaaaattcctcttgctacttttgacatgaaacacgcagtctctaattattctgatcaagacggtgaaatacaaaaacaaactttaattgtgtttaacagatatttaatcaggactcactgaactacagattaaagctgaaattcataaaccataattacccgattgtcgcaatcttttggtccacattctccttccgtctgggcgtctggcaccttgccccgaatttcttttactgtcttctcagcttcattactgttcatgttttccagcagagatttagcacagattacaaaatatctgttcttggcaactttcttcattagctttttctccccccttgcaaaaagtttattttcttttttctaccagagtagctggaacaggcatacgtttagggtgctttgatgacacaaactaattatatagttatcaggagataatacggtagcgataactaaagttactacagttatcatgtaggtatcatgcaatttctccagtataccatgcggtgtgtcccagtcaccacgtaattacctaatgtcactactgcattgtttcatggaaaatgcttatctcaccccaacaaaaccttttctgccacatttagagaaaaaaaaagaagtgaaattcttagttctcatatccagtactgctcattcccagtaagatgttgtcatgcaaatgtaagggaaacacctgccctctcctgaaaatttgctcttacagggagcaaatggagcaattattattattattttttcctgcttcactctttccaggtaaaagaagtaattaccaacaatacatacattttttctttttttttctttttttaaaagaaaccaatccccctaccgacccccgaaagaaacaccctatttacttaggattcgtttagtctggcacttcccccctatactctttcctttcaaatttcagtcactcacatttgtttttcctagaattatggtgtaaatcattcttaacaagctaacttgaaacttctctcactcagtagaaacacaaaatgccactgtaattgaaacacggaagcttgaaactctttctaaccagttcttttgggccactcttcagaagggcatgccgagtttccctcacagtgcggtaacccctgggtcacacagcgaggataacatcacagaccaaggcaagaggataaagagaaggcactggctaaagaagaggtgggtggttcctttattccccccagttgggcagtcaaccctatgaagcaaggactgtagttgctacttatttatctcaagttgatggcttgaagtctgacctcactaagacctttagatgtgacataccacctgagagttccagtttaaaacaggatgtagcagcttcctttgcagcacaagttgaaagctatttccaattctgcttttattagtcacctcccaatctaagagctgcccattcaattgtacacttaactcatgtcggggtaaaaagcacctccagatttagaagggccagaaaaattgctatcctatcctagcacattgttcttcaatcacacagttcctctaaatacagttgacagcctttgagatgcaaaatgtatcactttaatgtagtagaggtccccttcactgcattgccaaatctatttagcagaatcttcttggaataatctgtccctagacctgaggatgcacagtgatttcaagcattttaagctaatgataatggttagtgctgagaacagatgtacctggctgtgatgtgatctattccagtaggcttttatgagctgttcattcctattgacttagcattttatgtctgtgcttttgcctggtgtgatggttgcataggggtgtcatgtgtgtattttcctgatgtgtgatggctgcacagggggctgtgtgtattttctcagtgcaatggccacacagggtgttatgtgtgtgtttgcctggagttatagctgcacatgttattgtgtgacttttctctctatttgatgcttgctcgcagggtcctatgtgtatctttttcttagtgtgatggttgcactcaatgctgtgctaatgatggacatttctagcaattatctatctacagggtcctcgggaaaaaaattgcagtgaaatcaataaacagtgctagacaggcccttgtaaatatgaaatgacaccatgcataaatgccgtttcctactatagcatgttaaaatccaaattctgttatgttattggcattgggataaaatttctatggtccctccatctccttcatatattgcaatcttttgggggaagttgagattactgctggttggagggcttttacacatgcatctatgtaatactactttttgctacattgtcctacacatcatctcttatactccattctgacttatcctggcataatagctgatattctaaaagtgaatatgcctttcatttattccttcagtctcaccaagccctcccccatataacccctacatcacacatacaaaaccccctcgcttgcctccctctctctagtttctccgtatccctcctgtgttcaccaaacggaactgacaaaggaaacaaccaatgaggttaaaatcttttgaaacccctggaatacagatgagctgggaggcatctggaaacaaaaccagacacttgaaatcaaagagacaagtaaattactatcctaatctaggaagaataactaaaggtgtcagtggggttccattgatagcacttggctctgggccagaatgccaagggttcaaactccacaccagctttgggctcaggcccaagacttgctactgcagggtgcagcagcatgtgcagcagtgttaaaggtgtcagccttctgcagagaggttaagtccaagtccttctgcctgtttgtcattacaccccagagagacggagagataaccctagctttctcttcgctgcctttctcaatagaacaggctgaggaggaactagtgctcagcagcagtacttgctagtatgagtactatacaactaattagtaaaattcccctctactgataaggctgcttgaagtatgcgcaagaaaatccactgtccctctccccccacgaaaaacctgatgtttgtcctaaagattcttccatcaatgcaaagagctaagtttggaaacctaaaaccatgtgtctaaaagaaagaaaatgttttcattggaacagcttacatgtctggtacacttgcataaaaactatcgcatagcattttagagctaaaattgctataaaatgcttaatacagtaagagtaattatgagattttgcatgcacagctggtatacaactagagtctcagccacatattcaatggagcatgggaaaaccatttataaaaattcctggtatgccagtttaactcaccatcaacagcctatcaacacttcattctttaagtggatagggaagatatttacctaccaaatgctttatttcttctctcatggatgttatcaatacttgattcaaggaatttgagttattacttagagagtataaatataagctgttaacaggacatgaatgacctgaatgcaagccttctccactgagtgaagaagttacaatgatagtagtaagtaatgaaccagaagaccaaatcattaaatctacttgtatcttccctttttaacctccgctttttgctatatcttcacatattcttatctctcttcatttctctaagattcaaatcctcgggtgagttcctgggtactctggactcccctgccatagcccacctggccttgccttcccctgagtaacaccctgaagacagagctcttcgtttacattttcccccaatcaagttataacaggtatttgttctccattccctttagttccagctacatcacttgaaaagaaactgatttgggtgagttgttaatggttaataataatttaataaagtttatttcttgatgaaaacattgattttaagagtcaaatgaagaacctctttattgtggtcttttaggctctatggaaaatgccataataggtgagatgattctaatcagaagcattgatggatgctccattgcacattttttagccataggagccagtggatagatgggaattcccaggtggacaggaagtttggggtcacaaaggcagcatgacacaatacaaaatgaatttgaacagaatcaggaaactcaagttttaggaccaacaaactttgccacgaagtgtttggcagacattcagtttcttaacctgagaaatgaggcaggccctgggatcagaaactctccatgatcctctctggctcttacattctatgactctctgaccgcagatcagtcaggtctcctggattagctaccacctccagttaagaactaatagttctgaataaagatggcggtcattccacactgagccaacctaactaaagaggtgttgatgtccataggtgagttttacctgtctgcctacaacctgcatacactacttttgagttggctcctttatgctatacagatatttcttagcattttgttttccctcatttacttaattcagcaaacatttaatgagcactttctatacatgaaacacagagtcgatcactaaggacaggactgaacagggcaccatctctgttgcacagatgattttattattcttgtccattctctctctctctccccaccttcacttttatgcataaacacatacttctagaactataaaagtagtatagaaaaaataagaggaattagacttatctgagccagtctgaaatactgtttattttaaacaaaagaatatgataataatttgtgttggcaaaatatatgcattcaattacgcacttcaatagtataaagggtatttctcaacatgtattttgaggtcagtaatttgcaataaggataacaatttgggggaaagaagattataaaggtaaaacattcccttctgtagaatcctgataaagtcctaggataaaatctgtgacttgtgtaaataacctctgggaaagtgagatcatagaattttttttttaagtttttgtttttcctctaaggattttgggttcatatccctccaaattttatttcctgacttaaaaataataactgccacttattgagtaaatattaaattccatgcacttcaaatacattatttttataaatacagtatgaaatacaatatattaatatattgtataatacaatatgatatattataatacattgtaaatattaaattcaatatattattaaagcaactctgctagatagatattattactctaacagacatgaaaactgtgggtcagagagctgaagtaacttgtcaaagataattcagacagtgtgcagagttagaatttaaactcaggtctgtatttgtctatgcaatatggctccataaccatttcttggttctgctgaatctaactttattttaaaaatgaataatcttgcttgaatgctttgttagcaaataaggaaagcaccctttttactcttccttcacattcattcattgcattacatatagtacaatgaaaacaggagatggttaagattttttcaatgcagatctggttgccttttcatattgatttggactgagataattaaatttgggctctcaatcaaagtgaaagaataagctatttgctatctgaataagtatttcttattaattgatcagacatggataaggtgtgttattacaactatatttgtaaggtatgatttatgttgttctactgcatattactctgtgctgtttttcattttcttgcactttggactttttgttttgtttttatgaatttagtcacagttggttgtgtgttgaactttgtaaaaatgtaatactaaggaaattaaaaaaagaaagaaaatattttcaaaatgatgtcaaaatcaaatctacccctcactaatttgatttgtaggaaatggagaacaaagtattagaagcagaatgcttttaaataatcctaattacttcaatgtgcaaatgcattgactaaatcgaagcatgcgtttaacactttgcacttcaattgtgcttattcatctaagttctatagatagcaattctataaaaaacaagagatatagccagccattccatagttattgggggaaaactattgttctaaaattcaagcttacctctcaagtcagcccacttttggactaacgcagatcattaggtcaaagaactcaaaataacataatttactgtaactactcaggttttcccaattgactctgccttccctattctttttttctgccttcagcggggtggggtgaggacgtggaggaaggaaagcttctgttaacaaagccacagagtggaagcagcaaggcttttggtagtcaagccacacagcattaagcagggccaatcttaaggaataatgccatggggttagagtggtttgtgatcaaggctgagatggagtcatgatggcagggtaacttagtacctggtctaggaccagctgcatcagaaccacctgctgagcatgttaaaaagacacatttcagggtctcactccagagcaaaccaacagaattagtatctcttgaggtggaactcagatctccattttaaacaggctccccaagtaattcttatgctacttaagcctgaaagcactggcatatgcacttaagctctctaattctatatccagcgacagccctgctgctacacctgtatactctgtcccagtcttcaagacatatgtgcaagtccaactacttgtcctgggaggcattaatgctaataataatggcccaagggcttagctaggcatgatgttatttgacatgcagtatctcatccaatccccacagcaaactacgagacaaagatgattactattctcatctttcagatgagaaaactgaaattcagagagacttagtaacttgttctgggtgccacaataataactgaaagagctctgaagaactatactactgtactttaactcagccctgcagaaaaatatcttgaaagatgtttacttctaaaggtgttcataacttggtgatatcattattccaaagaaacttgcctagatgctagtaagatagattatggaataacacacaaagtgtaagcatttctacccaaggaacttttccttagattatttcatagagacttaaactctcaaaaactaggctaagaatccttcattagttcgttcaacaattatgcactttgccagaacctgaggtatacaaagataaacaggacatagtctctgccttcactagacttacagttctgaaaaagagacaagcttgtgtacaaatggttctgggttaacttatacagtcagtggaggcctgagggagagagagtagttcattctcctggcagaaggaaaagagggtgaggtctgtaaagttttagttactccagcactatgccattggctaatgtaaggaacttagattttaaagattatatttttacttgtacagttttgttactaaaggggcagactaagttacttgtatatttcgagccaataaaactttatctggttcattctctctggcatcaaactggttttcttttttgggtaaatttctgggtacagagccaagtaagttgttatgtttattcattcttacacagagcaaccgagattctattcttgaaatgagtgcctaataaattttatcagtagtactttattccacccaataaaagtggttcttccttgacatactgtgtcctttattttcacttgtttcaattactcagaatgctattattagatttgcatattttcataagagaaatttagaaattacaaatgattgaaaacaaagaacaatctagattctttcctttgtgataagagaggatgatcccatatacatgtaaatgtgctttgagtatgttaatcttagaaatgactgaagaaaatgacattctaaagaaaatgagggccaggcatagtggctcacgcctgtaattccagcactttgggaggttgaggcaggtggatcccctgagctcaggagttcgagaccaccctaggcaacatggtgaaaccctgtctctactaaaatacaaaaaagtagctgggcttggtggcacgcccctgtagtcccagctactcgggaggctgtggcacaagaattgcttgagcctgggaggtgtaggttgcagtgagccaagatctgacacttcattccagcttgggctacagagtgagactccaacaaaaaagaaaaaaaaaaaaagaaagaaagacagaaagaaagatgaaagaaagaaaagaaagaaacagagagagagaaagagagaaagggaaaagaaagaggaaaaaaagaaaaaagagaaaaaggaaaaagaaaaaagaaaagaaaagaaaagaaaaaaatgaggttctggaacatcgaagttcaggctaatcacttaaggcaaaggtacaaggatccaaaaaagaaaaagaaattatgaaatatgatatgattcagtttggggaaactgaaaatctatgtatcccatattttagtaactgaataaattggaatcatacatgtattcttttctaagttgaattattaccaaatttgagattcagtgtttagattatttactgcttgcttaaaacttttatttttcaaattatcagagtatttttcaagcattaagaaagttcaataaaaaggcaatagaaatatcaagtaattccaccatacagagataactcctctttacatttgaatgtattctcttacatcattatcgaatactttcatttttatatttgggattgttttaggtatatatatttatttgtatcttttggaccaggaatttttagttgtgttattttataaacttttcctaataaaatattgtttaaaataactttaagaactatctaatttgcatatatgatatgtggtgatacatatggatattcaataatttaataatttctcgaattttgtaatttaagattttaaaatcttttttctcttttataaatgacattgtgataaacacctctgtacctaaatctttgtctgagattctatttcctctagacagatgcctagaagtaaaattaatgggtcagaggacatatttttaaagcaaggttctggataacataatgctacattactttgcagaattttgtgtcaatatatagatatccactatcactatgagtgtctatttcactgtaccattaccagcactgaaaattactatttttcataaatcatgactttgaatcctagtgaattatactttttcatgtttattagatatttgtatttcctttcataatttttctctttatattctttttagccattctatttgactgaacatatatctcaatatcttcatatctgttgcttcaacttcatttctgattgtaacaccatagtctgagctctccttaccttgctctgaatgatggcatcatgtctgcctggtctgtattccaggtttctttgattctgatttattctgcacactgatgccgaacagttattttgaaaatatgctttcatcatgtcagtcctgatcaagaacctatgacagctcctggttatttatctatcagctacattcaactgcctcattcaggggaaaattcatcccattcttggatattcccttatgagttctgttgaataatttaggttattgctatatggaccctatatgcacttacgtttttataagtgggtatttctatataaagacagggagacacaatgtggagtactagaatacaagaactggaaagggctttaaagtacatcaaaaccaactgtctacatttataaataaaaaaaagtggcctacagagtttaatgaactacccatggtcatggagccaattaaatgacagaactaggactagaaactaagttgcattattctcttttagtgacttttagatagagaataataaaagtcatttttacaatttaaaaaatagaaacagctaggaaggcagtttaatttcaatctgttgttatgtataaaagattgttaaaatcatgccacatagaaggcttgagtgttcttttaacatgaataatatgtacttcttataaatcaatcaaatgtatcattagaatttccataaaatttgcacatctgcaaatgacctagtttatttatactttgctttttcccttgctaatctatattgttttatttaatctgctttgccacaataaaagcacagtattttttatcctagcatattgcagattttcactaagtttcttaatcatatcaataaaaaatccaattttcccagcaaattcatataaaagatttcttttgactatagttagggatttgaagaactacctttaaaaaataaaaaaaaaaaaaataggaactacttcaaaatgcctctatttaaatagtaaacaacacgaactattgtggaagaatgtgggctgtcatccatttaatatgatatgatgattgctatatatattcaagaatcccactgtatttgccaaatgaaaacttaacggtagtcactggtttagaaacgagagttaccaaatatatttattatttgtggaagaggggtagggcataagaggtaaatgtggaaatagccatgaatggacctaactttgatagaagctcactgatttcaaagggctgattaacaaagcatgtgtttgcctaacaaaataattgacagaaaaggtatttattaaatcataaggtgattcaactgtttataaaatacaaggtttaaacaaaatggtagttcatcagcagcaatgagagctcagctatgttttctttctccgtgtgtgcatgtgtgtaaccaaacaggtccaccattcacttaacactcaaccaatatttattaagcacctactttgtgctagaaaccctctactatccaaaataagtaaccctgttattttgttacagaatactcgactactctggactgctgtaaaataaaaattaataataatttagccgggcgtggtggctcacgcctgtaatcccagcactttgggaggccaaggcgggcagatcatgaggtcaggagatcgagaccatcctggctaacacagtgaaaccccgtctctactaaaaatacaaaaagaaattagccaggcgtggtggcgggcgcctgtagtcccagctactcgggaggctgaggcaggagaacggcgtgaacccgggaggcggagcttgcagtgagtcgagatcgcgccgctgcactccagcctgggtgacagagcaagactccgtctcaaaaaaaaaaaaaaaaaaaaaaaaaaaaaaaaaaaaaaaaaaaaaaatgtatacctgatataaggtgttataacaaaaataataaattgagtgataagaggagacagatgaaacagcatcctaaatttctcatttcatgtaggatactacttcattaatgacaataattaaacaggcttgaatgtttttcagaaaaacaacagtgattattaccgaaagaataaactgtactttaaaacttcaaattgctagattgataaaagctaaaaaggtaatcacacatcaaaaaagacagagagtgagagtgagaaagtgagtgagaatagaccaagcaagcataaaaacatagaaaatataaaaaagatttatgagatagtactagatatattttttataaaacgaatattagttaatttaattaacattaaaaataataaccataataatgttaaaagataacaaaacataatttaaccataggatagcagtttaaggacactagctttggtagcaaaaacaggattcaaatattatttctgctatttacttgttataatctctttcctactggtgtatttatttagactatttacctcaactttctgctctaaaaaatggaaataagaataactgaacgtagaaaggattgggaaaaaataatatgtaatgcttagtgaccagcacaactaaacattcaataactgtaatttgtaatattatgtgttttaaatgatgtatctaactatgtacccatataaatttaaaaaaaaagaaaaaaatagaaaaatggtgctgatagattttctcaatgcagagttgccacaagccttcagtttgtgaaaaactcaatatctgcgaagtgcaataaagcaaagcacaataaaaataatataaaaaacataataaagagagataagaatcaaaggagtattgtccaagatgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaatattcatataagaatgaagctgaaagctaccattgtaagatctggattgggactgagaagatccagataaaggcaactgtaaaacccctagttagggacatgtgaacaaaacgaaacaaacaaaacaaaacctgtaaaacaaaattctaaagcataaccaagtaatggtaagaaaatcaataattgtaacattcactccagataaatttgattttatgaaattatctgacaatgacctcagcatgaatatgcttgagatgcttagtgataaagtactcatacctaaaaaagaacaagaaatgattaaagatagaaataaaataagaataggtgaataagagtaaaacttaatcagaaatcttaaaaaattaaaaatgttcattaatataaaagtacaataaatgaaataaaggaatttcaaggaaagaattgagtgtattggaaggtaatgttaaggaattcactcagaaaaaaattgtagcaagaagaattaattttttgaaaatgaaatagcaattgagatactaatcagtaagctgattagaaaataccaatgtttatcttataagaattccagaaaaagaaaatggaagtaatgacaaaggaacaataaagaaaaggataatagctgagaattttccaaaactggagtcctgagattaataagtatatcctgagttcatgactaataattcaaaataaatccacgtccagacacatttcagagaaactacaagatatttaggatatagaataacttttaaaagctaccaggagaaaaagcagattatttataaagagataaaaacagattgatagatttctcttaattaagaatagttgacagaacaatagtctaagatataattgagtaatgtctttaaaatactcaacaaaaaatacccagataaattgctatttaagataaaaaacaaaataagtacatttttagttatatgaaatatatgtattacccaaggtcctcattaaataattactaaaaaaaagtaacaagaaaagtgcacccagaaaggaagccacaggatctaagaataatggtaggcatagtaatatctaaaaatattagtaaatataattaagcattgattatagacaacagtgatcaccacttttgaatatggttaaaaacaaataggtaaaactaaaacttcatacacaattatagtaacaagattgatacttaataggtaattaaaagatgctatgttaaccaccttttttatactaagaagaaggtcagaaatactaaaaggtcgattttatattttcttagaaaaatacacagttcagtatacacaaaagaattttagaattagtgctaaagaaacagataaaccacctacagatttcaagccagaagtaaaatccatgtaccagataaaatcacaaaataagctaaaaaaagtttttcaattaaaaccacataaaacacatcattttattttaatgcgtttaaattcagaaataaataataaaaatagagcaaatatgtttacaaagtaaaagcatacccttctaaatacctcaagggctaaaaataaaacagatattatgaaatatttaaaattgaacaaaactacgtatcaaaacatggtatgcacctaatgagaaaccaggagaaaaatttagagtctgaaattcatttttaaagataataaaaattattgaaagtaaaagggtaataattcaattcaagaatctagaaaaagaaaaatggcctaaaaatataaaaaaaaagaaggaatgaaataacgctaatgctgataaaagcagaaagtaatgatttagactacaaataaataataaagtagataagcagaatcaaaagccagtttttgtaaagaagtaaatgaaacagaaaaatgtctagtgtctaataaaaaaaagcagaagggtcaaataaatattaggaataagaggggaacataaggacaaaaaattaaaaatcataagaatatataaataactttgtacaaataaattgaagtataaactgtgaactgtatttaaaaaaaataacttcccaaaattgactagagaagaatcagaaatttcctctgtggttattggtttattctgatattcaagtctgcctacctacaacctactgatgaaaattaccaagttcagatgacaaatactcagaataaaaaatcccaataatgtgaaaactgtttaagatatagaaaaaaatgaaatgttactcagcttattttgtgaggccagtattgtcacagcaaaactctatagtaacagttaagaaaataaaatttaaagattgatctccccatgtaaacatactacatgtcagtaaattaaactcaatagtagattaaaaaatacaccaagagcaagaatattttttccaagaatataagaactgtttaatatcaggaaatgtattaatatcttataaaatattaacatagtagtggaaaattttatcatattattgatgcagaaaatgcattagataaaatttaactagtatttctgattaaaaacacttagtaaactataaatagtttaggaacatattaagaacttccttaatacaataatttcgatttctcaaaatcccaagcaaatgttatgtttctaaaacatttccattaaaataagaaacagaatagatattcttaatgtgactatcctattcacactatactgaggtttagtaatgcaatatgacaggaaaaaattgaacatttaagaattagaatttaagagaatgactgtcattatttactgctgacatacatgttgctgtagaaaacttaagagaatttaccagtttagttattcaaagtagtaagagagctcagcaaagttgctgaatatataacaataataaccaataaacaatgaaatggaaaacagatatgaatataataatgtaagaatctaagttatatgaggaacaattttacaaaataggttcaagaaatttatgatggaaattttaaaacatgattataggatatgaagatgatcacaaatagagggatatagtatgtcactgggcagcaagacacattataaaaatgtcaattctccccagattattttctaatgttaatgtaattacaaataaaattcagcaagacttttgccaaacttgaccaactagccctaaaactcatattgaatagcaaaagaccaagggagctaaaagaatcttaaaaaggaacaaggtagagagacttatcttaccaagtaaaaagaatattataaagctatggtaattaagggttatggtgttagtacaaggatagaaaaacagtccatcggatcaaataaagatcatataaacagatttgatataggcaaaagatggcattataaattagttaataaagaatgactaattttttaaataatgctgggataactgggttatccatatggaaaaagaataaaatagggtgcatgtagggtaccagaaccaaaaataattccagaaggattagagatctaaatgtaaatgggaaatctttaaaactgttagaagaaaatacagaaaggtaaatgaccttggcatgtgaaaggatttcttaaatgacataaaagcacaaattatgaaggaaaatatcaataagcctagttgagttaatattaaaagctttataaaaacaaatactactaaagccacagttaaaagggcacctacaaattgggaaaaaatctttgtaatctctatggcccaaaatatgaaaatccagaatattacaacaacagcaacaactaataccaaaaaccaaatcaagccaaacaaaactcttccaaaataacaacagcacaacaaataacccaacagaaagatggacaaaagatgcaaattaggcaacacagaagagaaaatcccaatggcttacaactaaaaaaaaaaaaaaagttaatgagatattattcaattccgatcagactgacaaaaattttaaaaagtctgaccatcacaaatgttgtgaagcatgtggagaagctctcatagattgttactgagaatataaattggtacaaatacattggagggaggttttacaatacctagtaaagttcaaaatgcatatttcttaaagtttagcatttctacttctatgtatatatgtctataaaaatgttaactgtggtcttgtttgtgattgggaaacaattaaaataatgtccaacaatgagagaattgataaataaattttagtaatacatacagaagaatacatttcatataaaccaaaatatatagcttatgtaaaactaattcatgatgatagaggttacagtggttttgcttgttctttaccttttgttaaaactttggaaaatttcaccttcaaggggcacatacaaaggattcttcttaggtattataaatattctgcaccttgggttgggtgttgtcacatgtatactcatcaaggtatacacttaatttgtctaattcactgtatgtaacctataataaaataataaaaaataggttcagaaacaaatgttccaaattattaaacttcgtttaacctgggttctggattcttgtatttcatattatcctttatacttccatgtgttttaatttttttttttttttaaagacagagtctcactctgtccaccaggctggagtgcaatggtgccatctcagcccactacaacctccgcctcctgggtacaagcaattctcctgcctcagcctcccgagtagcttacaggcacgtgccatcatgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatcaccaagaacgttacagtatgacctacttaagtgaatacttattaaagaaacagattcatttaaaaaacatgtttttaggtaaataggaacggtgcaagtgtttctttgaaatcttacaaaagataaaaattaattgaactaactaaggttccttaccctatgcaaataagaaacggcttagaaagaaatgtcttcaaactgttgaaatgtatattccttagttggtgtaaccaatgtgaggtctcagttactataatagcaaatgttctattagatttaagcacatcagtgcaaattattaaaatgagactgtctttgtttaaaataaagctttaaaaaatgtaatgtaatctctgagggagtattgcctgaaatgaaagttttaggccgagctctgccacaatcctattgcgcatcttggttcatctgattaaacatctttgggtctcaaaattcacatacattcacatttctaaagtgagtgtgatataaagtcatagcttgatcatcaaactcctttctagccctaaaattctacgtatctaatgagattaatttatcatgaggtgtttttcttctttcctttgttaatttccttacaataaatagacaaataaatgatcaaataagcaaataaataaatattaaaaagacatacacacactgatagctatccatctgaataggaagaaagacttttttttgtttgccattatctatcccctaatgtgtatttaaaaagagagctcccacagaaaagatttttatttttttctaaatcaaaaatagtgtatcatttatttgccatttaagttctactaagaaggaaaacacaaaatcattatggaaatcctattaggaactttagaaagaaaaagctgatgaaattccatttacaattcaaattgttcattcacgtatttccttttgcagaaactttaaatgctgcctcaaactatcttcacctctttttccagggacaatatccctaactctgttaaaaaaaaaaaaaggctctcttctcacacccttcccacctgtcctctgaggtagttgttccacaaagctaaggtatagattacatcaagagatatttgggatgggagtaaaacatttcaccctggagacagtaatgtgtgcaatttgccaagtctaaaagaaagttaagcctcatcaccactttggcaagaaatgtggttctcatggatggacaatgattatcatttttacacagaacttttgaaaatgaaagtacctggggcaccagccagaaaataagtacgagaatgcaagttttttgcgtcaatatttaaatcagacaaaacactatcagtgtacccttaacagacctgaagcgtctagaaagaatacaaggcagctgacaccttggtgaataagagcagctcagttttatgaaaaggccaaagtcttagggcaaactctctgttgttccaagtgctgatatacctatggcatcaacaaaggcaaaacaccatagggggcaataggcaaggcttctcttacaggcaaggctcctgttaaaggctgggaccctctggactacacactcgaggaaccccaagtgtgggtccctgaggggaggaagtttcctcaaacagaacggcgagaggctgaagttacacagtgtaggagtactccctgctggcagctgaggttggaaatgaactggtgatgtcctagagagggctgcttaaattttctatgaggaggctaatggagataacagtgctcttgaggggacaagagcatgggtctgattaggtttagataactccagatattatgctgagtgaggaggaggttaagggaagctactgatgacaggaactccaacaattgacaaaaactatgtgtagagctggtatatacaattttcatttaagtttcccatctcatatcattctataaagcatacacagccgtatgtgcacatgtgtgtggggttcagaggatgcaggaagaaatctatttctgtgcagttcattttacccctgcaagaacaatctttgaaaccgtctaatgtattcacatttatgttttacaaggaatcccttccatacttctaatggacctgcctggtatgccccctgtaccactatacctaatccctaggcaggtggtctttgtatgggcctggggcaaccacactggtttctccccagtgctctgctctgttagggttcttctgcataataaaatgaaggtcaaaatggcagcctgctaaaagcagcagtatttcagttgcaggaataacttgcttgtcatcaacttgttaatgcaatagtcaaacatttctctgacatgtacagtatcagctaacttcagcagataaagggtctagaacaggaagatgctgcagatgctttagctcggaggaaggcttagcagagccaaaacgtcagcagggcctgtttgttccatactttccatcgggctctgtgaaagaaatgttagattactgcaatgacaagtttgtgacaagcaagtcatttgtgcaactggtgcgctcctgtttttatctgtttaccattcagacttgtgaatgccatttcaagcacttagaggatttctggctcccattaaggggaaatggttcctccatgtttagaattttctacctcaaagagaattactaagcaattatttgttcctgtggtcagtgtcacacaaaagcactcttgagttgtttagctggactctgaatcatgaaatgaagtcctgaagactggatagcttggagcatcaaaaatttcccatctagtttattggaatgactacaaagcaagcctgtgagagacaataaaattatggccagcttgaaataccttgcccttttgctctgggatcatatatcaaggccatatgcttcaagccacataaactcacttgtaacaagtagatcctgagaagctaaggcctggcgatgtcacactgacatgtgatttagcatatgactgttttggtgacaaggaccactttagctgttgagaagagaatttccactgacttctctctataccttgtgggtaactatagggtcaatactaatccagagaacattttaactgtggtaaaataaagtaatataatatcaaattaataactagggccatcctcactaggctgactttttaatagtgaatggagaccctggcagatttgagatcaagaattcaagatcctctcattaggtccttcacctgaagttgctgagtttcttcaagtcattttaacctcctgggacgaaggtagaaaataacagcacatgttcctttccatctgacataaatggtctcagggtcaatattacaaaagatgaagagtgccttcagactcaagaacaagaatgatactctctaaacatcatttattctttctacaattttacatttttgcccattgttggtactgaatttatacataactctaggtataactcccttttttttttttttttttttttttgagatgaagtctcactcttgtcacccaggctggagtgcaatggtgtgatcttggctcacggcaacctccatctcccgggttcaagcgattctcctgcctcagcctcctgagcagctgggactacaggcacccaccaccacacccggctaatttttgtatttttagtagagacggggtttcaccatgttggacaggctggtctcgaactcctgactacaggtgatctgcccacctcggcctctcaaagtgctgggattacaggtgtgagccaccgtgcctggcccaattctaggtataactcttaaagaacataacagaatgaggctttgaagcagacacagatgtacactatctggggaagcaagtcaaagccggaacaggtggaatgtcaaggactagacaaaagtaatgatgtaaagtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatattttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcggacagctttcttaccatgacaaggatcactgaaacagtctcaacttcaaactttgcacagaatgtatcctttgttcggtcttctgctttgtttctctttaatgatagctttgccatgagtcccattcgtatgtaactcagagctatgcaaatcaagctggtaagcaagcatttgcagttactcagtcttaaaatgaatatgtgtccaaccagtggaaacctgagtgaggaatgtctcctgaacattatgtgtggaatggctcctttccttgatgggtggcaaataataaactcagtgagatctgcattatattccctggtctcttttagtgtatgctcagagtgggtcacaagagtggttttagcttatgtaaaattttttcttatagtatttccaattttttttaacttcttgatgtctcccaaacacagaattcttaatagctactgaaaaatccccatgcctgaagaatcctaagatcccagggcaaaaatatggtaaagaacattaaacaacccatggtctgggtcttaatctggtgctcacagtgatcattcagtctctgctgcataccaccagggcacggaactctccactgtaggatacttctttctgttctgttcttccttatgctgaatcttaatccatattagtctgttctcatgctgctatgaagaaatacccaagactgggtaatttataaagaaaagaagtttatatgactcagtttcgcatggctggggaagcctcaggaaacttacaatcatagcagaaggcacctcttcaccgggcaacaggagagagaatgagtgctgagcaaagggggaaaagccccttataaaaccatcagatctcatgagaactcactcaccatcacgagaaaatcatgggagtaactgcttccatgattcaattacttctcaccaggtccctcccacgacacatgaagattatgggaactacaattcaagatgagatttgggtgaggacacagccaaaccatatcataatctatctttctaaaatccccccagtgcgtctagttctttctcaccctaaatttcagttcagagcttcagaaaattattagtttaatgactcatttaatgacaacccttgtgtgtattacataccaacaactgggtttagattgtcctgccttgtccctttctcctcacccaacatgatttaaattcccactctatccctctgacaagccggggagaaataaaagccagtcacacccatttctcatttccatttggatgcaggtagtactggtggcaaagcattcttaatctctttgattttctgtcctattctgtggaaaatctttcctgacaacctcaggcatctttgattgatatggctatttatagattgaccatttaatttattgtccaagcagggacacttttgacagtgaaagggccttataaataattataccaagactacagacttaaacaagaactttcccaggcaaacttacataacaccttgcatatacttttacttcaatacccatctttttgcataaaaactttcatgtctatttttcccaccaacctgtgaacactctttagcaacagaaacatatttttacctatgcagcttcagttcctagaaaagtgcttgtaagtataaagacctgggggtaaatatgtactgacgcacatgcatatgcctatatgcatgtgtatgtgtttgaattgatggtatatttttccataattacattctgtggacctctccccttatttcatagcaaataccaccaacacatgttaacttcatatttttggagatgaatcaaaaatatttcacttaatgccataggaaggaaatggtctgagtatattggtaatgggtttgcttttaatattgacagcaacaaacagaaagtgaaatgtgataaattttccactaaaagtctactgcatatttttttaacaaagcactgaacaataagctttaatcgctttcttcacaagtattataaattgtttcaggccgtgtgcgaaggctcacgcttgtaatcccagcattttgggagggcgaggcgggcggatcacctgaggtcaggagtttgagaccaagaacggccaacatggtgaaaccccgtctctactaaaaatacaaaaattagccagtcatgatggtgggcacctgttatcccagcaggaggctgaggcaagtgaatcgcttgaacttgggaggcggaggttgcagtgaagctgagatggtgccactgcactccagcctgcagcctgggcgaaagactgagactccgtctcaaaaaataaaaataaataaataaatttatttattaatttatttaataaaaaataaaaataaataaaaaataaacaaaaataaaaataaataaataaataaaaatttcagcagctgtatccacaatttcaagtttgtagtaaatgagttattataggaaatgatggtaatttaagagtgatcctttaatctccattaaaatgttggtggcatttctattgctttcaccctcgtcaagcacatttggaagtcctggtaacttttggcagtttttttgcttctgagtaactgtggctttaagaaaaagaaaggtaaggagaaagtgcctggaaaatgtgaaccacttagagaagtcatttcttcccttctcgctgacacatgcagaccattccagaaagatatgactctatactggttaaagagcttcatagaggataatctcacaacttccctttcagtgtttagcactcactattaataacctatctcattatcaaaccttaagattttctgttgcagcatattttgtcattatcagacctcagtgaagaaaagagagaaagccttgtttcccacttctcatcacttgcttaacagctactattagcgctctaccttaacattcctttttccaagataaaaaaagtcaatgtttttgactcttccttgagaatttttttccaaaatgttaaatttaaatttgtttggaggggtttgataattctgtctctctaagatgtttgtattcagtattatctgaaatcagaacaagcatgaataagtatgtaatctatgctcataagaaatcagagaaatatctatatttggcatgcttcttatacattccactattatagctattttaaaatttcagtttgacatttcacactcttgataaactttctataatctacttctagatgctatttttcccacagaggaagtcattctttattttcagtccatcaatgacatttaccaaaccatcacggataatgaaaaatataagacttataagattcaaaagaaacaaagttacatgtctattatttcagagtcttaaatatgtggaaaaaagaagacaatcccacacaaaagaagaaacatggataagcatgctcaggtgtttggtgctagctcaccagctattagtataggtgaactaatacagctatatggaattctctatacaagtgatgaagaagtagtggatgaaatgccacttttgaggtctgctttctctcctgaagaaaactaacaataacttttatttaacaacgttttgtttattcccagttttactgagtgttcatttcagtcctccctctgaagtggttagttatacttatctctcaaattgttgttatttggacactgtacgtaaaagcattgcactttgaaagcatgcatttcttgtcctcaacatctaaaataatgatttgcaaccatttagaagttctggtatcctgttgttaatgtgatttttgcatcactcttccttgcctattccttaaaatataattttaaatgaaaattaatttcattttgaggttttgaaatgcctctaacaataatttagaatacactgaatttgccaatattggaaaacatgtatgtagtctagattatcaagccagaatccaggaccgacctcaatagcatgtcacttctatatctctcaatactgagtctcatctcctactaatcatttcctgagaattctgaagtgctggccacaaaataaataggttagaattttttattttttggtcatttgagacagaattaaaggctctgctggttacgtggagttatatcataatactagctttgccttagttcagcaaaacttacattgggctaagaaagaagataatatattatcaaggcgttgtgtcctggtatcatcaaacgatgggcaaatcgatttcattaggtctctcctaggatatttcgtggaataaaagttagagttctatgtctataacttgcaggatagaattattaaaaatggttgtatttaagtgcattttcccaaatagtgagtttccttttggcagaaaagagacaatgaaggtaaatgtgaaagtatcatcaaccacaaactagtaagctgaactcaagtataatggcaatcttcctgggtgatcagccatagagcaccatttgtgcaagagtctgaatttctatactaacttacttttaaatttcgttgaatacaaacataacaatgtttttaataagtggcttatctattaagtttatagagaaccttccactaaagagattacttattctaatctattcttttgtccaatcttttccccatttttgcccagtgttttgtttatataatattttattctataaaaatctatattatacattttctacctgccttgtctattcttatacattcacaatctattctactcttagtatataatttgaacagattcacatacataaatcaacattcattacttctgggcatataaatggttgctgggtccatgacggctgtttaaataggtagcttccaggccactatgacatagggaaaaactgaaaagtgtatgttttataattattgagtaaaagaggattttcattatggagacatgtacagctatctcaaaggcttatttttccaaaaggaacaacgacactgtcccctgggatatgtgaattgaaaattcagtgtcaacctcttctaaaaaagtagatattttgaggtattaaaaagcgttcttttattagtgataacacctcttacttggggtcgttttgagatgaaagttggcaagtagatttttcaataaggcggggtgggaatcactataaattcataaactaaaaagaagaatgacaatttattggcccaaaaataggggagagggagagatttttttgttcttttttcttttctttttttttttttttttgagacggagtgtcgctcttgtggcccaggctggagtgcaatggcgtgatctcggctcaccgcaatctctgcctctggggtttaagcgattctcttgcctcagcctcctgagtagctgggattacaggcatgcgccaccacacatggctaattttgtatttttagtagagacagggtttgtccacgttggtcaggctggtctcgatctctcgacctctggtgatccacccaccttggcctcccaaagtgctgggattacaggtgtgagccactgcgcctggcctaggagattttggaataaaggtgtctctgtgactaaaaacatataactggtcatagatagtctgtttacctctagtgtcttttggagcaagggtgtgggtctctctgttgagtggtgcctatcattaggcatcacagcaacatcaacaaaactcatctccgtaatatagtagattttacattgtgttaaggtagaccttttaaacaactccttcaagttttctgttgatttcctgccagacagtcagacagctacttcttttttagtaggagtagtcaaggctaaagtcaatacatgtgccttccttgctgagttagaatcaggcatattccatcaacacatatgtcccactgttctcatttctctcactttactatgtgattagtagacaaagtatatactaaagaaagctgaggaagttgctaggatttctaaagaagaagaatccaaatcttgcctactttaggcaaaaaacattttagtattaattgaaaagagatggttaaattgcaacccataaattaaaatgtagttccaaagtgtgtctatagtgatctacaagcaaacataatttctcatattctttttttttttttttttttgagatagagtcttgctctgtcaccaggctggagtgcagtggtgcgatctcagctcactgcaacctccgccgcccgggttcaagtgattcccctgcctcagcctcccatgtagctgggattacaggcacatgtcactacaccgggctaattttttgtattttagtagagacggggtttcactatgttggccaagatggtctcgatctcctgaccttgtgatccgcccacctcggcctcccaatatattattaaaatatattctgcaggctaattctatgttcttatctcattcctgtttcttcctctgctccagaaaggattagtgtctagcataaaacaaacagtatataataaagaacagataatgtatagtcataaaattctgaatccacagcaaaaagagggtaaggtcttagtctagcaggtaagtcttattgacaataataaaggcatgtttctaagccacccatggaaaataccaaaaatgttctctattatatcttgaggtgaagttttggccgtgtaaaaaattatggttaatgctgtgtatgttatgttttatttgccttcattctgggaccacaaaaacggatctaactatagataggggcaggagagcatttgtgtttcttcattagaagctgtgcatgttagtctaatgtataagaattaggaaaacaatactaaatctcttgatgcaggccatgtcataaatccatttatacttatataatattttcctttttcttattctttcaaccttcatgcttcttttttcatttaaaaaactttggggtcagcccttatattaccagatgatttctagtagttgaagcccttgggaaattcatttgtccatccatgctgcctagtttagtacaacactccaaagggaacttccttctaccaaaggcaatgactgattggacttaaaaaataacttctataaatatgacataatatctggaggccacatttatagctggtcaaatgcactgttagccctacaaaaggctggctcataattatgaggcaataacatgtaaatttccctttctgatgagaaactaaaggtcacataggtcctgagttgtattaagactgcattaatactgttcgttagacatttcttttctcagtctcaacaagtcaccttaaaatctatggtatatagcagatcctgagcacctacatgaaaagcaagtactcaaatgttagagacctgaattgaaatcaagattgagatccatccaacttaggagttactgctggttcaatgagtccagggaagaggccatttaatgattcctccaaggaccattaagagttccagggtattcccttggatatctggaaacctgggttacttgatctgagcatgactaaaaactgggcaaagtcttgcatgcttatcctaggttggacacagatctctaagataagactggtatttggtaagctctcatctttcccattccttcctttagagttcatattcctgatgtattcttgtcacaagatacggtcaaggttacacatgggttaagagctcacagcagtccaataacaaacatgttgctgtaatactggtctcccttgtagaccttgaaagtccaatatgctatcatctagggcagttcatgggaaagttgacataataatgcttcaattattcaatttataaatgggacatttaactgatagagtagggaggacaactgagaaacgtttgaagatgtaaatagtttttgtttcagagaacaaccttatctctccaacacagtaatattttttctttgtgtagccaaatttctctaacacgaggctcacacagaagctatagagacttcacctagaaggtctcaatggccttagagccatatatatatttctactataaaacagcaacaacaattttggcccaaatatcataacctaagcaaaaatacaaacaaaatcaaacaaacgaaaactacctagaatataatcttaaaaagtactgcctatatgccatcaccatgtatactataaaacccaccaaacttagaatgcacaatgatgtcatttacttcaatttttataatactgctttttgaagattcctatttttatacgtaatgggaaacatgacatcatataaatgaggcaggcaaacagaaaggtgtagaaggcaaatgcaagatgcctatatattgtctaccaagtgttgccagttgtgaaaggatttgacatgctaatatccattcattcactaagagcatgatggctggcaggctctgcatttaagtgcggttatcgaggcccccaaatattgacagagtgccagattctaagaaactattgatgtacacagccggccacagctccagacacctctcagacagagtctttaaatgtcacagataaatgaattttcatgaaactgagagagaggaagagcaagaggagagaaagaacacagaatgagaggcaggaaagaaacaagaaagaagaaaatcacttccataacactgacatgaaagcatgtggcatctcatctctaaagctcaatcataactccttacacaggatgtgagatcaagccttctgaatgcattgcattaccaaagcactcaaacacttttaatcatttcattgcatggtattttaaaagttaagggagatacatgttacagaatagcttcaacaaactatttctgagcaaaatacagttcaaatataaatacttcccgactcaatcctaaagcaaattaaaaaaatatatatatatataaaggcccacaggcacagataagcattggagccttctaagcagttctccatatgcataaaaggtgaaaagtcaaggtgtcatgaaatctattttatgccaagacacaaatgtgtcctctgacattttcttctccacagtcctactgaaagtagtgacccctagtgggtttattgcacgatattaagggatgccttcttccttcacctctcttttcctgcctttccacagaaaacatctgccaggaaaatatacgagtcagttacttgacacatgataacaaaagtgagccatggttataactagaacgaccaagtattccttagaaatcatgtgtaactcaatatattttaaacgtaaaggaagcttttttactttgaaagttttccatctgctgagggcagcttctcttgaccttgatacactgtgccattgaaagcagtcacactttcaaggttagaatatggcttgtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccctgtctttaaaggcttttattttgaagacaaaatcagttttaactcaaatggaaattgcagtaaaatctcagacactgtaatcagtgactgcattaaaactctcaagaaggaagccaacttccatgtgaggccacaattcagccaggatcacaaagagacattatccactttgcctgtggccattctgtcattttagactgtaaaatttttatactgtaaaattaaggttcaaggaaatcttctctaactttcacatacatacacataaatatactgatttttgcctgtaaccatataataagcagagaggttttggcttactttagacataggtatagaagacacttaataaagattattaaaatttccttcattatataagtaatagtgttcaccaaatattcagtgattggttaacacaaactgtgttatacaccctacagaaaatactgtaaagttgctaaaaaaaaaaatagacttaaatgtgctatatgacaggatatgacattatatatgctcaatccctcttgtataaagaaaattagtatacatatatacacatatttatgatagataggcatatacacaaacattttcttctggaagtatatgtaagatacttttgatgtatttggggaaaataagatggagaattttacttctaattacatatttttctattctgtttgaattcttcaaacatgtttaaaatataatgccaatagggatatccgagtggtaaggttatgaggaatttttttctcttcatttttttatatactggaaaatttaatatatcatatttcaaaacggaagcatcttcaaaataattatgtaatagtaattcatgttagttacaagaaacttgaaaacactaaaaaagcatgaagtatatcaacaaacagccttgtaattctctgacccaacaataaccactgtcgaatttttgctgcgttgtgtccagtttgcaaagtctcttctgctttgtacagtgtaagtaagaaagatcctttacattcccttaacggggggggacccaaaacagctttatgtgtcatttgttctgctatataccttcttagacaccttcaccaccacaccgtttttagttgccaggacattgttgaaatagcatgctatatgtgacacctccctaaattacacaggttctttattcatctgctattgccccctgaaaaacatgatctctgtgctatttcataatagtacatggcatttcatgatggaagccatggagttgaaggcaacagtggcctcatgctccacaattattatagtatacatactgaaatagtttcgtgaggactcagaaatgttcttctcttctgaatgcacagagatgcttccctgtaaggagctctgtcttagaacttcttcaaagcctaataaagttgaaggaaaaacacagaaaggtgatatacttggtgtgatattttaagcaactgacctattaattataataccttttgatattttctttgctgaggatcattttctgaagaagggtatgaaccttctctttcatgcaaaataccttggtataactgttcatcttttaagtatcttatttgccttttggcaaattaaagaattttcctacctttgttgttgctgttattgaaaagaagataataatgacaataataatttttatagctaactcttattggttgctttctataggttgggcagtttacttacattatttgcatttaattccaaaaatacctctattattattgttgctgttattcccattttatagatgagaaaacccaggcatagaaatgttgaaaaacttgcccaatgtcacaaatctactaagaagtagacgaagaaatctacatcagactcattccaaatcttccttaagattattatctagattagggttacatgactgtactaagaggtccaaaccatgtccagagctttcttatttttctaatactatggggggtgaaggggagtgggaagagaaagagagcgagcgagcacataagattccaaataaaatgttataaaatttatctaagacttcattttcctcacctctaaaatggacagcacccatcacagaggtttatcttgaggaccagttgagataatataagtgaaagcatctagtacaactaaaataaaacaccattattgctctacaagtttccttcctttgcataatggatatgttctggataaggtgattatgaaaaggtataggcttaacttctgttgtcaaatcaaagagcaattacactataaaatctcagagaaggattcccaacagattgagatgaagacctgatgtaaggcaggggttcaggtggaggctgggtctacagatttactgggagcactctgtgggttggtaacacattctagatcctcttacctctctctcctcaggctccttggtctgaaaattcctgagtgtactacagcagtttccagagatgattgctttctttttcttttatctggttacaaagtctagtggaatttatttgcaatgatgatacttcacttgaaggccttatcccacacattatgatataaaatagttagaaattcctttaatgtgagattctcaatcagataaattcactgtgctctatttactctggatgtttggttacaggtttccatcatattattaataatacttgcattaacttcctcatattcattacattgaaaggctctgagttagaaaatatgtattctactttcttggaaaccctacactcactagtgaggcctataaataaaatgaaactttaaatagtacgaacttcaccttcaactcataactaaacccaactctgggcttaaagtgctattttctccctccagtctcatcagatataagtatatcatgttactaactgaggccaagctatatatttacacaattcacttcatactaacaacctgctgcattttgttgcttgccttttcttgaggtactgggacttactcttaaattaatgccttagtttttttttttttctctagggacatccttttacttatggaaaatattcagaaagaatggaatttttaaaataagccatctgctgcgcagacctcaagaaaaacagttatgtttgaaaataccagattcaactaatgaggggcacaaaagccttattaactgtgttagctttcttatctttagagctcaggtaggaagtaagagccgacctcagcatgccaacaggtatcaagtgagagaggtcagcacagtctacacccttatgatatagcttgaacacatcagctcagaagtactcttcataaattctaaaaagagaccttcttccagattatctcgcacatggcagcagcctgggagtccttaagacaaaactctctagttctagaacaattcaaacaaggtgcatttacattatatttaatattttgctgtaagcagacgatagaatctactcaaaactatctctatttcactgtttgcccatattcccatatccgtcctttatttctcagcttatatctttcttgaatttctaaagataagaaatctaatttattcatgtattcattatacaataaatattaagtatctcagaaaagggcaaataaatagatgatagatgattaatagatagctaaatatatagacagataatagataaatagctagataaaacagagatgagttatggcctaaagaaatggctaaggaagaagattgcatattgaggatgttttaaactaggtattgaaggatacttgggatttcaaagtatagagagcaaggagaaatcatttcgagcagaataaactgcatgaacaaaaaggtcatcacacgttgggaaaagcagattatttggtttgtgaaagagagtagtaaaaataaaactgagaaggtaaattagggttagatcacatgagagttcgagtgccaaccaaggaatattactctgtcaataatctaggtttgaggaaagcacagtcaacaactctctagctttcataatttaagtaatgagtattataatccaccaaacctctggtctttaggctccacaggggatacgttagatcagtggtagagaaaaggtcctcatatttaatgagtcctcctccagctgagattatcatgctgcatctattgaagttaatcatctcacatgatttgaacaagaatctcactagttcctaatcacactagcattggcccttcattctcaataacaagttctatagagttacctaaaggctgacactgaggctggctgagatgagagcggtgagtatcccaagcacatgtgagatgtctgtagaaagtttgacataagctgtcatttgattttgaataaagccaaattgttcataagtgattggttacttatatatgtctagttcaggttctccctatgatacagaaagtcattatagtatacgtggaactctgagatctccttacacatcttttaaggctcactcctaactgtttaggattctttgatagaaggtgtttcccagcaccttctgttatgctccctctttattgttctctagtggacttactgacttctgatatgctttgtttttatgtatgtatttgtttactttctgcctctcctctccaaatgttaggtctttgaaaacaaggattatttgaatgtgcctgttttgctcactgttgtatctccagcatgtagaagagatacctattgaaagactgcttttgaaactgaagacaaaatatagaggaaggtaagcacatattaactggtatatgggggaaaaaaggcttctgtataaaactccccccaaaaactcatatgctatataatttgaaaatatcatcagctaattatgtcacggacgaattttctataaaactcaaagcacttttaaattaaaagtatgtattttttcttcctgttactgaagtaacaatctcattctctctattttatacaaagggaaatcatggcagagagagagatactctggagtacagcagatgaattcagagcttctgactctaagggccatctatattctatgcactatttaatgttagtttatattttactaccagtgagatttaagtgctgaattgaatagagtcctagaatttgtaccaataaataatgttattaacttatgctctttctgctagcacatggccttctcacagatataagcaaacaaataaataaagagcaacacagaaagaggaaaggtgaataacttaaaggggtgaacatggttgttcttatttttaaaatccagattgttcattttcgttgtaattgtattgtattctactggcagaaagagatgagatttagtgtactatgcaaattatagtaggtccaccacagcttatcaagttctgagaacagtatggtttctttttcctcagatcctcttttacccttaaaatatcttctggattaaaattctcattcaatgaaccacatctttcaatataaaaaatgaaattataaaagtactaaaagaaaacattagtaaatttctttataatcttggcataagaaaggactttttacctataactcattatctagaagctacatagaaaagattagtaaatctgattatatttacaaacaaacttcagtatggccaaaaaatccataagtaatttttaaaagtgggaaaaacttatgcagctcacatagataaaaggattatcatcttaatgtataaatagcaagaaatacataagagaaagactaacaacccaatagaaagaaaaggctaaggagatgaacagacaccttatggaaaaataaacgctaatgacattaaacatattaaaaaagatggttgacatcacttataattttaaaaatgcaaactaaaactataccgagataccgtcttttaccaatacaattggcaaaaatccaaaagcttaaccaagcactattttatagttgaggcttgggtaaaaaggtacttttatatatgccaatggagctgctaattgatccaactcctgtcgagatcaatttggcaaaacttttcaaaattcaagatgcatataaccctttgatcaataattttatttctgagaatttatcctgcagataaacttgcacatctatgaaatgatttatatataaggttgttcactgtaatattgtttgaaatgaaaaaaattgtttatcaatcgggactgaataaaccatgatgcatttatataatggaatactgcaaaactataaaagagattaaggcagttctctatgtatcaatagcaaaagacctctaagagatactggagaatacaagattgagaacagtgtataaagtggtttaacttttgtgtaagaaggtggaaggagggaatatatattcactttttttgcataaaaagaccactggaaagttacacaaaaaaaataatgaataaaagtggttactaatgggaatagaaagagaaaaaggtggatggggagaagtgaagacgtttttacatagttttgatttttgaaccctggaaatatatagcctgcctcttcaaatatatttaaaatatatgtaaaatatatttaaacaaatatatttaaaaactaaatgaaagataatctcatattaaagtaaaaatgagaacagcatagcaatgataaaaatggttcctgagctccataaatttctcccaacttttagctaccggtgcagccaatatctgggtaaacgtggtaaaaaaaacttggcagtttggtccaaatggcgtctttggagcaaaaaatgattcaggttcttccctttgactttgtagcattcttcagatgttattaaacagttattcctttctaagctcaatcgagttaccagtaaaatataaaatgacattagtgttgcagctgtgaactagttgggatgaatccctttaaaagcctaggatgatttccatgtgttgagtggagaagacctggatgtttgcttgttgctacgtaataagaacaaaacacatttcttgaggaattttaatgtgtaaaattgtttttaaaaataagtaaaatctatttattaattatataatatttatcaatcttctataatacttaggcgatgtactcagtatgcataacattcttaacaggaggcagaatacatcattaggcagatgatgtatgttgagtacttagaagttcctaaaggagaagcctataaagacagtgcattataattaataataaatgtaatagtataatttttttgtaaaataagcaacacatttatccactagtcagaaattatagcttcaattcaataagctgctttctcatgtttgtattgagaatgccatctagaacaatctagaagccacagacaagagcaggggtgaaagctcctaaatttcctatttccgttgtcccatgactttttggtaaaaagataatcagtgaattacccattttgtgtaagaatttcttcctctgggttctgttcttattttaggcaatgattttaaaacatggaggtaggtaagtagggagtattcattcaatcattcatttgtattaattaaacaccaagtatgttctgtgtatttcgctaacattagaaatgcagagacaaaagacataatttttgcccccaaatatttcaatctagtggggagaaaggaaagtaaataaccaactaattataacacagggtgaataacctgctgtaattgacttaagcataaatagctgtgagagaacagaggcgtgggactctgacttttaatgaggaggctcaataacaagttttgaggagtgggtgccttagctgaaacttaaaggatggaagaagttaacaaggcaaagatttgagaggatagaaagggattctaggtataggtaacagaaaaaaaaaagtacagagcaagacagaatatgatccattcatgaactgcaggtggttccagacagaggatagagtgatggttgggaatgccaagaaatgagttttcaggcccatccagattgtgatggaagcactactttagataaggtgataagggaaggcggagatctgaatgaacagaaagagacagccatgaagagcttggtgagaacaacgttcccagcagagaactgtacttattgcacatatatgcctattttaaggaatggttaaagagctaggggaactgattcctggttgtcagagatgagcagcactattccaaatactcttcccctgacaattatctaatctcttttgttgtctctggaagcatggttctttcccatcaatgaattcattcagtccctgtaatcaactctgattagtgttgtttaacatcaatcttttctactttttttcaaagaaagataccaatcagttgctgcacacccctgcttgttaaaagcagcacctctcctgctgacttaccgttcttttaatcaaaagggcaggaggaagcagttgggattcacttttctttttttttctttcaaagtacacaaatgtcaacttccttaaggatgtctggcatagctgagttcagtcatgtaacatacaaagtcagcttgatcaaaaggttgcaggctgcccactgctaaaatggaagagaaaaggaaaccatgggcttccctgaagtgtgaatgagtgcataggccactgccacgtgtgtatttatactgaagacatgctgggctgacaagggagattaggaaacataaatccccaccactacactgctctatcttcacctttgaacctctggagcagcactttctctctttcctatttcttctgttgtgcccagtgaaggagttactatatagctttatagcaactgcaagccatggctatttttgaatatttaaaaaaaacatttttgcggccaggcactgtgcctcactcttgtaatcccagcattttaggaggttgaggcgggtggatcacttgaggtcaggagttcgaggccagccttgctaacatggtgaaactccgtctttactaaaaaaatacaaaaattaactgggcgtggtggtgggcacctgtagtcccagctacttgggaggctgaggcaggagaatagcttgaacccaggaggcacaggttgcagtgagccgagatcacgccactgcactccagcctcagtgacacagtgagactcaatctcaaataaataaataaataaataaatgaataaattcttttgccccaacatttagttgaagtttataattctcaatttgcaatatgaggttataattcacaatatgcaatatgaggttataataatctcaatatgcaatatgaggttataatcatttctatggatttaaaagtgttaataactagaaaaagcataaaactgttcattcattttttttttttttttgagacagagttttgctcttgttgcccaggttggagtgcaatggcatgatctcggctcactgcaacctccgcctcctgggttcaagcgattctcctgcctcaggctcccaaatagctgggattacaggcatgcacccccaacgccgggctaattttgtatttttagtagagacagcgtttctccatgtttgtcaggctggtctcgaactcccgacctcaggtgatccacccgcctcggcctcccaaagtgctgggattacaggtgtgagccatcacgcccagcctcattctcttactcttttaataaatcagtatgtatcatgtgacaaacctgtatctgccaatatgacaaacccttgtcaataattctcctggaagatgcttctggcaacccagaaccagaaaataatttttccaaagagttgattatcttagactaaactaatgactcaagttggttttacaaatagggaacactctgtaaatactcatggacatatctaaacctgaacatacattctcatgaagcacaaaaatcatcatatatggttacagtccccaaacaaggctgcagaagaatttaacattcgtaacaatgtacagctagtataattacattttgtgcaacctcgtaattctttaacagtacaactgaagtgatgagaaggtacatactgatataaggtaacatagctctgtgttctagccaaaactagaactcaggatccattatttttaatctaggaacttttatgtgatgaccatttactaggaagggttgggagtaaaaagcataaggcaattgatatagagaaacaaggatgctttaaaaaaacaaaaacaccagtctaaaagaagactattctttactcacttgaaatggctctgaattcctgggaagagcataggaagaaatgtaactataggatcacttttatatgagtaaattaataaatcatttcccctatgttctctaagaaatcttttagaacaatatttcccaaacttccctaatcataccaattgactagtttcttgtttcagatccaaatgccaaggccccttcgtgaaaatttcttattctctaggtttatggtagactcaggaatgtgcatatttcaagggtgaccctgatgattcttagttcagggatgtttgggaaacactgttctggagaaaactttgtacaatagctaaacatttcttcattcctaatgaatcatcccattttaatgtttctgtggtgtgtcttaagcaggtgcagactctcatagcaaaccataaactcctatgttcctttaaaatagcttaagatacatttactcagttttcaggattagcaaaaagtcaaatagggctgttaactagcccattcccacagaagcaccaacctgtaattcccaagtatcaattctaatgtgttcaaaaataaaagcatatgcttagtcatgtaacagagggtttctttttttacttttatttcattgtctgtcaatctggttgatcagattactaatttctactctactggaagtgatctttagaaaaacaggtctgccatgtttgcattacagagatattaacaataataatgatttttaaaaagtaaaccaaacataaataaacaggaaaagaaaccaccatatttgagtccagtctttgtcctgcctagtgaaacatctgtcttatacctttttgacaggcagaaataagacctttcacatcgcctcatctctctgataaatcagtctatttccttacaaatttggtctgagacaaaactcttctgctcttccacttaccatttagaaaggcacagtcagaaacaccatctaagatgagctcacttctgggtgtctttcagttagacttctattaaatggataacaagaaaactaaccaagaaacaaaaatattcctgtcacttcttttgcaacaattccacaatcttgaggaaaattgaattttgaagaaaagaatggtctatgccatcttacaagcatgagatggaggagcaatgactataaagaatattcgttaattttggttgtactgtagttatattacaaattgcacaattaattcccactatcaaattacactggtaaacaggcctagattaaaaacacaagcctgctctgcttgttttgctctgttatacacaaagtaatcttaaattcagtttattatcattagtatggtttcactttgggggaaaaaaactctttttcctcataaggcatattgcatattgagatgatgaagaccaaagtcaatgctgtagagagttgtagggatataactgctgctaaaataagcacttggtttagtagactatttcccttagacgcttggagcacaataattttttcctgctgggagacaatgtatatcctgaatggggtagggcctgaaagacagtgaaatacagccggaaatacacctgatggcagaatccaccaggatcagacagcatcaggacagcattaaacacagtgtttgaagatagcagaggtatgtggactctcaaggaacactgaaagattacagattgtaggtgagcatggttttgagagtctatctctgctagccacaagaaaattagcagtcaacatttgcaaggtctgtttaattatgtcagtgaccagagctagcctcccaggttaagtgagaacgagaactaacaagctgcccctagcctccttcaggacttaaatgataaagccatggcaatcacagcagcagcagcagcagcaaaagcagcaacagcagcagctgaagcagcaacagcagcagcaagaacatggttttgacccgcagttcttgcccatcaaagagctgtgccctgtctgctcccactgacaggcagataaatacagagatctgttggcaagtacatatttatgtgtatctacagttccctcacacagacttacagagaatgcataacagcttctagtggtataacaaatgcacccactaatggggtgagacccattactcacaaatgggtgaaaagaagcatcaatatgcaggtcttaaccccagtttgtgggcagaaacctgtcattccattgcaggccgataggtctcctattcacacagtccttgtttaattttccaaacaccctttctctaaatggtgctactctgagctgtgtagtgcagacagacaggtttgacaagcagagctgtcaatttcacatttttcatcccaactgcagggcaaaattaggccttgtacgtaactggggttgactggttaggaaggcaggagaggttggcatttaagaggtattttccacattagaaactcagaactcaagatagaaaactcaaaaagggttgtccctattcaacatccatgaaatcaggagagtccaaagatgtgtactggtggtctactgtggggcatatacattttgctgaaacgagaagatgaagggaaaagtaaagcttggtcctatctagaaggagctatgggtaagtaagtagtgaaagacactcactcaaataccataatataaaaatggggcacttgccgtaagagaggaacatagcaacgtgtacacacaattcttggttaaccaagaagttgaatatataagtaatatattagtcaaatttttatccttcaaaaaattttggaattgtccaaagaaaggccaacaggatacatgctaggcaatgatgggtggattaggcatacaacgaaagcaagttaaccagcgctgtttctaacaaccaagtcccagaatatccttgggatctctgggactatctcaagcatataacatgagtctgggatggttttgaaatctctgctagcatatgctctgccctgaggtttctttttggtgctgatttggttgaactgaagaaggaagggagaacacatagaagaagagttctctctattttcaggcggcagtcctatctataccggtggtacagttaagaacctagaatgaatgctcctccagaatcccctgtgcagatcgacactctatggtatatgagatctcacagagtcttgcatatcagaaactcacaaacgggaacacagaagagtctgtgtgtccctgagtttatgctcaagctgtcaaacatcaagagtaatttatgttgttcaggaacatactataacaaagctctcacaggttggaggcttcagtgagcctgagggctcacttcccaacctggacttaccccataaggagcaacggactttgctaacatgaaatcaaaaggcaaaggaaatcaggcatttaggaggtattttacagttacaattacccaatcctaggttggactaggattggggttggtggggaaggagacatggaaagtgctgttaaatgttgtttgaaatgtccctttttgatccccacagtcatgagtgtatttgagtcttgattgctctttacttaaattattgtcattgcccctcagttggcatctctgactaatcccaaccctctcaatctactctgcacactatagccaggttaacttctaaaacatgcctttcattatttttgcttgtctctgtaagtgtttcagttattcagcaaatccttattgcattctaactgtctgatagctattgttctcatcacccacaaaaaataaatctggactctgcctgccttttggaattcacatcctagtcttcaataacatggctctcatttctagtttcactacttcctgtatacaccaactttatttccattggttgatatttttcttcatcctccctacttctctgttttcccatattaaaccattggctaccatctttgcttctttccaaaagaccttttattccattatctttcaacgtccagcttttacatctacagctaaagttctccgtctactattaatcaagccttctatactcctttctaggccaccataatgcagattcttgtagtactcactacctttcgttattgctcatgttggtgcataatggcagattggtaatttccagttagttttaggatctaattactagtctctgcaataagagtataaaaaccataagctctctgtgagcaggtattgtgtttctgatagtaacattattaactgttgtgataactgtgaattaagtttagcatcatacttatttctaaatttaaattgtaccacttctaacaaaattttctccatcgttttattaaaaaaaagtccaaaagaggatgacaataacaggaacacaataaatatatatccacatgtaatggtcagtggtcttttccagtgacaataatgctgcattttgctattagctcctttcttttttacgtgatattcactattagacatactactacactaatgccaacattttccagtaaaaattgacattaattaagctttggatgttgtcagcactagcctagggatagggtaggtttagggccactgagaccaagttcagggtataagatctctgatattcatcaagcagctaagataagaagcataatgaaaggcaaaacaaatggtacaccatatagtatgccgaatatttttaatgctgatttttgtagatagaacttgatatcagcttttactcatttgttattgatatatgtgtattttcttaaaatataataaatatagaaaagggtttgtgaataacataatatgaagatcagaatcaagattagagccaagggcatcagattaaaatgcagatgaataatgaatcacctgtaagattaaagctctaattccaaatggaaagaaagcattggcaaaggcatacaaacatggttctagtgtggtgttcacagttccatgaaggaaaagatgaagcagataggagggtgggcctactgtatggactaggtactggtattaagggttttgtattaggcaagaagacaaaaataattaaaagagtttggactggaagactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggtttttttcctaacaagtattaaccatgatcctatagcataagagtgagtgatgatgaggaggatgataatggtaatgatgataacagcagctgtttattgagtgcttattatatactaggtattggtttaaatattttacatttattagattacttactccccacagtaattttataataaaaacaaatttatggtcccccacctccttctcctcatccttaatttacagataaagaaactgagtcatgagaattagttttcttaaggttacagtgttgtagaatctacgtagtcttcactcttaaccacactgctctactgcctaaattcaggtaaccaacaaaagagttgccctgcctcatcttggagcttatagatgtctacagaatatattgagaaatatatatgagaaatgatttaaggatattcttaccagagcagtagccattctaaaaattatcacaatggtatattatattgtttagacataaaatgagagtattggggtaacatatatcagagatttggctcttacagattttaatttttaattgtactatttaagggaaaaattgagtattgtgaggagcactggaacaatggaaaaggtaatatggaaagtaaaaagtttagtctcagcctggtaagtgtggctgtctatctcttcaagcttcctttcctcaacggggtgacataagggttaataggatgactgtaaaatgcagttaccttatgaagaatgaaaaatcccattattactgagatttttcaaaccctgataattctgctgggattttctgaaccatgataattctgctgggatctggtattaaacagcatgtagacagattaatcccaagcccagaaaagagcaaacaaataaaacataagtagcataatgactgaagaaagttagattgtagtgtccaatctcatagtggccactttttttgtttgtttgtttgtttgtttgtttgttttgagacggagtcttgctcggtcgcccaggctggagtgtgcagtggtgtgatctcagctcactgcaacctccacctccctcccagtttcaagcgattctcctgccttagcctcccgagtagctgggattataggtgtgtgccaccacatccagctaatttttgtatttttagtagagacgaggtttcatcatgttggctaggctggtcttgaactcctgacctcaggtgatctgcctgcctcgcctcccaaagtgcccaaagtgcttgggattacaggcatgagccaccgcgcccagcctgtagtgcccacttttgacaaagttgattgttcatgtgggagcatgaacatgaaaatttaattacaaactaaggagaaacatacttaactttgaatctttcctattggtttcctggagtcaattttaaagtatcacttaataaatactatttgacaatttgcaaatttatataaatgtattttccttagagtataagcattcaactccaatatgatggtttcctattttcagtttgagtaaatatcaaaatagaatgtccctgttagatatctagggaatcacttttaggggacactatataatgccttactaaataccaagactacagtactattattttcacaagtgagcatgggtcaaggcaaagaagggcaagttggggtaaggatgtataggctgttaaccttgctgcacaggtaaatgtaaaagttccttttttctagcctcaacatgctggaagatcctgactttaaactgagtagagaatgtcttaaagcaaagaaacaagaactcctgtactctgaactttgttggggagttctggccccttttatcatttgatcgtcaatgaataatataactgcgtttagcccttaagcctgtatcagctgcaaacgtgacagatacctgtcatattttagaacagcttatcgcctcagcctctggagtgattgagtatttatagacacaaagatagaaacataaagcacatatgtataggcaggagtcccctggaggtggcgattaggactaggcagtaattttagcttgaagttcctatgacttaaatagccacttgagctctgctcttgcagtttacgatgtcaatagaacccctaaatgaaattacagccttctgatacgcagcaggatatcctttctttgccatgcaatgtacacggccaggagaaattgctctgtatatggagtttcactaaagcagaatttatcataaggctgctctgctaaaatatcattatgctgttattcactggataacacatctaatgactcgaggtgcacttgatagccatgtttcagtgaacacagacgcatgccctgatgtgaactgggcactccagtacttcaaagcactatcgatttcaattctaccataatttacacctggcttgttttgccaatagcttgaacccatgctaacactggaacatacacatacaagctttagaaagatcagaaatgaggtgtatagcaaaaatgaatgcagcaaactctccaggattttgcctttataatcatctcccttgatgccgattaaatattttgcacgattttcctagttaagtttgggcattccctctgttagcattatcctttggttggtgatgatggtaataagaacctcttatatttggacaagctatggacacttctgcagcaggatctgggtgccagtcatcttggttctcccactatctagcacaatgactggcacataatagttgctcatgataatctctgcaggctcctcttcctctctccattccagaaatgcactgtatataaaggaccttctcccttttgtcatctttcaatatatttttcctgagaaatgtccactccataattttaactattaccatgatttggatgattcagatgactgccaaagtctgtccctgacatctccagcattcctgactaaatccaactgccagtctggatgctcccctaacacccccaaattaaacaccttcaaaagtaaatttgtaatcttcccccatcctccaaaatctactcttcctcctcatagcttttcttgcttagttgtataaggcagaaacctgggagcaatccaaaattccttctctccatgcccagcccaaaggttattaaattgtgtcaattttgcctatctcttgaacatatctcctcctctctgtctattcccacagttattgtcctagttcagggcttcattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccactgttgaaaatgcttttgcttagatatccacaaaacttgcttcttcactttcattgaggtcttttctcaaatgctgtcccccaatgaagacttccctctctacctctccaccctatttaaaattgcaaacttatccctgacacaaacacacatgtatacactctttctcctctttaaattttctccatagcacttatcataaaatgccacatattttacatatatatatatattttatcttctgtctctcctatctagaaagtaactacaaggagaacaaagatttctgtttttttttttctaaatctactgcagtatccccaacccctggaatagtgttgggtacataatatgaattcctcaataaatatttattaataaatgaatcaatctttagcttcttgaataataactgacacagagtagggattcaaaaatgtttctttcctttttttttttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgtgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattctttgcactttgttcatgatgtacctctgacatttgttatacaattttgcttcctcttgactaggaatgcaattagcaggaggtgcaaggtgctaacactttttattacaatttatgtctttccatattaggtgtttttcataaaaaagatcccctttctttaattttcacaagtggattaggcactcatataattttgcccttcggagtggtttgtacatgactacccaggaggacattgtgttacaaatcctgccagaatgaactggaaggtgagtgcagcattcatagcttaaggatgaacaggttgtttggtgccaggtttgtactaatggagatgttctccattagtgttaactcccaaaggagaataaattcaataacaaaacatttcagtttttggcatttctatggagagttaactttccattgttcaagggttaattatccattatgtgaatcacttttctttctgtggctgcttacatctaggaattcagtttactagagagtgagcagggaaaataaagagacgaaaaggaatattctatatatataaactccaggaaaaaaattggtttaggggacagaatgagatatagtttggggattgctaagttgattgacaattgaaaatgggtaagattaaagcatgttttattatacacaatattttgggttttttttttaaattgtttattagggtcagtttgtagtacatgcagttactctctggatgtgattcttgtcagcacaataccatctagggtgctagaatgggcatttagcaaatggtactttagaggctagctcgacttggtgcccctctcctctgaagaaggcttagtgtgctgcagcttaatgaatgaaacagcactaagtgattccacctatttctctactcattgatgagaaacaactgcagtaggctattttcagctattatttacctcaaacagggcatttaattagtgcttgttaagacagtgcaaatgatttggctgccagtcttcttgcccctgctctttattgtgctgtatgtctgccccgcctctctcctgtctagttcacagggcatccatagccagtcttcatgcctttccataactgacatcagcctgacctccacggatgtggaagtttgaggaaaggaagaacaagtattgacaagctggagggactgttggttaatatgatgcattataggtaagtctggtactttctgactacatgagctgaccaagctggatattcggtcaccctcataagtccaggaaaatgaatggaactactgcaaactgaagatcccatgttccatcagaaattacccaagcattgtggggaaccttagcaatcttagtaaatggttggaaatgctgtcagatagttggaagatctaatgtgggagttaaggaggctcagatatagaagactctgccaatttgtgttctagacatggacatgtttttttcttttcttttctttttttttgagatggagttttgctcttgttgcacaggctggagtgcaatggcacgactttggctcactgcaatctccacctcctaggttctagcgattctcctgcctcagcctcccgagcagctaggattacacgcatgcgccaccatgcccggctaatgttgtatttttagtagagagggggtttcttcatgtttatcaggctggtctcgaactcctgacctcaggtgatccgcccgcctcggcctcccaaagtgctgggattacaggcatgagccactgtgtccggctgtttctttcactatgataagcaagatgtattcactgtcaatgcactgacatgtagatatccattcattcatcacctattcattgatcctccactcagactgagccaatctgacactggttgggagagaaattaacaaacctaaaacacaaaacctgccctctaaccacttgcagtttcatatatagaaaaaacttcaacttaaaagcatatataaatgctaaatgaaggtagatttgtaaaatgctaccagtgtcagatcacttttaatttgggttttatggaaaacttcagagaaaaagtgtgacttgtcaaggatatgatttggctgatcttgaaaagttatcagaaaaattatggttgctgatgctaatatgtaaatacagcatcaaaatatttaacatatagtaaaatagctgagaaactaaaatgggatcatctgtatatgtactcagccttataaaataaaatgaattcattaaacatatgctcaattttaagatatcaattaatttctttctacttaattttaaacttttatatatatagcaattaatattttgaagctgtacataatagaatttaggttgataagctaatatgtatatttgctgaaggataattaccaaacttatcagctaactacatctttctttttgcaaatactgttcataaatatttgtgtaaactttcggtgttgtcagtgtgataaaaagtcagctacatttcatttatggtcattatgaccaaaacatttgactgaaatcaaaggcaagtaagcctggctagaatttggtcatatttttaatagctgaatatagatatatggttgtgcgtatatgtaggcatttataagctaacatacatatacaatcatatgatacaagcaatcaactcctttttaagtttttaaaatatatgtctttcttaggggaatcacataaatactaaaaaccacttctatataaataagaaagaacaatttcttattggggtaacaacaattctgttatttagcaatttgatttgtgtatatctgcgactgcctaattaaatgaatatagcatataggaagtacttacagctaaaatatgcacgcaagaaaatacacatttcacaacatgcatcctcattaatttaatgaaattagaatttccaggtgagcactaggaaattgagttattgacagtgcattgtgaaggcttatgatcaaggtattgaaaaaataagtaatattaatatagccattgaagcacaaaaaatacatcgtcttgcctttgtatcagaggtacactaatcaaattctgacttcttatatatttcaatttagtcatgaaattcttccacgaccacttggaactccaagccttagcaactataagaaaaatctctctggcagattatatttttttaaatgtcatgtcttgggaatactcttaaatatttgttttcacctattctcttcttaaagttgcttatataatttcatatgtagtcattaataacatgttttcaaagtgttagagatctagcttgccttcaacgcagttctaatagacatccctaccagaaactatgagacagttttcctgggagtctgggcagtttgaatattaactgaggaatgttaacctcctatgtaggtcttggtggtaatggcctaagagctagttacattttttataacgtattgtaaacaccatttccctttcaactttttttctttagaaaacaagataactaatgaaaattacccaagaaatattatacatataaatagtatagtcctaacacgagctaactacaataggcaaactttactattaatataacattaaacttttaccatactagccctaataaaactctgagactattttctatcacaatgacagctgatgaatttaatgtgcctcacaaactataggaattgtgataggaagctgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacgtttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgctctgattagtttgtcgagttcacagtgttccagagtgctgaagcacagaaattagggaggggaggtggaaggaaaatcactggagcctcttacgatctaacttccactaactgggaggaaatgtcttataaataaacaacagtaagagaaacaaaaaaaaaaaaaacccatcccgtcctgccagaggaatgtacattattgtctcccgacggaaaactttacaccacaccagaatgcagccatgtctcctgaaactacctccctcaaaacagaaagaaaaagagaatcaaaaaggaaaggagaacaaaacagaacaaaaaagatttcatccccttgaattctgttgggaagttcatgtgagttcccagtagacaaactaaactaagcaatttcaacagtgtcactgttccagaattttgtgcagaggctgcttattagccaaatttcatttctgcccagatcactgctgtaccatccagacattttcagaagggaagttcagggaaggggggaagggtacgactgtggagaagaggaagaagagaggacaaaggaaaactcctgatgaaccagaatgccctagccacggccatgatagagcgagcccccacccaccacccgactactgcttgttgaggacttggtgatgcggtgtgttttatctacttactctttctgctcgggaggctgaggttcctacatttccagctcatgctggactgtaccgtaagcaacaagtgaaatgagttcagtgatctcattctagtccttcgactcctgtccacatcactaagcgactgcacagcttggcacaggccaggatgagtcagcagtctctggtcatgagaggccaggcctggaatagcaggggggtttaggtcaggagcaaaatgaagcagaaaggcagtctagatggcagggctctgttctgcaatacacagaaatactgcaggtcaaaatgaaagcgcctcatcagctctggggtgaagattgtaggactgtaaaaaaagaagcatcaagagaaaaaaaaaagctgcctaccaaacatagcaaggacaaaacagagtaccacagtcagaaaaagagggcactggtagagccctggaggataaaagatgctcattaaggtttctgaaatgtcttttcttccacatgctcccaaacttgaattaagaaatggtgacttcctatatactatcctagtattttggtactgttttcccaattcagtaagtagcaaaacaaataaaatgcaaggcactgcagttaaatagcaagaaaagcctcatatttcataaaataatatgagtctgatatctcaaaggtgtacatttgggttaatagtgtctgtatatagcctgtatgaaatggttaaagaggagtactctttaagttgagcttgggtgggggtagagaagagcttagagaaaagagagttaccagttaatgataaaacataggggaactatgacactgtgaccatatttctactcaatggggccaacatagacctccattagacctccatcaagaagtgatgctcccactaacaggacttcaaacacttctccctctgcagtagtactgtaatatagcaaggggagagggaaaataaaatagatagaaaaacaaggttcaacataaaaaaaattagtgatagacattttgtttcagaggaggcaaattgctctataagtcaactgataaaaaaaagtcttggtatctgaacagacttagagaaaccatatctagatgaagatgccaggtggagactgataactatcaggaaatggtagtaatggccataaagaaggaagaaagcaatctcaagtcacatgatgtagaataaaacagcatggaaaacagaaggagagcaacagacttcgggaacacgagtaaaatatttctttaaagtccttttaagaggagtaatgaggacccaccacatattcctaaatgttgtccctcagagatgcacagatgtatatgggtaaggaaatgtaaaataaactttcagctttcatttcagagggtattaagtcatctgaacacatatttactaactgtttaatcttgggcaaatgagctttctagcctcagtttctctctctttgaaatggaaataatattatcatcctcatggaatcattgtaagcactgaatcaatgttcattaacccttatctcagcagtacctgtcacatggtgaacattcagtaaattgcttattattcatattatttgattatcatatcatatcatctttataagtatccagtgaaagaatccccctccagtgttgttccactggattgagaggaatcaatatgaagactctagtaaaatcagttgagtaacactgcttacactgctgctttaaaaagattatttctgtctgggtatgttaaacattatacttgaagacacaggatgttgaaaatctattatgtgaaatccttgaatttgggtatctatgttgtcaaagcaacttggagcctaacagttgtccagtaactagaggcccaaaaaagaaaagaggaatttttagaagcttctccaaaagcaacaggataaaagtgttattggccttaaccgcatgatgagggctttttaccaaaggggaaaacgtagtccagttgatcatcgcagcctaattgattaattgtgggtctgaccatctggctgatgaatgctgacacccagcagtgattactgtgtaacacaattccggatgtgctctccctgatgcctcccacaataatggcaactctgaacttaaggttagtttattcaggcctcttggctcaatctcttcatggaatagtggttgtggcagggaatattttactagacctggtcaagcattatcttctcttatttcagttacccactcttttccaactctactcctacccactcctaagccctctcttgtatataatcacttttcatgcaaagcattccatctgtagttttcatcatattatctgattctctcatttctggttgctctgttctgaaaaatatttgactaaactaggagatctatactgctagaatgccatttcacaggggatcctattgggacatgtttattgtatcttatttgctactggtttacttcaaattactctgcgcttccaaataaagaaaattattttacctaattcattagcctgattaaaagtcccacatatggcccaagttttccatgagattatcagaatacaagggttaatagacgataattcttacatcttaagcctacttctgaccctcagttaggagtatcccatgaagaagattcccctggagcatactttactgttagagaaggaaagtcagacccatgtaaatgacaaggttcaatagcaatgccatccacaaaccaatctacacctggagatgacttgtacatggagaattcaccaagcaaataaaacctgtacatataaatataaaccctggggaattataacaaaataattccattgtattttgtaggaatgcacaggggagtaactgacacaaaatatcttatacaaccttgaccaacaagtcacaatgacaaatcatccgtttcctcttttcttttcccagattgatttccagctctaaattcatcttttctttcactccccacagatgctgaattcttctatgttccaggctgagttagtgttaattttcagtagaggacggcagtagcatgctgaactgtagagttccgggctgggagttgggaaatgtttttggcctgactgtcagtaaacaactatgtgtcttgggcaagtcaagtcccttaactccccatgtctcagtctcttcattgaaaaatgatagggtaggactgcataaactccatagtctctgccaacactaagattctatggttctatagctcatttccttttttttctccctttggcatcaactgctcaacaactccgctcatagtaatctctatgctctcagttactaatggaaaaatatgtccttcatttactagttggtattttgtatttgtaatctctctctttttttatttgatgctagatattttgagtcataaacaccaacatatccaaatagatgctttaaatttgaaggcgtttaaggaaaatagctttcccatgtagaatatttagtgtagcagggcatggaggaagccagccatccaaaagtggagcaaaggggccaattcacaaatgagagaaagcctttcataataagagtctccacactctttaacttagataaagctaaaatgctaccaacttctaactacttttccaatcaatcccagacaccatcacagacacttaggactacaaatctgaggaccagcactggcagcaatgcagttcttatttcacctccaccacccattgccaagcaggatttaggatggcatactaataagagccaagaggacgatctgtcatttattttcctccaaactttttgaaatttcccatttgggctctgtttcccagttttaatttggtaactgccatttttcagcatttcttttaacaggttactaataatttctgatacaggatctcatatttcattttatgctgctagagctgctgttaatatttcatctgccttcaattcagctctgaataaaggctgctaggttttgatagactgttaacactttggttctggggatttgatcactatgttcatccagtttgtccatattttgttaaaaaaaaagtaataggttagctatctcagaaatatctcagggtgtgctatacattctagggatacttcagagtttctttttctggatctttgatgaaaaccaacaaaaacaagtatcctgggtttgttttcacaaatgacttgccatttgcttcagtgtcagtattctggaagcagtgggcagtggttaagattcagggctcataggcagatctagattcaaattttggctctgaaatttattatatatatcacctcaggccagttccttaaccttgccaagtctttcttttcccatttgtaaaatagggatgataataatatccacttctattaattaatatgaggatccaataaattaatataaagtgctgaggattttctcagttctcaataaatgatggctatcattatcctagcattaataatctacaaattcacattatagaattattattttgcaacatcttttcagggtcaacaaattattttttagtacagcctttgttgtttgcttcactatagcttacatttttaaaaagtctcagtaaaatcatgtaaaatatttaaaaatttgatatttaaactgtatgtacagttagactaatatatagcaccatattattattattgtagcacttttcagtgcagcagcaaattctcaaaagtttttgtccatctaatagccagccctagataaggcacattgtaccaatactaatctgttctataaaaagatgacttatcatatttatcttctcctactcccaaagaatatagattattttaatattctttgggtatgtgtcagtcaggccctgtttggatacagagaccatatagcaatttgaatagaaagttagtttaaattattaataataacgggattaaagtaataagagtagctagtaagaagtaaagaatactttaaagaatataagaataacatgggccaggcgcaggggctcatgcctgtaatcccagcacttagggccgaggtgggtcttcagcctaggagctgaagactagtttgggcaaaatggtgaaatgccgtttctacaaaatattagtcgagcatgatggtgtgtgcctgcagtcccagctacttgtggggctgaggtgagaggatcgcttgattccaggaggttgaggctgcagtgagctgtgttcatgccactgcattcaaccctgggtgacaaagcgagaccttgtcttaaaaaataaaaaagaatagaagaataacaaatgtaaggaacagccattatttgcagggctaagatagcatatccaaggaagagtctcctccatccctggactgagatctagacattgtaggactcaagacaaaaatctcctggacccctggaccaggatccagaccttgttggacaacacacagccataactcattggatggcagagaagttgctggggagctgcatcagtagcacctgcactctagggtgctaatgaaagctatttacagggatgtatctcatctgaggcactctgctataaattgcccaatgtgtgtgtacacatgtgtgtgtacgtgtgtgtgtatggtgggtgctaggggtagctgctacctgccacgtactggagaagctacctgtgcttcagctgctgggtaccaggttagctgcatttgctgcaggagctacatgctgtaaaggttgcttatgttgtagaagccaggctctggagaaaccgtgcacattgcaggaggctgccaaagtagtgcatgacaaccaggaaggaaaatttcttctttctgcaacgtctccctaccttctctactgacaaagcaccctcaaaccagctagcaaagaaaaaatatttaaagaatccagatacatttttgcagagcaggcaaggagaactacatttggaaggaggcaatgggaggtaatacattggtaactggcacagatattattatttgctcacacacttcatgaaataactcacattagagattataatccagtattttcaactgattgcactactgttcacatttactaataaaccaactccctttgcatagttaagcaaatactgtcagaattaagaaaaataagaggccagtagataaatacctataatagaatattttaaagtgacagtactagtatatgtacataaccttttcccccaagtgctgcccacatacattttaattacatgtttataatttacttaagaaaaaaatatacagaagtactaagctattgacctaaatgtatgcatcagtgatctcacaccagaatctcaactaagtgggtattcagaagagtcattacaaacaaccaaaagctttgagagaggtaaaaattgcctcgattatcatttttcctttctctttccttttctttttaattaactctagaactcatatttgcttcttctatgacatttttgtggaggggtggggtggctcttaaataggttattcttttttttttttttttttttttttttttgagatggcgtcttgctctgttgcccaggctggagtgcagtggtgcaatcttggctcactgcaacctctgccttccgggttcaagcaattctcctgcctcagcctcttgagtagctgggattacagacatgtgccaccacacccagctaatttttgtatttttagtagagacagggtttcaccatattggtcaggctggtcttgaactcctgacctcgtgatccgcctgcctcggcctcccaaagtgctgggattacaggcatgagccacgtgcccagcaaaatataggttactgtttttcagaaaaatacatatttagaaattttttcttatgattctggtcctatattgttctactcttaatattaaatagagaagcatcaataaatgaccaatttggtaaactatgatactgtgatcattgttagaactagttttacatatggggagagagtatattccaaaatacctcccctacttttgcctaattcccttaagaagggaacaggtgcttttgctgtataattacaggtagagtttaaaaccacaaacacctgacattagcaaggagcgtggttgtgagaggctgagagcagaaaagctaattgggtgaggagagtcctgtagagagtagactatactgaggtcaggaccacagaacatctttctcaccattcatccgtttttacctatgtctggccatcagcactatctgttctcactattatggaaggggtctacttgttacctcacagttgtgttttcttaaagccagtggtatccagcaaagcaagccatgttgggttgtctcacaatcacactgtaggcatctctgccagctgcaggtggttatccttatgatttccttttgtttgtgctatgcgtgagtactgaggataaatttaatgaccctatgtttagttctctcctccaacacacatgcacacccccctctcccctgcaattcctgagttcaaaaagagatgaagacaaaggaatgtcataagtccgtgtgattcaggcaggcaagtccattttattttagtttgcccttctgttctgctggcttttctgctatgacccactatacttaacctgtcggctgttcttagtagcaacatgcctttttaatcagccttcctggggtctgcatttgattacagcatttgtgttctattttgattcttttgtactgtgccctgtggtgttcgcttgaaaggtgttatttataaaatgaaattctattgtattgccacttggattcaaagaggacatataatattaatgcagaatgtatttaataatatcttcaatctattaaatcaatttcttcatgagaatacagaatggaagggaggcacatgggctgataatcaggtaataagacttaagaatcacctgaacttttccttcacaagctttcctgaaagctggcacaagaatcattctcttaatgtcagggtttccaagtggaggagactacctttcttcagccagaccagtgcagtgcgcacctgtttaaacattcaactgtgcaggccaaacattttcctaggcttttagatgcaaattttttgactaaggaaactatgagaccaaacatgaatatgacttttttactacatagaaagaattaggttatgaaggaaatgtaatcacctatttctaaggatctactttcaagatttgtaaaaagaagtatatttgttctcacactgactcttctcaaaagcaggataggaaaattctagtgataccaagaactgatgcaaagtttccaaggtggcatgttcagaatgatgttctcacctagcaaaagggcaggtttcattgtgggctgctgggcctacagtcaaatgtttctagattagattgatggaggagtccccaagttttttcaacttctaattttaattccagctaaagactgaaacattgtacactgtatcacagcttgcacagcacatttcttgctgcatacattctattctttcactacaatttttttttcctgttgatctatctgaaatcatcaatggctatgctgctgtttggatagggaataagaaagaatttggtttgaaagatgatttaggaatcaggctctgcagaacttactaaaagaaactgtaacatacaaaggaacctggctgggcagtcttgaaatgagagttcctggatttttacctgttctcattcagtggcatattatataactccagaaaaatcagggtccagttttctaatcactaaaaggggaataactgtccttttctacttgcactgggctactttagggatggataagaaaatgattccagaatcttgtaaatgctttgcaatgaagaggaaatacaaatgcacaatattattaaaatgatagtttaggccacatttttgtttctccaaatctagagatgaaaaatagtaacaaaggaataaatttcttccacttcaaaaataaataatatacccttatttataaatgacatgtcaaacataaggaactaggatgtgttggggaatacacatctcagttttgaaggcatcaaattataagctatttgcatgaaggaatcacattcatctctgtatccacccaagttctacctcattgatttacattatgtaagtattccattcgttaacatatgttgaattgaaatgacaaatgagatcgcacaattttagagctcgaattaactagagaccatgttaaatcctgttgcctcattttgcagatgatacaactgaggcccagataagtaacttaactaagtccaatactaaaaatattacaagttttagaagagttattttaaagatctgccactgaaaatatatcactgaattaaaacaaaatagacattcttctgtcaaaataagaagcactattcagctcaaataatccgatgtatcctaacctaatcaagaaggctgaagcctaaagtaacaagtaaacataattaaatagctatagacccataggcatgttagaaatgccaagttactgaggggtgcatatcttaatactttgtctatcagccagtccaaatggcatatttttttcaagtaaaattaatgtcttaacaaataataggggtgaagtcagcaagatggcagagtggaaaactctacctctcattcttccacagaaatactgataaaacaatgttggaaccaaaataccttgcaaatatattcagattgtagctaagaaatagaggcaccctagaggatcccaaactaaaagcagttgcatttgcatgggtaaaaagtgcaatttcatgttagaatgtcatatcagtacttcccccagactggcttagctcaacactgagaggactgcttcagctcatgatttctcctgtgccacagaaagtgagattggagtgtgtatctggcttcctggcctctggcctctcagagaaccctctgttgggtcagttcctatattgcctcatactgtgtactgacgcacctgtagaacttcgttcccagggatgcgtaggagcaaagaaatgaggagggcaactccttacagttagagctgccttgcaagattaggaatggggcagaactgaggttattcttagatgagggaggaaagggaatgaagggggccttattctcagcatttcagagttccctctgtgaagccagtttccatttcaccttgtactgagccttgtgcgaccattagaacttggttctgagggatagttagcaaaaactaaaaggagcaggcatccctttgcagctggcactgctctgtataataagaaaaaaacatagaaccgagccttttccttgagaaggcaaggaaagaagtgtaaagggccttgcccccagtcttagattgtgctccccaaggtgtatgtctctatcttgtctcatattaagcaccatgaactggtaaaggtctctactcatcaaaactcatctgtagagactgggaaaggtagctgctacttcaaatatacagatcacaaagaaaatctacaaggaacacaaagagtcatctccaataaccatcctgaaagaaacagagatccctgaattaactgacaaagaatgcaaaataaatgtcttaaagaagcccagtgagttacaagagaacactgagagatagctaaataaaattaggaaaaagatacaagaacaaaatgagaagttaaataaagagatagagactattaaaaagaacccaatagaattactgaagctggagaatacaaaaattgaactgaaagattcactagaggagttcaaaagcagacctaatcaagcagaagaaagaaacagtgaacataaagacagatcatttgaaattatgtagtcaggagcacaaagaaaaaacaaggatgaaaagtgaggaaagcctaagtgacttatgggactcaaacaagtgaatcaataaacacattagggaattctggggagaagagagggaaaggggtagaaagcctatttaaagaaataatggtaaggaacttcccaaatcaggggagagaaatcaacatccagattcatgaagtccaaagagctccaaagatctacaccaagacccattataatccaattgtcaaaagtcaaagacagaattttgagagaaacaagagcgaagcaactcatcacattcaaaggagtccccataagactgtcagcaaatttctcagcagaatcctcacaggcaaagagagagtaagatgacatattcaaagtactgaagatcaaaaaacaacaacaacctgtcaaccaagaacgctatactcagaaaagccatccttcaataataaagaagaggtaaagactttcctagacaaacatgcagaggggtgttcaccatcactgtacctgctttgcatgaaatgctacagaaagttctttaagctgaaatgaaaggatgttgattagcagcatgaaaagatgaaagtataaaacttgccaataaagtcaagtatatagtcaaatactagagacctctagtactctaatgatagtgtgtaaatcactttcaactctggtataaacattaaaagacaaaactataaaagtaatgacatgatttgttaatggatacacagtataaaaagacgtaaattgtgacaccaataacatgaagtgtgtatataggagaagtaaaagagtagagattttgtatgtgatcaaatttaagttgctatcagcttaaaatagatgattataagttgttttatggaagcctcatggtaaatacaagaaaaacacctgtagtagatatataaaacataaagagaaaggaatcaaagcatattgctacaaaagataatcaaatcacaaaaaaagacagcaacagagggacaaaggaactacaaaacaaccagacaataatttaaaaatggcagtaataagttctcacctattaataattaagtgtaaatggattagcttccccaatcaaaagatacaaactggctgaagagattaagaggaagactatccatatgctgttaaaacagcaacaacaacaacaacaaaaaacaacaacaacacactttagctttagggacaaacatagactcaaagtaaaaggtgggaaaaatatattccaagcaaacgataaccaaaagctagtaagagtggctattcttatatcatacaaaatagactttcagccaaaaattgtcacaagagacagagagaaggtcattatataacaagaaagtgattaattcattaaaatgatataataatccccttgattaggatccttttgattggaatcctcttgactggagtagaacaaaaactgaataattgtaaactattattatgaagtagagatctccaatacactactttttatttttccaaagctttcctggagatcacagagaactgaacatggagaaaaagtgagcaagagacagcagtaggctttatgccttaaatggctgtatagcttgttaaagattattgtttgtgtattaaaaaaacatgattctagaaacataattggggtttcacagatcaaattcaaattattaacttagtatttcagcctccattacttgctctatcttgcttaggcatcctaggttccagtacttcccaacaagtgttctgtggtgtatgcagactatgttagtgtttccctttattttggtatttccacaggagacctaattttaaattttctgttctatcatctccatgatttcttaaattatgtctagacttctggattagaatattattcatgtacttactatgattcaataaacatcttctatgtgtgagacagtaggaataagatacaaataagacttatttcctatcttcaaagaataaaggaattcacaatacagtggccacttaaatatataacatgtgttcctgcttttaagcttttattctttctataattagagtatcctatcattattttattgattgaattcctttaattatcttatagtccagcttatgttctgcttcttccataaattaatttttactttttatagcccacactgtttccttttccccccactattacagtggaagtggacactattccctaaccaaacttcattccctcattcttcctagccgcagacctctattttgtgcagagtgtcaatgtgctcagtgctggatgatgagttttgaaatttataagccaattatgacaagtgtattctctaatttgcttgcttctctagcaaagaagggtggcctagggattcagttatagccaataagatctatgtggcaatccacttgagaggcaagtttctgagaaagctttttttttccgttacaaagaggaaggtaaaaggcaatccttctgtttcctcctccttccctctttgaacatagacatgatgcttggagttgtggcagctattttgtgatcataaagtgacaagcatgaaagaaagacaaaaagaatcccagagatatcagcacagactttatcatataccaggaatttcctacctctcaacttctggacttcctgttaggtgagaaaactgaatctctatttgtttaagccacttaagtcaggatttgctacctgctgctgaacacatttctaaccaaagtaataatagtaacattcataatttgaattcaccaaactgttcttcctaactagataacagacattggtcacattcttggcacttcataaacattcatttgcttcacatcttgattaaatatgctagacttttatatgtaatgaaattctcacacagaaaggaaggggggaatttggattagtatcagaaaagaggatgaaaccaggtcaaaaaaggaaaatttgattctataataaaaaattatatgacaaaaatttgttacaatgtagctcaattattatatacaataaaagcaaatttttaaatattttccaaaattaatagcaacatattttaagaaataagacagtagaataagcccccaaatgataaatgttttaaaggagagatgatataaacaagtcttctattaaatgtgaagacaataccatgcagttctactgaaacctaagtgaggaaccagcgtttgtcaaataccaccagcaataagactttttctctgtcctttaggttgtatgactgtgattcaccccaatgctacaggctccttagcatgctcattatttctaaaatctttcacctgaggtttgaacccatgacttaggaaactattatcgcatttgcttttggagaaaagactacataagttgggacagaagctattttcaaggcttccaaatattacaagtaagtagtggggaactgttgagaagagaaatgagtagctttgggtcattttaggttagtgaccttaaacataaggtgtgatttaatcagaagccagagtaattatggcaggaggtggggaaaaagactcagagctgtctggagttagggaggactttggtggcagctttcagcttgagctaaaactgcaggattctgtcagaggctccacaaacaaagggctgcattatgtaaggaatcttgtatttctttgtgaactagtccacaacaaaatttcattagtttttttttttttctctcctagagatttttttttaccacttccagcccgtaacttgttgctcagaagggaaactttctaccttaaataaaagtttaaattgtaagcaaactgacatttttttaggaacaaatcaaattaatttgaactttataataactgggaaaatgctttttaagttaggtggatgataagtaatcttatatgaagaatttccaaataatttagcaatagttggcaataatttagcaatagttagcaatacgagttcatatctctctccctctctgtctctatcattttctgatagtctgtttacacatgtaacacttttgggtcacctttcaatggagcatttcataggcagaattggaagatagcaagacacatggatggcacatagcaataggttctcataaatattatctgttttcaaaagaatatttatttttttgcccattataaagatattctaagattaattacagtcctaatactgtcaaatttagctttgatatacaaaaatctattttttagtagtttaatttttttttatcaattactaacttgaggctttcattttacaacattattttggtcagttataaaaataatttaactgccaaatgggttttcccatttgacatttcaaatgttggtttaatacttatcacttagacctctatgaaggttgactcaggtttactgggggatattgcatagatcatgtcttttggtccaacagtttgggctgtgaatagtctaaatttgcatggaagctcccaactaccaagctatccaaaaactacagggacagggcggggtgaatgattctcagcaggtggcactcttccttctaattaggtcttgaatgaatgcaccagcattctgctatctcttgggtggagtgtgagactgaatcattcaataatgcttatagcgcttaagaaccaaattcaagggaactgtggaatgaaggcaagttataggtaacatacaaggattttcattctgctggactttttcattcaaaacagcatcattctcagactcagaattatggataaccatgcctctcagtctactcaggagagtttccagtttcagttccaatggcccagtcacaattattagtagtgttcattttcactttcaaaagtgtcctagtttggatgataaaatatggggttaccctgtatataagctttaaaaaagttagtcataacaccatttacagtgataatcattctatttaggacaaattaaagtagactctattggccaacttctataaagagaaagagataaactaaaacattattaatttaatctcagagctttaatcagaaaaagtttattttaagatgacaacaaaatttctatgaattatttaggatttctaattttaggtcatttttttttagccttattttatacaagcaagcacgtatgcccttaagatttgtggtggagaaagaagtacaatatctgaaataaagttctttgaagcttaggtttgaattctaattctactatttactcggtgtgcaaatttaaataatttctgtgaacattattattaaccctttctaaaatatgtttaaaaacattttaaaaaccagaagggaaagaactacatatgctgtgaaaagctgtaagttattaacagttactattatttctctttataaataatgatagtttttccctttcaacttctatgacacttttacagactgtagaaaaatttggccaagcatgttgtagcaagggtccttaactgtaatcacctttgacacagatccatgatatttctgggtgacatctctacatggacattgatggcctgcaaagatctagaaaagaaagactatagatcttgtacaccaaggccaaagactaaaaggctgaaatttaaagtacaaaagtattgtgaacagttttgttagtagtataatatataccacttatatagataatttttcttatatagatataagaataatttttcttatatagatataaaatagggtttcttatatagataatttttccatggaaggaaggggaaacgaggcgaaaagtggctggagtagaaagactagtttgtaaggcagaaagattttctaattactaggtagattttattttattttacttgtttttactagctaaattttaaaaaagagattcctagatctctatagacatgttcctctttctttttgctgatattttcctatttcttttctgaaatcttaatttgactagaaaaaaaatgatgttctgatttaattctcttagtctacctgacatcaaaaagtatatggagggtgtctttagttttttatttatatgaatgtaatcaaataattttattttttaaaaaaagactctcactgtttttcattgtttaacagacatttctttaaaactttgaagtaattatagaaaatgttctcataaattttccctccaaattaaccaggtagaaagggctaatcctgttatgcatgccatttttgtttgtttaaattgactattctgagaattaagtctgtagtacctagtttgaggcctcaagattttcaggtatgcacaaggttctatcaactaattctttgtctcactgatgatcctttattttaaatatactctacttgcaaaggtggtagggtaaaaagaggagtggctgacaagagactaaagaggggaaaggattcccaacatccttaatatctcagggctgaaaaagagcattagaaatcttctccaatctcttggagaaaaaatatctttcacacactctgtctattagaacttcatttgtgtttaacaagcccctcttttaaaatgcaaatttgccttgtgaacctgtaaacctcattcacaccttattgttaattactttgatgttctagaatatgatcaacacttaactgatattggcaatctaggaatgaacaaattgctcagggtgaaaaaaggaaaattttgttggagtggggctgtaggtggtagtgtgagaatttcatttgtgagaaatagagcatactgatattctgaagttttgtctaggagaatggcagtagttacggtaccacaaaacgagcacttttcccgactgccgatgtctagttgagatcagaaaaagcctggaagcctgcaaacctaagttttaaatatttagccatagcaagctaatcaagcttgcaattttctgaaaacgttttaagttaattcataatagctctacaactcggtgaccttgggttctaagactcatttggttcaaccttccaggtttaaaattcaaccaataaatgaattccaaggaaaaaaagtgaatatggcccagtccttttttactgtctccctagtcattcacttcagagattttggaatgcaatcctagaacatactgtaagcaatttcagaagaatacacaggatgcagtatttctctatgtgtcttagtaaatgtcacttgacccgatatatcaaaaaggttgcaaaatttgaattagactttagttgacttaagctacacatcttagcttggcagaaattcaaggaaaaaaatattttatggcctcttgtaacattattaatcacccctccttttatataaaaaataaatatgctaaactcttcactgttcagaaaaggggtcatttttcctgccaaaatggctaattttagtttttatgtagttggatacatttgtaaactattacatgaaaacatatggttggaacatgcttactccttcatgagtgttccccttttgaggctgcaaaattttccttagttgctccatgtgctactttgttgtgctgatgacttcttgttctaaataattttcttcattttccattgttaatgaaatgagttctaataaggaacaaagaaaccctctgatgaaaatccctttcttgtagaatggactgggaactgatataggacacaggggaacagcaaatgctgtgttgcacattcttcaattaaatgatccctttgtagtttattcacctgaatgcattttggcaaagagtgaagcaatagtgggaaaaggattgtttgtgtggctaatctttggttactcagaaagtactagacatgttttcctgcatgtttgattgatttcctgcacagtttgattggtgaatcaacactttaaggtatctaacccataaggaagagtgaaaaacttccccagaggtattgaaatttcactaaacctcttcttggagttttggtgtatgattctcagttgatctttgagtgtaacagtcaactattaaattggcatgactgaagtacagttttttcaaatagaagagtattttagaacaaatgagaattctaactctttaactgaatttctaactttacattttgcccgtacctctccttgtaacattcttccctttttccctatatatttttaccagtaatcctttcaactgctccttaacagtgagattctactgttctggcacattataggttctctttaactattttttgagtgcacaaatgaccatttggacaaatattataaaatgaacaataaaaaaccttaattatgcaaattaataagtctatacctttgggaaaaaagccatgatagtaacaaaatgaataacaattccaaggatatttaggaaggataaagcctagaagattaaaaatgagaaattttagaatcataaaaaacaaaacgaaataaaatagctcaataccattgaaagcacatgtatgcagaaagaagctaatatattattgtaaaaaattaaatggaaagaaattagaaatctattggtattattacatcaaaagcaggaagttctttctttctggtccaactttagagagaagaacaaatttgccagtgccaccaagggcagaatagagagagatgtttggaatttaagagttacaggttatgttatggttcatttatatcattgccatcactgcagttcattcattttgtgtctaattattgatgttgccacggttgtcaataaacgctcagcattactaatcatcagagaaacgcaagtcaaaaccacaatgaaataccatcttataccagtcagaatggctgttgttaaaaaatcaaagaacaacaggtgctgcatgattgtggaggagagggaatgcttacacattgttggtgggaatgtaaactagtcctacctattaggtactgtgctcattaccataggaattagggtgggattcctattccaaacctcagcatcacacaatattcctatggactaaatctgcatatgcaccctctgtatctaaaataaaagttgaaattttaataaagatggaactaatccctcatatcacagaattatgtagttgtgggtagtcaggataaagaatatttaggatataatttaaatgaattcactagctctgaaaatgaaagaataaacagaaaactaatctagacattaaatttttttctttccctaaggataatgtatagtccctaaggataatgaatattcaaggacatactgtaataaatcatatacatttattattaatataatatagtttattgcacacacacactatgagctccacgatgttcgttgaactattacaaagtttaaagacatacgaaattacagtaagagccatccatataaaaataaaatgttagtgtttggaaggaccaattgtaggagactatattggcgagttaatacaaaagatcatcttttgtttaagagttcatatatttttgtgtaaattatatctatttacagaaattttctttactaccaactgttctcaaacccattcactaataaataattactatatgtgattacttaatatttacctcaaacctttatgaatatcactgaaagcattactggcaaattaattatataggcaaatggtgaggatctctcaacctcacctctcaccttcttcccaatcactcgaagactgactatatcaatttgtcttgttatccagaaattggctttatttgttaattccagagatgcttcaactgtagtttcagccagctgtttccttacatctttctgggtggcatcagtttacaatgcatagcattgttgagggtcaaagttattttattttggtattactattggatttttcccccagtgcctcaaaggggaatgttgagtcatggagatgtaatgtgactccttaaactaagtagacttctaatacaagtatacttttattatggagaaaccaaattaattttatcaattaaatgagaatttatttaccatttgcctttaccagatatttcattagacacaattctcagactttacacaattacaaagaatgttgtataaaaactatctataaagcaggagatatttcattcttagttttttgccaaacaaattatgttgcttcgaggaacagagggaaaagaaacattgatgaaacacagccctcaactatggcataaagtccaaagcacagagaaggtcagaaaagaataaagcagttttgcagaattattatgatagggagtactgataaagaagagtcaactttttggccttagtcatttactgagttcctttattaaaaatagagcataaacattttagaaataattttttctcaatctttttttataaaacctctacagaaaaaagaagcgttatgtgaaaagcagctaaatgggaggaaagtaggggtctgtgggtgaaacaggaggttaccattgcaaaccctgtccttgatgccctcactcagtaggactggtggatggaagaagtttgaaaaacttttatgtagagatgaagaaaagtagaagccctagtttacagagaacgaaagatacatttttcttctgtgtaggtagagtttgtatttggagaaggaggagactcctttcttctgatgaaaactccttcttccaagagaaaactccattaggaaaaatggagcagcagtgagtgagagagaccaggtttaagatttgttttggaggttaaatttgttgtggaagttgacagaatgtggtgaaagcaagacacatcataaaataagccaaaaaaaatctctctcttccagctcattgtatattggagagttagttgacttttctactgtaaatgtaaagaaaacaaaagtttcattcatcctcctgtaatgatgccaatctaatttgctattaaatttctattcaaaagccctattttgtttagttacaagggatttgatccccttaaactttcccaggcaatttgtatggaaaggcggttgctaagggtattcctaagggaactggcaaacgttggaagataaataacctcagtacaatatgcagattaagtagaagggatggtttaagagttaccttttgaaggaaaaataaaagattcagaattcagggctagagttgctagttaatcactgatttgaaggtacttaatcaaggcagttttattttattttattttatttatttatttttttttagacagagtcttgctctgttgcccaggctggagtgcagtggcgcgatcttggctaactgcaagctctgcctcccgggttcatgccattctcctgcctcagcctcccgagtagctgggaccacaggcacctgccaccacgcccagctaattttttgtatttttagtagagactggctttcatcgtgttaaccaggatggtctcgatctcctgaccttgtaatccacccgccttggcctcccaaaatgctgggattacaggcgtgagccaccaagcccggccaaggcagttttatacttctcaagaaagtagaactttcacattgttcctcttgggaataaaggtaaaattatcatagagaggaaattagagagaaatgttcaccatttccttccttatattcttcctttctttcctctctctatctctagagctcttcctcaaagattcaaataaccaaaaatatgaagccatgggtggcagcttggagttctcaaaagtccaaagtgaggttagcttctgaccaaaacttttggcaatttccttaggttgagtgaaagaagcaatgtgaaaaagcatgagtttagagtcagtcagccatcaatttaaaatcaaactccactatttattattggtgtgatcttgaatacattagccaacctctttatagtccagtcatttctaaagaggtgattatctatgaaacctgtattacatatacaatgtgtaagtactcagtaaatactcagtacttctctagtatctctctaattggatttggctagtaatcatgacaattgtgggagagaaaaaaaaagatatgtaatcctgagggcactcagtctctgtaacaatcacttgataaataatcaggtgatacttcgttgacatctctttaatcttccaattgagaaaacattaggagtagaagaaaaatgattaatctccaacttctgtcattggaaaataactaaagatcagaactataagaaacataaaacttttctagattattaaagttaaccttttagacattttccacaatcacatggtatgcaaattttaactaaattattttacattaaatgtattttgtgctatgttttgactagttgattttactgtagtatagaatgtattatgacattccattatcctcttattactcatcaataaaaaatttattgagaaaacaattaattataattaatatttattattcattactagtaggcattgtagtaattacactattattggtattttaaatatcattaatagctataaacatgttatacataataataatagaaaccatttgtggagtgcttactgtgtaatacattttgctaagcattttatatacattcttaaaattaataatttcaaagatttaatgagctaagtgtcaccagataaacgagaagacataataatctttatttattaaaggaaaacttgccatatccacacaatcttccaaagcactgatagaacagaatgatggcatgatggcatcttaaatttagaaagtgtcattcataaaagtgtactgttaactactaatttgtgctatctgcaataataatattatattacacaagatggaaaggctaccccctaaaagatagcatttgataaattgtacataaaaatctagaagaataagagtataacagaggagtgaaatttgatctgaaatacagagaaaattaagaaaaacaaaacatgttagccctactggaatttgtctcaatgtatttcaaggttcaaagtatagcagaggaagatcattgacactgtcagaggattatcattaaatttcaacccaaaggcaactaactcaaactatgcagatatggaaagtagtgtttcctaaaatgaaactaaggcaaatattatttattctagcttctactcttttgactaatcagctgacccagaaattaaatatttaaaggcttaaaaataatatagttttaagaagttgacctatacgttactaaataaaatgatcctcgttgtatttgaagtagctcaccatttaaaaatttaatctatgtccacccattttctttcttcccaaataatacaatgatttaattaccccacagtttaatttgacagaggagccaaaaagatacactattccttcattgttaactttaaggagaaaaatacactataaactatattagaaatcttattttttgggtgtccaccacaatgttttcactacaaaatcccttgctgcctgaatacaaaatgttaccattcaatcagatgagtctccatgaagttagaaacattcaagtgaaactcataaaataaagaagatatactctaaaaattccagttcttgagaagctgtttacacacaaaagggctattaaaagtgaaagggtaagtagaaaatcttctgggctcatttaataaaagaatgtagagttccatgggattcttttctaaagaaaccactaacaatgttgcagatctacaaatcctaaaagagtgcataatggactcaagtctctgctttgtgactcatgggtgtacttcatcaggatgtacttcctcttttagggggtcatataggtgaataagctgacaacaccttcagagagagaaattccacatgtgtcataggaatagaatttatttgatctcaagctttctatatatagaaaaaaaacaaattctaatccaaactttaatgaattcagtattgttgttgttggtttgcctctagaatgtctcttttgaccaagtcacattcctttaaatttacactaggtaaattatatattttccaaatcttttataaaagcataagctaaatgagataacattaaaaggctgattggagatttccctttaaaagcagtcataagaacaacagcaataataatataacaacaatatacactacattttgggcaccatgctttgaatttatatacactaatattattaaggcaatctgtgcttttgagaagctactccagactaggcactacacaaactctgccacacacaagagagaaacaatttcaattacaaagagagctagaaaataaaatggataagagtatcatgaaagattttttgtaaaactgaatagatcctttcatgtttctcagttttaatctctccaaatatccctattgtctgctttttaaaagaaaaaacactgtaaaaattctgaaaaaattattcacaaagaaaacttccactcgtttatataaagcattattattaacttcataacatgcataatatcatctatttctgaaagaccattgaaaagtagccataaaaacttaaaaaattgaaaataatctttagagatcaacaggccaggaagagttctaagaatatgcattggcctttactaaccattttcaatgccatgcacttttgtctgtcaatactttctcctgttatttttaatatccctagattaagaaatattaacatctatttacaaaaaaatattctaacagtttcccccacaaaagcatattcccatgaagatcaagaaaacaaaaaacatagcagggagtcagtattctgacagccttttagtcttcttcatcttcttcctactattattattagacctactgcctattaccagtaggctttttaaaggtcttggacataaatatcagttgttaagttgctattttcatggtcatttaaaattatttcaaccataaatgcttttaatttcctgaatatcttaaagctgtctaagtataaatattctcccattatattcctctgtgctaacacaataatctagttggagtcaagtttcatgaaaataagaaaattggtacattataacattttaaacactgaaaaataaacgtgatagctgtaggatgtaaagtgtagtcaggcctgtagaacttcggatgcatcattttacaatatcatttatcattttgataaaactgaggtcaagtttctaaaaatacaacttgttaaaagcaggaataaatgaatgagagatgagtcagctcgtttgatggaaagggtttaaaaaatacttcaaaagcataccacatgacttggtaaatattcagtgtatcaaaatgtagttgccatctggcattgatagactgggctagaatatgtgtttaaaaagaacaagaaaggaaataactcagccaggttaatgtgcacttgtctacatttcataattcaggtattaagtgctttaataaatattcactatgaaagaaaggctgcattacaatcagacttgggcagtatttgttggggacagctagaaagaaatgaaagaagacaagacctgatggcacttaagaaagctaaaaacaacaataaaaaagtggtttaggtaaacagaattctcaatcatatgtaatattgccagaacactagtatcacagttaaatgcagggaagtggtaagcttatatttgaaaataaactgaaatcttgcttattttcagctttgaatattttaattattcttttctttggctttgacaatttaaaagtatagagaaatccagggaataagtaaaacccttggttggatagtaaaaaaaaaaaaaaaaaaaaaaggaaaaacgaaaaagtcctgacattctttgaagttttaaacctagagtttgatattaactttgcaatatgcaacaaaacaaaaagtaaatttgaaggactcctcttttctccctcttgctcaagaaataaaatatatttagaaagcagtatcattcacaaaagagaaaagtgaacacgagcagtgaacacttgcccaagcgttcgactgtccaaggctgtatctgggcttgttaattagatatttctgtctttaaccttgaacattctccagatttccaaatcttgacaatttacattctaccacatctcttggaatcagagcaataggcagaagagaaaagttttaaaacagctttgaaggttaattaggacagggaccagggtagccattaggaaaatagatgaagcacttcaggtgagagttgattagggtcaacatgaaatttttcagagttgaggtataatttatattcagcaaaattcatggacttcaaaatgtacacagaatgagttttgattttgataaatttatacacctatgtataaatatgtatatataaaaatgtatatatttaccaccataacagagacatagaaagttcctttgtgcccccttccagttaatttctatctcccataaacaaccagcattctgatttttatcacgatagaatagtttcgccttcacataacttatgtatactcttgtgtcctggctcttctgcataccatgtttctggaattcatctacattgttgtatcatactctgttttgttttatttgcttgttagtatttcattatatgaatataccacaatttgtatatccactttccacatttgggtgcttccagttttaggcaattacaaataaagtcagtataaacttgcctgtacaaatctttttgagggcattattttcattattttttggtaaataactaggaatgtaattaccaaacaatatggtaggcatatgcttaaccttagaagatactgatccaatgttccaaagtagaactatatatttacagaaagtcttgaaattaggtaatgtgagtctttcaactttattctttttctaagttttctgcaatctcatatacattttaaaataaatttgacaatttatcttaatgttagaaaaacaagatgttgatattttgatggtgattgcattgaatctacagataatttggggaaaaatgacactttagaaatactgagtattcatctataaataacggatttttctctaaggccttttaaaattttgagtggggaatcttacattcttttgttaaacttttatttaaatgtcttatatttataggctactgtaaattgattttaaaacttcattttcaaattatttgccggtactacataaatgcaatcaatttttgtatattgatcttgtgaccttcctaaatgcactgttagctctattagttgttttgtatatcccctaagagtttctaatgtaaacaatcatggtatttgtgaataaacacaatgttacttcttcctttcctatgcttatacctttaatttattttactcgtcttattgctctggctaggatctttagaacaacgctgaacagaagtagtaagaatatatatctttgccttctactatatcccaggaggaaagcattcagattttatcattaaggacggtattaattatatgttttcatagaggcccttcatcagattgaggaagtttcaatctgttctaattttctgagagttttcactgtgaatgactgtcaaattttttcaattgctttttctgcatctattgagatcatatttttcttctttattaggatgcatttacagtgatttattttcaaacgttaaactaaagttgcttttctgagataaatcctacttgatcatgaggtattatactttttactttttattgttgaagtttgtttgctaatattttgttaaagattattgtgcctagaaccatgaggaatattggcctatacttttattttcctgtaatatctgtcaggttttgctgttgggattatgcctgtctcataaatcaggaagtgttttgtttttacctcctatgttttctgaaagagtccgtgtaggattaatattatttcctccttaaatgttatatagaattctccagggaaactatctaaacctgaagttctttttttaggaatgcttttgacgacaaattcaatttctttaatcaataaaggaatattttgatttctttggtttactatgccagttttgttaatatgtttttaaataaatttacctattttatcaaagttgttgaaattattgacatgaagttttcataatattcccttgttatcctttaatattgttatgatatgtaatgataatctctcattactgatattcataatttgtatcatctcttttttcttgaacttttctgttatagcttataaattctgttaatcttttcaaatattcatgttttgctttcattaatcttctttgtagtttgtttttatttcacagttttctgcctttgttatttgttttctttttttactgcttttgggtttaaaatgattatactttcccactttcttaaagtggaaacctacgctattgatcttaaacctttcttcttccttctaatttaggattaaaagctcaaaatttctgctaagcttctctctggctcatattataaatgtcaatatattgtattttcatttaatcagtttcataaatttcaatatactgcataacttaatttaattattttaaaatttcatgactttcaaccatgaggtattaagtttgttgtgtagtttccaactggtcttttctagatattttattgttttctttttttatttctaatttaattaattataaacaagaagcatattttgtagtatctcaatcttttgaaaatgtttgaaactcatttgatgaaccagattagggtctactttaataaataaagtagaacatacatacaggactctattcctgtatgttttaaatatgttttaaagaacacatattctccaggtgggaatagaacacattctccaagtgggaatagtgttctgtaaacatcaaacaggtcaaggcagttgatggtgtttttaatttcttgtgtattcttactgattttctgcctatttgttctatcaagttctagaacaagaatgttaaaatctccaattgttattgtagattttactatttctctctagttttctgtcagtttgtgtctacatgtttatgacttatgcattcatgataatttcacacatatgattaggaaatatccctccttatctctaatagtactccttggcataaagtctattctttgtaatattaatattccaacctagctttctcatgcttattgtttgcattgtatatatctttctatcttttcactctcaagatatccatgttattacatttaaagtgtattcctgtagacagcatatgttgactcttgcctttttattcagcctaatactctctcttttaattgtagtatttataccatttacagtgaatggaattattgctacaattaagtttaggtctaccatttatttcattatatgcttttgatttttttcttttgggtttttgtcattgttattcttctgttttcctttcctttttttttttttttttttttgagacggagtctcgctttgtcgcccaggccagactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttcctttccttttttaatgagttaaactgatcaattatttttccattcaattgcacaactggctttttagctgtaccttttttgttattttttagcagttgttctaaggattacaatatgcctctttaattatcactgtttacacagagttaatattttaccactttatgcaaatgtgagtatcttataagtataatttcatttactgccacccagtactttgtagtatttttacatacttcatatctgcaagtactatagactcatgagaaaatactataatttatgcattagtcagtttttcttttaaagaaattaaaagaataaaaggatattcttttacatgtaaatagatactttaaaatttttagtgaaaattttctgtaaaaacaagtttctatcttggttcatagtgtcatttcccttcaccctgaagcactcactgcctttcacactacttataggaattccactgacaacagaaaattcatttcttcattattgcaagatcacattgctctacataaaattctggttttgcagttgtttttcttttcaatcattaagaaatggcattacatttagtatgaggaatgagtcgatgtttgattattcccctgtaggtgatctattgtttccacccttagggctgcctttgagatttttctttgtatctttggtgtacagaagtttgaatacagtgcctacatgtgattttctttgcatatttttgtgttttttctcagcaaattttggacattttcagctatgatttcctcaaatatcatttctgtcccattttctcatctgccacccacaatctgctgttaagattctccaacaaatcattttttatttcagattctgtactttaacctttggttctttttagtaatttcatttcttttttcttcttctgagacatgcaaagtatagtggactggttgatattgttgtacagatcactctgcacatttttgaatcctttttctctctgttctttacattaataatttctattgacctgtattcaagtttactgacactttcttctgccatctacaatctattgttaagccacttcaatgactcttcaaaaaaatttcaggtattataccttaactttttacttatttttgaaaattttcatttctctgcttattttctcatctgttccctcattatgactatatatatacatatatttttagagacagggtctcactctgttgcccaggctagagtgcagtggagcaatctcggctcactgcaacctccacctcctgggttcaagctatctattctcatgcctcagccttctgagtagctgggattataagcatacgccaccacatctggtggattataggcgtgagctaccgcaccgggcctgaaaacatatttttttaaaatcctgaatatatttataatttctgctttaaagtccttgtctacaacttctgaatcatcgaggaatctatttccatggactttaaaaaaaaattacatgtcacatttttctgtatccatcactggtaatttttgaattacagttgaacattgtgcatgatatttatacaaactctgggtttggttatctttctctaatgcaatgcatttttcttctagcaggttattaaattactagtcgaccactttgatttgaagaggactggttttattatttgacagaaactttcaatgcttcaggtttgtctctctttctataattaatttcttagttcttagctatcatctatatttctaaggtttgatccttctgggattcataaagcctgagacatttaccaaacccttctaactttgtaaactcaaactcctaactttgtctcctcttcatctaatgtatctgttcagctcttttagctttctagttgttgcttttctccaggcacttataggctcccacatacatgcacagtttatatcagccagaatgttagggtaacttatatgtagattcatgggagccttccctcgatggctccatcctttctaatacttccttcctcaatttcagctactttgccaatgccagctccattcgctaacatcacaaaccaataagattgtggttttctgcctgaattctaacttctctataccatacagactgggaagttccttgagggaagaagctgtaacaaacgtgaattttacccgggacagttcactccagattccaactgcttttggtcactctccggtgccttcaaataattgtggtgttttttttttaagtttttaattggagtttagttttatttttaacccataccatggtttggaactgttatctgtggaaatatttgtcctgaaacagtacaagttactcctttattaccaaaatcacaactaccaaaattgtggttttatgttagatagcacttgaactgatatggaaaactgcattagaatcaaagtgtctatagggcttcctctctcaatattcagtattttaaaattgagacaagactattttttaaccttaaaaaaatcactcatagtgccctaggaaagtgctatatattccactcagtcgctaaatatggccaatgaatatttctataattaaatttagcagaataatctgtgaataaaatgaaacagacctgtatgtaaagaaaactaccttaatgaacttgcttgggagatcagtggtatgtgatatttctaatcatgacagagaagttgaacatgtggtacagttgtgtagggaaaatggataactcttatcttcattattttttaagtcattctaagagaagcatttgctaagtagtttatatatatgaacttatataattttcataacaatttttaaaaatagtattgtaacattattttgtagatcacaaaactacaaagtatcccaggccatcagactccagagttaaattccaaccattccctctaactacctgctcagaattgagataaaactcatccacagcagtcatcattttttctaagaatatacatcacctattaatgttctttcccatctcccatgttaacaactttcttcctctatcatgtaaacttgctctctatcatctccgtgcctttcttgttcattttcatggagcagccataaaatggagaataacaattgaagcagtgaatagccaagaagcatctctcaatcaatgaacctgagacagcctgttcacttctgtccatcattcttgtcctttagatctcagtttcaaattcatttcttctagacattcatctcttcccatgtttaatctggaaccatctacccttccaccagaccaattatcctggcaaattaatgtaatagaccagtattaattatttgcttgtatgtcttaacaacattctaggtgctgtgccaaaaacaaatgaatagcaacacaaggtcttctggttacaagcacattacattttggttggggagattttgacccatctcacagtcataatcttcatccaggttatctcgtcaacctctatgtatgcatatattccaatattttgttttgcttttctttcttccttgtagtaatttcacacagactattcgcttcaagaacctaactaacttcctgttggtacccaatcctttaactctagagggtcaaatggagccctgtggctcctggcagtgttcctgaagatcaggtccctctggtggaactcagttctcactgccttatctaaccttcctcactcagcttgtaatcaacttaacttttaaagtctttgtacacattaggtaatatttgttctctgaactcccagaggggctgtggtaactgcccaactaggaagccctacccttcattattcagcaacagcttgaagaatattctaattctaactttccgccctctgacagaccagctgcatcaaaggctgtgttcccctgtttgtttttttcctgaagcagagtcaccatttcaaactaagtaatctatgagaaaagtaagagctctgggtccaaatgtttaaaacatggctcttctgtgaaccacggcaaatctaaactggattatgccttatgctggagtcagaacttacttggtcccttgttctttgccctctggctccctgcatgctgttcaggggaagttactggcttttgaactggcggtttgaaaacgaaggcatttttcttttagggagaacagtctttcagtgatttaaacaacaagccttgtgatcaaaataattcataaaggaaaagatttatgaagtgacttcactagcacacaatgcattttaaaaactttgttttttaaataaatctgtcagtacagaagccaagacaacacatctgaatgcaatatcagtggacacaccctgaatctcttcttctttgcttgtccaagactgtggtagaaaagggaaatgattctctttgtcttttcttatttaatattattattaaaaattttttaaaaattctagttccatgaaaagactttgaaaaattgtgcctacttttgtttcctgcaggaaaacctgccttgtaaaaatgtattttccattgaccacttgtgcttgtttaagaaaataaaaaataaataaagaactccaacttataatgaatacctctggcattagggagcctgttctaatctccctttatcaagtttgagtgatagttctgctcaacgagtattgacagggccgtcctgtttctcaggctttcgtttccctcggttggagaaggatacagtgcattttcacattctcaaagtctgcagttgtttttatataagaagcaatttgcttgggtcacgtcaggtcgaatgggatgcctgcccagctcttggttttaaaggaaaaacatacagaaagacacaaaaacacagcagtttccttcattaaattccactctacctgccatgggcttctagccacaatggaatttcccaccctggcctagcctagcctaacttttatttttagggattttttttcccctttaaatcttatgagctttctttcaagtgaactttgaggtaaggattattaaatgatagagtaattgcctggttaaaaaagaatcagacataaaaaacaaatgcctagtgaccttccataatatcgctggataaccaccccctggataacagcctttcaaaaactgttcataatcagcacaacaagacaggtcatgtaatttaaaattaaaacctgaatcatttaatgaatagggatcagcatttttttcaatagtaccctcttcttacctaattgcattggatgaagataattttggagaagaaaatgaataaatgaaaacacaaggaactagataaatagatggggcgggtggatggggggtggagagagagacagcaagtgagagagagaagcttttggacctctctctccaaaaagccatttatgcttttccccattgcctaggggcaactgatttaatcaggattgttcatgtggattatctaaactatgaaaagcaacagggagcacttcccaagaaatccagactgggtgtgctgcagaatacttggtttggggcctggagctaagtagactgttcacattgtactcagggtcctaagaaaagtggctcagtgtctctgtaattctttgtccctttgatctacctcaacatttggtgtctcttggcattaggaaagctcacgaaaatgaccctgcctagttaacagattcatagtctgggcacacaaaaaaagggtaagaaagaaaaaaagctttggtaatgagggagagaaacgtaccttcttgctatctttgctgggcataaataaaaatcgaaagatgtgatttttggagatgtgaatcccgttcttcccatatttagtaatagccttttcagagccaattcaagaccttctatcaaccacctctgttaaacatatcaagttagatttctcattcattattttcaagctggattttgcataatcttccttcaaatgaagaagtttacttttcgaacatgtcatttgctcttagcactgttgttctccttcacccattttggcttcttatcctcaaatccctgattccttattaaagtggattgttaatgcagccattctttagcaccacagcacatttataaatcaaaaattagtttactctgcctggcttccaaaaccatttgctgcttgaaaccatttcatgagtttgtctactcatgtgaataaataaaaacttgcctataatgtgactttgggaaaggaaagagcaactatatgaaacgaattctacagaggccaaaattattttcacgagtttcatggattcagcccttgcatgtgccattctacattaactttatctctgagattaggattttgcttctctttttttttttaattatactttaagttttaggctacatgtgcacattgtgcaggttagttacatatgtatacatgtgccatgctggtgcactgcacccactaactcgtcatctagccttaggtatatctcccaatgctatccctcccccctccccccaccccaccacagtccccagagtgtggtattccccttcatgtgtccatgtgatctcattgttcaattcccacctatgagtgagaatatacggtgtttggttttttgttcttgcgatagtttactgagaatgatgatttccaatttcatccatgtccctacaaaggatacgaactcatcattttttatggctgcatagtattccatggtgtatatatgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactcacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccatgagtaggttgtgaaaattttctcccatgttgtaggttgcctgttcactctgatggtagtttcttttgctgtgcagaagctctttagtttaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacacaattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactatgcttcataagtgaaggagaaataaaatactttacagacaagcaaatgctgagagattttgtcaccaccaagcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaatccacacataacaatattaactttaaatgtaaatggactaaattctccaattaaaagacacagactggcaagttggataaagagtcaagacccatcagtgtgctatattcaggaaacccatctcacgtgcagagacacacataggctcaaaataaaaggatggaggaagatctaccaagcaaatggaaaactaaaaaaggcaggggttgcaatcctagtctctgataaaacagactttaaaccaacaaagatcaaaagagataaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacaggattttgcttcttaagtagatgtcatttttctccagtaaaaccaagtggtttaccctgacatttagtagtaatttagtgatttcagagttccttctaaatctaaagtaaatgttcatgagactcatgaacttgtatctagacaattaatctgagcattttaagacttccctgaggctacatataatctctcacaaccccttgcaaaacctgagattttgaaccactgtcaagtttgtggttgccctggtaaggagtaaagcaaaatcattacttatggcaactaccacacaaacattgtagtgaactgaagtataagaaaatcactactatactttagacagaacattaggattaatgctggtaaccaaggaactaagagcctgtaaatataactggcttaagaaggagaacaggattaaacaatattggagtttagaaacaaaagtagtactgtatcaacctgtcactatgcagccagtcattacaataaaactaaccaaaggatggcggcagaaagaaataaaagtatttttgtgtacaattcttcttgaagcactacttgaattgcatctgtagggaacaggtctcataggtctattatttgcccacctccccaacacacacacacacacacacacacgtactagcctaggccgatatctactgtggtaagtttgcatctgtgagccactgagcagctgctttatatatgcagcataggatgaaagagagaaaactggggtactcatggtttttgtgtaatatcacaaagaaaagaaaacaaaaaaaggcttagagaaagttaaaggaaaatgggcagtggtacatatacagaacaagttaggattccctaggaactggtaataggactaaacttgcttaacatctatcaaaatgacttacttattccagggtcttgcatatacatagcagaagcacaattaatttttgctgaatgaataatctggaacaaggaatgtaaaataaattatccaaaaatgttgatggaatgaaacttttctgagcaaggaaaagctaaactgatggaacacaatatttatccaggtgtgcagaaaggtgccagtgcaaatagagaaaaacaaaatattcaaatacagtcgtttgccgtgtaatgacattttggtcaacaatgaaccacatatatctataccatggtggtcccatagattataatactgtatttttgctgtaccttttctatgtttagatatgtttacatatgtaaatacttaccatctactctgttacaattgcctacagtattcagttcagtaacatactgtacaggtttataaggtttatggcctaggagcaataagttatactatatagcctatatgttagtagtatataccatctaggtttgtttaagtacactctatgatgtttccacaatgatgaaattgcctaaggatgcatttctcagattgtatccccatcatcaagtgatgcatgtctagtttaattataagtcttacctaggaaagggacttaaaggctatgagctctttcaggcaaaaaggccttcaaaattttggcactcattaagtaaagtaatgaaaataaggtttataattcccttatattaaaccctctgcaattatgtgaaactatctgtacttcaaatgccatgttcctataacataacaactcagggtgtcttacacaggacagtcattaaagagtttaaggtagattaaaataatctgcattagtagagaacaaattattttgcggtattataacaattcattgaacatgagaaaaagcaaacaaacacgcttgttaataaatgttacttaacagacatcacactgacatttcttagtgactgactgccatggaagctttctaataagtctaatttttcccacgctctgagtttataagatagcaatattgtagctttgggtgtttacctttgtttatttattgggcggagttttattgcgtgcctcctccagctgtgccaatctggtaagatcaaatggaatcctttagctattgtcactatcctaaatggaccgcatgcttcctttgtcccttgcattctctgattttcgctgggggttatctatcatggctgtacatccaagtctctaatctatctcctttctcatccgtttttcctgacttatttcccttttccctttgtctatttccctgtgagaagccaaaagactgtatagttcttagtagcggtagtagtgctatctagagttggcatccaacagcaccagtgttataatacactttctacaatcaagaaatgatttgatttccttgcctcagtagaaattttacaagttaacagtggttcacctgatataaaccataatatttctatcatatcatgaaagaattctaaaaaatctgttagactttcttctacaagtttgcctatttcctctgaatacagttaattcacctggcaacaaaggagattagctatttctttttgtatgcagacagaaagaagtgtgatctttctttgccaataaaaacttctagtaagtggtgatagacttcaaaacccttctttttatttgaaaatcatggttcagttatcaggaattccaaattcagaatctaagaacagtgatcctatatagtcttgtgattttgcacatgctagggattggtaagttgctgaagacttcttaaataagagaggaagcatttttcttttcacttgcaaagaaccaggaggtacattaaaagaggttttagagtaactagaatgtgtgataaactgttcactttctgttttaaaactgtccatgaggttccctttagagataggacagactacagagaacgtggtgtctcgtttctatgggttgaaattccacagaacaatgctttgcaaagagtcataccaccagttccttttcctgtgagatgcaaatactaaaaacagatatgggctggacaagattattttaaaaatagatagaaggcaataaaagctttggtgatattctagattacatatgaaatgtgtaaaagcgtaaaatgaaaagttctctactttttaaaagctgcatcaaaatttccttcctacactgtaatcgtgccccttaacccatctatgcctgaggttgcaatttctttgaatttctgcaatcagaccatggcgatgaccttgagcagtaggatataaataactcctccatgcttagcgttccaataatggaacactaggcataaatgggataaaacacaaattgctaggttcatgataaacagagcacatctgtaaacaaaataacttttaaaaaatatgcctacatatataattttattacttctagaaacacaagtgttattagacttaaagagagccagtgaattgaatcaacttattctgatatgaacctcaatgtgatctgattgcaggctgcaatgattaacacgttttaaaagaaatgggtccatactatactttccaactgcccacccttctgttcttcttatgctacagatttatggcagcctaacctccagccaacaagttagagaattgggtaagacatcattttggctttttaagaaaattatggataatcaaaaaacatgacacaaaagatttagtggctattatcagggtataaactaataactaaaggcatttatgtgttaggtaataatgatgcttagaaaattataaatatcaagatgctctttcaacaactatattccagatttaggaattttgtagaggatatggcataagagtgttaagaaatgtatacttttttgaaaataaaataaagtctgatttatttattatccaagttcctgtgttttctgggaaaaatgtattaatgagaggtagcattatttgatagttaatggagagtggaaatcatctgttacaggcccacatgctcacaagcaaaataatattctctcaatcctcaaatggaaatggggattataaaatgctataagactctgtcaacatttctgataaattccatgaaaattttgtgttacatattttaaaaattgtgtactatgattataacatagttgattattaaatatgtaatcctttctttcagattattcttcttccttaaatgtaaagggtatattattttcttgatttattcttttggataaatatcctgtacatagatgtctgaaatccagcccgtcagtttccctttaaattctagcatattttaaaggaccttaaaagatgactgtggagtactgcctgatttggaacttgcctctgtctcttacacactgtatgacgttgggcaagccacttaacttctcagtacttcagtttcatcatcagtcagaacagcacaataatagtaccctgctcctatggttactatgaggattagtgggtttcatactgtcaataataagttgcctttctgggtctttgaagtacttgaaatcaggttaattaaattaagcagagctttggtccctttgtttgacaagtaatctccaattttcatttccaggttctgatcccctaaaatcagtggaataaaaccttgtttgtgtaactgccatcttcctgccccaaagccaagattaatttacctgttggttttagttttcactaggtctctctttagctaggtgcttctaagggtaaaatatcaactattaaactatttgaggcaggagatgttgaaaggggaatttaattgttaagtcaatagcagtgtgccagcttagtctgcctttcagaaagatcaccatagtaataacgagaccaataaataaataaaaagtataaaatatacatctatgcagaatcttagaaccctttctctaacacataagtcattaaaggaagctctgaggtctgcctatgtgattcaacatttacacacatcatagttctatggaagaaattctcagttgagagctaccagctttcttcagatcggatcagatttttctatactccattataaacaacaaaaacaaaagcaaacaagtgaacaacaacaacaaaactgtagttgtggttcactccagtaatatatactaccaattcagtggttcttaactgggggacaattttgccacccccttccccaccaggggagaactggcaacatctggagacaattttgataatccaaactgaggggtgctccaatggggagaggtcagaaataccactaaacatcctacagtgcacagaacagacatctaccctgcatcccggcaaagaattatctactccaaagtatcatagtgccactgttgaaaaaccctgtgctaaactaacatctgagagccactggccttaaaccatcagccacatcaacacgtaagacactcagcctatgggatagtctaacagttaaagaagacaccttagagggaactacttcaaaaatatataaactgacaaatctggataccatactaaggaaaaaactggtaaaacaggtagttgtttgaaagcttcttatgcccattattataaaccaataattttagattactgaaccaaccagactaatattccctttgaattccaggaggtataaaaatatgaagtcatcgactatgcaacattatcctgctatggagacattctgaaatggtttataaaagcagtgaacacattaaaaaaaaaaaaactagcccaaatgagttatgcaaagttaaagtcattttttctaggaccagttttttttcctgtgcatagtattttccatatgtaccgcaaacattcatttgtgcagaacatagcaccacatttctaatacaactcctctctgaagacaaatcaggctaaagctaagagttgcagaaccatttctgtatgagtcatttttagcacaacataagccctagagtaaaatttattttctaaataagccacaattattctgcaaacatttaacctagcacctctcaactgttaaagaatgtcaattatatatgaaaggaagaacaaatataaaggaaatttgaaaatcaagaaaattttttctgagaaaagtttgtgagaattattatgaatacagctaaaattcaaatatgtgacattttatttttttaagggtttccctgtcaaagacaacacatatttttctaatgaaagaggatgcctgaagttgacattcataagagcatttggatactaccaatgtgaagttgtacagatttactcatttctgcaattaccctcttgtgtttgaattctactttggttagtggtagcaagcactaaactgtactgagggcttcgcaaaagttgactttatttctttacacttagaaccccaaaaatttacttcctaggaagatactagggaatcatatcttactgaggaggaaataagaggtggaataactggattagcctcacaaagaatgaaagctcagtaatttctgagttggcaatatttttcaccctccttttctccatttaaatttctagatttaccttcaaaacacttgcctttttctaccttaagggaagttctaggatcagggagatggagatagagaaggtagagatagttttaggttttcacagaagttcaattaaaaactgccaagtacctcctaccaagagaccaccactaaaatttatttctagaacaaggtgcagaaaaataaaaggtagaaagcaggaatgttctggtactgtaaaatatttggggaaaaagtctaatttctgttctcaaaatggttactatcttgctctagagaaaaacataaaccctcttaaaataactgaagaacaataagaaacagtataattaagtgtaaaaatgggtggtagaagcaaaatgctgtggggcacccatgtgtcttacatctttccaacacagagaaaagagacaatgggtcaaatgcagcctactctagtctctgatattagtttcattacacagctataatcccattacaaagaacttgaaggaactgttgacattttttgctgccctggagtttattgtctcaagtattgcttgaaataccagggtacatgcagagatgtctgctctaatggtatttgttgacctacattatgttagggttagcctgaataaatggagaggaacgctacatggaatcagttagttagattgtttgtaagtaggcgtgcattatttttaccatgttttattatttttaacctaaagactacgcatttaaagtagggtattatctgtaagtaatcttgttgttatatgaaacagtaatatttattaaaagtgcttttgtaaagcccaaaaaggggatctgcagaggcagatttactgcatatttaatggagcttaaacctcagggaccttcacttgcgcagccccccttccaaggtcctgtacttaactctgtaatcataattttgtattctttttcttcaagaggaccccccaaatagtttaagcttctggtaaaatcttgatctagcctaggtataaaataatcttgaagggatccaaactgatagttctaaaaggctgatgctgagaaagatacaaaatgtgcttttacaaggatatcatatcaattatattttccaaatgtatctctcttattgttgtcgctcccccttccctgccaataaataaatgccattttttttttttacctcactgttaaaaggttattagacccttttaaataagatcggtctgttcagtgactgggaataaccagagtgttaaaaaaaagatgaaaaattcagaggcagaagataatttccaagaatgaaaagatatcttagagagactcacaaaatgtttcactaaaacagcaataattattatccatacctaaggagtacatgcatttgagaaaaggaagggcatggaaagtctctcaatacaatttacagtagtacctactgaaaactgtgctgagtttacacagagtgtgggaatttttaccaccagtaacaccacgtgtctgtttttctggtttctgaaaaccccaaataaatcccacaagcgcctctaaactccaccatggaattctcacacttctgagtaagaagttcagaacagaataaaaactttggatgcagtatgtctgtctatagtttttcctataatgccttgtcccagtttttgaagaaaactgaataaaaattaattcaagaaaaaaaatgaatgaaattacctcaaatggaatattaaattgaaaaataatagtcaaattgctcataaccacttcctgttaattttttttctcttttagaaatggagtaagaatgcttcaaataaaaaacgtaaaacccatcccatcccataaagggcccactcacgtaaacaggaagcttattaaaagaacttttcttggtttcctggcaaaatccagcttttattttggtggcagcatctattaaggaggagactcattttgtgggcaggatgaaaaattaaacattgcaaatccatcaggtacttgctggattagagttagttgactgacttgttggctacagggaacaaggtagttctgaaaccaaggaacaagctgccaaggaacagtccagccctgcccaaaagatgatggtcttctccatccaggcagcacaaatcaactcgaggttccaagagggccagtagacgccagcctaccttactgtaaagtgtctcacatgcatatctaactgttctctcctttcctttacatttaaatcctgttgtattggcttctctgttttccctttcctggaagcgctgtagcgtaattaaaagagtatgagttttggaatttcaaaacttggtttatagtccagcctctgccaaatactgtgacatgttacctgcttgagccatcattttctgatatgtagattgggactaacaattcttccttaatcagctcaagtttcacaaaatatgggtaaacatcacgtgactcaaaatcaactgaggcaaaaattcagatgtcaatggccctttcttgacttattagaacctccatgagctagaaattcttggaatctgaattttaaactcactcccaagtgatttccatacacacagaagtttgagaaccacatcccaccttgtcttgtgtcaggattaaataaaaccatataggtgaaacttatctgtaaattgcatatcaagacatgcttagctgctctcaatagtatcattttccagatagcccaaagcaccaaagtaaggacagcgggccattttcccaagatctttcttccagcttttccctgccatgccaacagcattcttcatcttcaggtaggcagggcaggttcactgggggttggggtagagctcagcactgtgacacaggcagtacttccgtagaatttcatttatgtgactgtacctaccccacagggtgatataaggattaattcctatttggtaatttactgtgtgtaaaatgccttgagccccttggaggaaagtgctatataaatgtaaaataattattataataataataacctcgactatttaactgatcagtgaattagccagaagatttaggctgccaagggacaaggctgaaaccattataagtagaaacactttacatcatcatatctcaaactgttatcacgaaaaagggaaacaaagggtgaaaattaagataaatccatgttctcaactgatttaaatgacagaggatcactagtaatgattcatgaaagccaggaaatgcaaaaatgacagctgcattgtaattctaactcagccacatgtcctgaggttttgtacactttggtcttttatttgtagggaaaatatctcatcagtgcaacatctaaaatttagcattatgaaggcacttgactatgcttttgcttagttgaaatacgttcataatgtatcccctatttgtaggtaatgatttttctacctaaaaagcattgacattattctatgaagttccaggtaaattttgaatcggttgcttacaatctgcctccccacatacacaccctaagaatacactctaacaaaacaatggtgtatttctagatctaaatttaggaaaccaaaatatatagaagataccttttcttcccaggaagaaaatgctttggtatataaactcacatgagctcaaccgtcttcagctcttacattatttgttttatttatttattagattcatgaagattcttctaccaaaagctcaaggggctgaacccagaactttcatatattgaatgtgaatcacttcttaaaccacagaaaggaaaataaagggctatagaaatcttaatgggcaagctccagatgctcaaaagcaattgtttagttactctacttagttatgcatcattcaaaacactttctaacaatcgggcaagaaaggttcctttgtgaagaacaggctttggggtcttggacaagttttaattctagttgttttatagctcatacaaaatagttgtggtgcatatgtaaagaggtactgtacttacatgcaataaagtttgcagatgaatattttgaaaatcaaagaaaagaaaacaaggggaggaatgagcatgtggtaccttgctctatttttaattattaacttgtagcctcaaagatttccatttagtagaaacacatgtaaactacaatgaaggagtactagaaaataaagtcaattggtataactcaaattattttgtaaaatgtgaaattaagctttaacctgtctatgtggaagggtgatgaataaatgaatgaatgaagtaaaaaatcaaagatacagagttgtaactgattttctttgcatgaagtagtaaatattaatattagaaatatcttttgatttagataaaactggccttgggtatataatacacaacactgaaaaacatttcaaatgtggtatttgtttaaatatatacatacataaacacacacatacacacacaagtcaaaaatatgggtgttctggtatagttttctgccttcaaagggtctctggaaaaaacagaagaaaaggtatcctataaactgcttttgctgaggtctctagtagagagcaaatcgaggcaagtgctgcccaaaataatctctattacaaacatttaaaaaatctatctttcatatatatatatgaatatatattatatatattatatatatacacaatatttttaatttttaattttattttatttgctgtatagctaacagcatagccaatgccctgatcttctagccacactgtaatttcttgtccttgcatcacaaccccagctgtagtcatcaaagtggaaaaactgacagcattgtctgaaagacacagcttgggaaaattgctccttgtagctcccctgtcaatgaatattatcatatttttctcatggataaggttactgtgttttttttgctgggccgggggtggggaggcttctacatacttagctactaagcacattaccattccgtttgtggaatggactaaacgtgacaatgcgagctgtagggttagcattcccaacattctgttttaaagtttttgtgtgtatatcttcaaaaataatattcctttatgtattcagaagaagtaaaatcacaattatattttacttgacattactattttcttaaggaggctaacagaaaaatcaatgggtgggcataaagagaaagaaatcatatgaggctaccacacatattctgttactgaatttctttcacctaaatatacaatggaatgctctgaattgtatgttttcttttcccatcatattaaactaaagcaaagttcttgggctgaaagtagaaaaactgcactttagtgttctaatgatccacacctttcacatattcacttcgcttacaattctagatgctaactcaataagaaagaaagaaacaaattcagagtatttcagtcaccaacaacaacagcagtaacaataacaataatattaatatcagttaatatttatttaactcttagatatactagatgccattgtaatcacatgtattaactcgctaaatcttcacaactctaccagagagtactgttattactccgattttattggtgaggaaatagaggcacagagagatcagaaacttgcccaagatcacacagtcagtaagtagaggagtcaggattcaaacctaggaagccagactctgttacaggatgaatattttggttgctaaaggccccatcttccttacttctcctgatcctcttccccaactgatcagcttgcagcattcatttgatcttctcaacaaattacgtattcatttgcacaccgtccatttagaataacacagtagttaaaaacttaggctctggagtctaatatgagggtttactgccacatattggtagtgcttaacttttctgtgcctcagtttccttctgtataaagtagtaataataaaagcaatttcatgtatttgttgtgagggttaaatgagataatgtatgttggagctcaatggaaggtcaatgttctataaacattaagttcattattattgatttttatctcttaataaatagaatccctttttccaattagattgtttttcagaaaaattgtgaatatgaatcttttttgtctcgtgtaggggttcccaaatgttcagtatgttgaactcttagatgtcctaggtactactgaaatcacgtgtattaacattcataacaactctgtcaggtaatacttacatttacccataatattataaatgatataatataccaatgtctaaaatttagtgagaacttactcactggacaagtgcattatggcattatctcattctccctctaagcctctgaactaggggatttttttttttttttttttttggagatggagtgtcactctgtcgccaggctggagtgcagtggcacgatctgggctcactgcaatgtccgactccctggttcaagcgattctcctgcctcagcctcctgagtagctgggattacaggtgtgcaacaccacgcccagctaatttttgtatctttagtagagacggggtttcaccctgttggccaggatggtcttgatctcctgacctcgtgatgcctgcctcggcctcccaaagtgctgggattacaggtgtgagccactgtgcccagccaactaggggatttttataatctcaagtttatgcaggaggaaacagaagctcacctcggtcatcagctggtaaatgttcacaaatgtaaattcttaaccacaatgccatactacctgctaaaaaatgaatttaaggtagatctttagtaaatatatttggtcttgatgatgaatcaattgaattctttatttctgttaccagaaaccttgcacttaacaataaactaatgtggccttgaccagcagccgccagtccccaggcttcagacactggtacctgttaggaacttagctgtacgggaggagatgaacagtggacaagcaagcattactgcctgagctctgcctactgtcagatcagcagcagcattagattctcattggagcacaaaccctactgtgaactgtgtatgcgagggattgagtctgcacactccttatgagaatctaatgcctgatgatctgaggtggaacagtttcatcctgaaaccatccccacacctccagtccatggaaacattgtcttccatgaaactggtccctggtggcaaaaacgttggtggctgctggcccagacaatatcactcattctgttaactattgaaaagagatgactgtatgtcaggtacatgccaaatactggaaatttgaaaaatatatatatatacattgtgggtctaaaactgtatcattaaaagcagctaatgatttaatatcatttcatttactatcattttctgtttactcttacaaaaatcaaacttcttcctctccccttcctctctctgcctactctttcttattccttcttttaaatcaaagttttacagtattaaccttacaaagatttttgcccataagaaggttatatgttaaggcaaggaactgttttaattatatttactcttcattttgagtatatttctttttcatacctgacaaagacttttgaaatgactaaagaaaggcaaagcaatctgattctttataaaaaaatctttcatatgcaatcttttgtctgtagtattctcataatagcttagaaattttaaaagaaggttttagctggttttgttcttttcaaattggcagaatttgatttttttcctcttcacatttggattcactttaaaaatcaacaaacaagaaaataaaaacatattcaatttaaaaaatatgctctccattggtgccttggcatcatcaaccaatatcagcatcactctgaaaaccatttctattctgtttttaaaaaaaagagttttaaaatgcacacataaaatgcacttaaaattgatcctactgtattaaggagagagaaaatttaagggcaatggagagctttgctgtaaccaactcttcagtcaactataggatattgttaatactgccttcacctccacactgaagatataggtaccattttgactgtgcttttgaacaatatatagctaaagatttgaagtgagtaacttcaaagtcagtagttttcatgtatacgtcgcagaatcactgcatcttatgtatgactttaagttgtattaagctgataatttcaaaaagagagactttcaatgaaagaaaattcctgaaatttggtcattaaatggttcgagtacgtagaattacttacaatgtaatgccaaagaaaggtatattgtatttatccagaaagcacgagcataagaatgacctcagaaagttattataatttattacttcattaaagatacatttctagtccatctattatgtgctaggccttataatagacaacaaaaatgcaaagaacaacaaatgtgatctgaaaagtagtaaaggttagggaagatgggactagtaagagagaacagaagtaagaaaataaagtgattataattgtaactgccatgagctgagggcatatcatgcattgaggtaaggtcctaggtgcttaatatgaacaagccctgcaagacaggtatcataatctttgtctcacaggtggtgttgggaaaactggctagtcatatgcagaaaaatgaaactggaccccttccttacaccttatacaaaaattaattcaagatggattaaagacttaaatgtaagacctaaaaccataaaaaccctagaagaaaacctaggcaataccattcaggacacaggcatgggcaaagacttcatgactaaaacaccaaaggcaatggcaacaaaaacccaaaattgacaaatgggatctaattaaactaaagagctcctgcacagcaaaagaaactatcatcagagtaaacaggcaacctacaaaatgggagaaaatgtttgccatctatccatgtgacaaagggctaatatctagaatctacaaggaacttaaacaaatttacaagaataaaacaaataaccccatcaaaaagtgggcaaagatatgaacagacacgtctcaaaagaagataattatgcggccaaaaaacatatgaaaaaaacctcatcatcactggtcaatagagaaatgcaaatcaaaatcacaataagatactatctcacgccagttagaatggcaatcattaaaaagtcaggaaacaacagatgctggaaaggatggggagaaataggaatgcttttacactgtttgtgggaatgtaaatatagttcaatgattgtggaagatagtgtggtgattcctcaaggatctagaatcagaaataccatttgacccagcaatcccattactgggtatatacccaaaaaaattataaatcattctactataaagactcatgcacacatatgtttattgcagcactattcacaatgtcaaaaacttggaaccgacccaaatgcccatcaatgattgactggataaagaaaatgtagcacatatacacatggaatactatgcagccataaaaaaggatgacatcatgtcccttgcagggacatggatgaagctggaaaccatcattctcagcaaactaacacaggaacagaaaaccaaacaccacatgttctcactcatacatgggagctgaacaatgagaatacatgaacacagcgaggggaacattacacaccagggcctatctgggggtctacggctaggggagggatagcattaggacaaatacctaatgtagatgttgggttgatgggtgcagcaaaccaccatggcatgtgtatacctatgtaataaacctgtatattctgcacatgtaccccagaacttaaagtataacttaaaagtttttttaaaaaatatgtgataaaataaaaaaaagaattaaccacagtgccttgcctattcttctataacagtatctatttcactctattttattttgaagctatttatctccaagtttctttctagaatctaaacagttaacagcctgagggcattgaccttgactcttgtctaagttttacaaacaaacaaaccaaaaagcacactgcattgatatacttggccaagtaatgatgtccaaatgctacaatgtcacaaccagtgctcagtaactattagataaataagatagagtcattcactcaatcattcactcctgcatgtttcacttagtaatcttgtacgctcattgaataaattaaaagctgctttatgaaaatgttttctgttaatttgaataaaaacctttacacatcaactagatacaaaagagaaatctattgtttgacaatgatcgttactgaatcaaaaaacagtggggccatctgcagggtacagatcatgctagagtcagggaaaactggtgataaacttcagaaagccaagaaatataccagcttacaacttagcagcactgcctccacacagtcttcaggtatttattgactgtctcacactaatgcatgagtgcctgtggtaatggtaaaagtatataaatttacttgcccagagatactaattgttaaaacaaatacaacaatttaatggcaatgcaagagaagacagactaacatttacaaagctatttcttgtttaggcaagatagtagactctaaacatatattatctcatttaaattatcatttaaaaacccttagattgttagtatttacccattttaattaaaaacataactgagcgtataatttttttttttttttttttgagacggagtctcactccgtaacccagattgcagtgcagtggtgcgatcttggctcactgcaacctccgtctcccgggtttaagcgatccttctgccttagcctccaaagtagctgggactattaggcgtgtgccaccacgcccggttaatttttgtattgttagtagagttggggttttgccatgttggctaggctggtctcaaactcctgacttcaggtgatccacctcccttggcctcccaaagtgctgggattacaggcgtgagccaccacgcccagcctgtaaatcttgacaaaattcccagaggcaaaattattagaaggctgggagccaggattaaaaaacataaaatccttggcttttccatttatttcacattgcctcttcttagaatccacttctacaccaaagcagttaaaatcaatgtggatttgtattttaatagagggtttatggagtagtgggaaagatagcaaataataactatgtttattgaatactactgttcctaacattttgaacctatccaatcatttaatcctacaacaatcttttggaagtgagtgctattattattattgccactttgtaacagagaaactaagccaaaaagaagataaacatttgaaaagtcataaagctagttagccgctgtgcagctgaacttgacagcctatagcccacagagtttaaccatcatgctatattgcttcattaggttgaaaggttattaaatgaaatggcttaaacaaagttctaagcacatggcatggcacagagtaggtcttcattaaatgttagtttctgttttttctttaatctctaaaattctataataataatacctttattttcaaagtaattctgctttttaaagactttatgacatctgatttaaatttcacaaaaaaaggatggtgaatgtggaataaatcttcacaaaaatgacactgaagattatttaaaggcatagaatgttactcacaacacagatttaagagacaaaagtagaaacagtgttcacagtgttttaccaaaaacaaaaagggtatatatgcacaggaaaaaaaatgattagaaaggtatatccccaaagtttgaaaacaaattacttctagacgattgtggggattttaatcgtcctcttgtaatttatgctacgcacagaattctacaatgccttttgtatgctttctatactaagaaaaaataaaaaagaagagtagtactccttttttgagatcataatactgaggggggagaaaatcagtagaaatgtgtgagatttcaccctcagtgatagagctggaatagaattcgcactcttcatctctaacctactgtgttttatctgacccttattttctattcagtgcttaccataattgatgaattcaaaactaatctatgatgaaaacccctgaaagtgattagagagactgtgattgtaaatgtggtatcaatcactaacacaaaagtcccttataactcatcaggcttcttaagttgtttattcaaaccatttgtttctgagtccaaaccaataatatatgtgatagaccggattactttctctaattcttcactccctctctataatagaactttacatccataaactttaccatatgacttgaatgtaactctcagtagagtatgtgttaatgtgggagatgggatatatatctctgtctcttggctttgagcttggttaagtgacttgctttgactaatgaaatattagtaaacatgaaatgagcagagactttaggtattttctgcgggaacaaattctgtagttgtcaatagtttattctcctagattaaatgtttgataaacttttctaaaagaaggaatttttttttcagagagaaatatagctaacatggaatatcatgtccttttgtacttacctggagccaaagtaaactacttggaaaattaaggtaccttttgctggactattcctcatcctttagtttcttcagtccagactgggacattttggttaaaaaggagtaggcttgtgatgttaaggtgatcatcttggtcaccataccccagaaaaaatctttacatatccatgtcttagacactgaggtacagaaagagagttctgaactttccattccattgtcatttgtgttgtggagtcttattaatctgtctcatggaaggtgggaatcaggctatgaatggacaataattcatggggggcagtcaacagtagagaagaagttgctgcaaattgattaatacaaacaaaccaacctgagtacctggctcattttaggttccctccaaaggcttcagtacaggcagtaacttagaaggtaatctcagagggtaagataataataaggattgacaataataaggattggccaggatctctgagatttacacaaaatggctccagaggtagacattataaagaaatagaggctagaacatctctttttccagctctattcctcctttagttgagagtttccccagggcattaagccctgggggcttaatgtaagccccactctccccatcctagattttttgagatctcccagcattggaaaaggtcctggggcagaaggaaaagcatacttgaggtgggagtctgggttagcagagaacggcttcaggtgcagctgaagggaccatgacagcactgcctgacatctctgagggactatgacaggattctgacagccatatctgctacagaagcctgtaaagacttggggtggggggcagtggtgtataatatactgtgtagtctgatattgcatcctttaaagtatgatctggggaaggttaggctgcatcttctttattaaattatattccaaacaagttgtctcctctgactcctgcatgaagtcagactttgggacagtaaatcctacactgtccagctaagaaaaatgacatgttgttaataggcttaactgattctcttgctatgatggcaagatcagatttttagcagtgcttctgaaaatcctgacactcattcaccaattattttcttctaggagtctaatatgtattcatcttcccatatttcagggaagaaatagttgaacgactttagggagcttttcccaaaatgctgacgcatttttgcagcattttgccataatggggcctattgaaaatttttctgacattctgaattcatagcattaagatttgtggtgttgtttttgtatctggtttgtatttatttttgtttttattaaaatacaggagaaattgggacaggttaagagttgcacctaaatgtatgaagcttgaggtctttgaacataaatgagttagatatacagaaagttattaagacctttaagcattcgtaaacatttcatcattgctgacaatatctatttactttaggtaaccctgcctgagcagctcctgcattgctacaaggatgaaggtggggttatttaaaaatttaccaagctgtgaaagagttttctggagaaaactggtttggggactcagagcataaggataaacaatggatacttttatggttacaggagaggagttgataaacccctcattcctctaatgtaatgtataaaagaaaatattgtattcctggtcctcacaaatggggaggtggtagggtaggtaggttatatgaacacacatgtcttccctttgacaatgagtgggcaggcctttaaaaaaaagtctgaaaaaataaagagccctggggaccatttaggctctatcagtgagttctatcctgagatatcaaatccagttgcacagaatctaaatgtcaatatttacaaagctctttccatcttatatcccgcttcctttttcttttatgctctttctaccccttttccttcctccctattcccttgatcccctacatcattctgttttcccatttgctctcatttcctaacaacccccatccccattagtcagtccaaaatctgttcatcccgctataggcttcagtgatggaaaagaaagggccccaaacaaagccaccatccaagacaaggagctccagagggtggtgaattggtgattgaggtaaagcctggggactgagaatgttcaccgctctggaggttcttagcccgaaaagtgattaggcatcagcaggcttgatagctgtatcaagcctcatgatttcaaagctttcatgagctgacaaggacttgctaatttcaaactttctaaccaattacaatcacaaagaactcaggacaacaatcagtgagcaaaatgaaactgctggagtgaagcagccctcggcaggtttcactcttgtagctctgctacgcaatgtgcagctgggactctgcttcaataagtaaataaaaatacattataaaatacaaacatacacaatggatcccacttgctgtcttgttcccagtaaaggggtatgtaggaacgctgtcttgcattcattcagtccattaatttctgatggtgttaattaaaaacttttgatgctggtttgaatggaaaatacctcaaacagtgtttcctttattgaaacaccaagttccaagtcttggattattaggttaagctctgtcagtagtgagaccaacataaatgcttttcataccgtatgctttgacaaaagagaatagtaataataataaataaataaatgaaaaggaagaagaaataaagtgtttagactgaaaactcctttacttcaccaacctgtttttttaaggactaaactaaaaatccaggtccctgaatgtagaacatataattttaaaaaaatcttttttcaaatctttatagaacattcaaatcacccaatgttccaggacctgaattttttatattttaaaatgaagaaagctgcttaaaataagtgaatcagctgctaagtgatttctctctgtcttttcctctactctctctttaaaaagactggaaaatgcttaaaatggtatatgcaattgatatgtgcagcttaaggagcttaatataattactgaggactcagactttctatttaaaaataagatagggtagggtaacagaaactctgagtggtgagtattcatcccttgtgatggtgaggtgtgggaaatgtttccaaatgtttaatccactgagcaaggtaaagagtgcgaagcagttattcacagaatttggtgtccttctgaaaacctagggaagcctaggaaatccagagaacaactgaggaggatagtatgagagatgctgtgcaggaaacaagcaaataaaatatccatttcttcaatccaatgcttttgtgaagtattaagccaaccaccaaaacattctgattgatttttaagactcttctctaattttattttttaattactcttccctttgtgtattggggtctgaagccttgggcacccattctgagaggtcttgtaaatgtgtctcacatatgcccgtttctcttttgttttctaatatacctttctctatcatttttcatttcccaacctgtttattcacactgtctgcaatgtcatctgaatcctcgaaaaaccacaagactttctctttattccccctgaaggccttcatcactcttgttcttgttttgatctacatatctctaacgagaatgaagttctccataaaggctaagcagtttggcagaacttccttccttccctccctaaccgcaggctgtattgacctcaccctcttggatcagtttgctaaaatggcctccaaactttatgtgatatgatagtgaaccttcaacaacaacaacagcaataacaacaacaacaacaagagcaacaggataacttcagtgtaaggcatgtgagaaaaatacgcagagtaatagaactaaaactccatgagggaaatgggcctgagcaaaccacagcatgggtctttttgttaacaaaatgtatgatttttccccagagtacattgatagaggacatagcctacaaaggaccagtaaatgtaaattaactaacagatatgtagcaaatgaatgcatttaaagatgatttccagctgaaatgtttttttttttttttttctggagaccaagtttttgttaaacttaatccttactctctttcctttccagcagcagaaacatctggtcggttttagattccccttggatttccaacttcaaagggaattataaagaataacaaattcatgtaccggcactaaaaaaaaattagagcagcaggagagaatggtaaaattgtccttatttgactgctagtgacaggcgccacaggcagaactatgagaaaagacaaaggcaagatcaccagttgacaaccagagttcctgcaagagactgaatctttggctacatgcaaatatgcacagggcccttaacaatccatagggagatttacttgcttaaggaaaataaataggtaaataaataaaaggagttgaaaggtaaaaaaaaaaaaaaaaagaaagaaagaaatgagttcatgtttgcctgtcacatagtttgttgaaataataacaaataaaccaataaatgtttattgaaagaatgacctggaaataattttaaagatccacttaaccccttgggttttatttgatttaaagaaaattgtgagagttctgattctacaaagggctggataagtcatccaagaaataatacaggctcttaagagtccactaaacttggatctccaaagttcttaaaagtagtttctgtttctcctttggctccagatccttattatcaaaagatgtgacgagaaatcaaagtcttcttagtggccgggcgcggtgtctcacatctgtaatcccagtactttgggaggccaaggcaggtggatcacttgaggccaggagtttgagacaagcctggacaacatggtgaaaccctgtctctactaaaaatacaaaaattagctgggtatgatggcgcgcatctgtaatcccagctacttgggaggctaaggcacaagaatcacttgaaccggggggacggaggttgcagtgagccaagattgcaccactgcaatccagcctgggtgacaaaatgagactccatctcaaaacaacaacaaaacaacaacaacaaaaaaccaaactaactgttcagtacatgctcagtacttgggtgatgggatcatacataccccaaacctcagcatcacacaatatacccaggtaacaagcctgcacatgtatcctctgaatctaaaataaaagttgaaaaaaaaaaaaaagaaatttgtaactgtgtcaagttgtgtttgacaccactttatagaaatggatttattcttctcctctatcattttcttagcaaaactgaaacacacttctagagtgcaggtcttgatataatcagacatgagaaaatgagaacagttagagaaaatacaattttgccattgtaattacctcttacaaacagcctttcctctttcctgttttatgtgcaatgtgtacagcaacaacaataaaaataaacaaagacatgattaaccgatcaatttgtttctccaaagagagaaatagttaagggctaaagtgcctttcaataattaattataagagtctttaaacttagtattgagaggttacagatttccataccacaaatacattaggttgattcacagagtggccatcaaatacccagaaagcaaattacttttgaccgaaatgtatacatcaacagtacggttaggaatgttttcatagaggaggacagaacatacataaccagttctctatggagcctagcatagtgtcccatggaccaatccacataagataagaccatctacagagcatattcttcatatcacagactctaggtaagaagaaagtattctctaggtaagaggagaaaaataagtgaagatttctttcgttaacacttccaccatgaaaggaatgagctgactacagaaccattttcttgaatatttttgtcttgagtggggtttttatccttccttcaccactctaggtagagcagaatcaccaaagttctctcattacggtaatgtcataaatcccatcctatagcagttgtgcatgatcctgtgttatgcatccaataaagtttattcagaaaatatgtcagcttcattaaacagggatctgatgatctgaacaaaccacttatcttgcttttgtgacatgtattggtatccttaggtctaaaatgaaaatcttggttggtgggggtatctgccaaggattccctgcctcatgtaagcagaatcatctaaccacaattctgagcttaactgggggaaaggaggtggaaggtgtatcgtactagttcgttctaagaaatgtcttatagcttgaggatacgtgaggtcacaaatgtaacaacaactgaactagcaccaagagccaaagaggccaagcataaggaaacctgaagcaagagaaaaaggtgtacgcgtacatacaccaagaagcaaatgctatcattaataataattattgttattacagctattagaatgatgaggcattgatggttcacttgggtgaaatatataatacataagctagaaagaactgtgggtaaacttatggatctttttaaaaggcagtttatattctaggtttatgtgatatgagacacataatttaacaccacatataagaacaggatgctgaaaaaagtgaagaagacttgcagctttaaaatagtataatggctagttcctactggtcttttcttgtgacacctgccttagtcaagccatccgatatagttctaaccttttctgatattttaatgatgatgacaggcccagagtaaaggagacaaaataatcagaagattcagaggggaaaaagaaatggaaagaaaaaaaaagagtttgtattgtttataccatctaatctgacaaattttatatatgctctctgtttgctcaggatagtttattgctaatgttatgactttctcttttttttccatgtgctttgctctaccagttttggctgaaaatattttgtatatgtccatactgtaaaccctcatatttttctagagatttagtgtggtggggaaacttttttttcttccccaagggttaggcacatcaatattctagctactcacttttgaggccaatggaaaatgtgctcctaagattaaatagacctgagtaacacataaattcagtttatactgatgcagtatgttgcatagttacatcctgaatttctgatgcgtgtaatacacctgttggacaacacatcactactgaatagtcactgacctacaattcaaagacagtgagacagcacaagactacagatacaggttctctacagacagcctgatttgtacagagcattcctcatctgtggaactctgtgtgtaaaggatctaggctagccatgggaagctggctcatagagggttctaaatatttttagaataaactagagcaataatacaagcacagagagcaccctttgttatacaatgcataatttctttccccccaaacatgttgtttaaaaatgattcagatttttattatataattcccccttttacatatttctaaatgcctcacatacccatcacatgttttccatgtctgccaataatcttaattaaaaattataaacttttaaagccagtgttacatttgatttaagtagatttgccatatttatctggtattggttggctgtagccagactggagttctaagtaataaggggactatgctttcctttcacctcaggtaagaaattgtattcaacacatgcttaaacccaataataagtataattaatgctgtatagatctggcaggcaaattagcatcctaaatttgagtcaagtaaaaaaagtaccaaaagaaaatagttcccccaagaaacctagccaaatctgtgaaatatttctctaggcaaccaaattgccctgtggcttacagatgtgtctaagaatattaggcaactcactgatgagattttacaatcaactgttacatgttagaaaatatgatgtcaggatactatgaagaaaaatactactatatacaataataagaactatttatctgaatagtttttaacattaacgtgtaaaaaatatcctgatggatctgaaataatgatgtactaaatactacaatgtctggggtttgcttcaacataacatggtgatatagtgagaaaataacaggccatcagttagtcattgtgcaagctggtgatgagtacatgggagttcattatagtaatttgtttatattcatgaatttaagattttttatcataaaaaatttaaaaacatatactgatttgaacttttattcatttattatttgttgactgattcatttactgtttatgcaaggtattattgagatataaataataataataatgctcttattgggcatttaggttaaatgagctattcctcttcaggaatattatatatttattttaaatgtttataaggtctatgtaattacatatttcttaggttaaattttgaaagcaggacacaaaattatatagaaagtatgataacatcatgttttaaaaatatatcctcggggaaaatgagagtaaggaaatatatcaaatggttattaatgattggatttaaattatagaaataattactttaatttttcttcattttactcctatgtgtttttctaaattatttttaatgagcatgtatcattttaaaatgaaaataaatatttcttcattactggaaaagatatgttctccttccccaaggagcttttcatttactgaaacagagaaactgcaaacacacagcattgcccagatagtttaaatctccatacctagaagggaaatacacccacaggaaaagaaacgtcaatacagattttatctgatcatagaaacataaagagctttctctgtgttggacagcaatagggaagaaactggcttgtttgcaagccagcaaaagcgtgaaattcagtcctttttgtgatgagatcattttgtgataaatgcaaaaggagtgacaaattaaagtcaccaaataagcctttcccttgagctcctgaggcttactaatacgagtttcttttggggtagcatagcaagtaaagcgtgggagtggggagggaggcggagctacaatcccgaaggctcctggccttcactggtgagatggatatgctcagagagacagagatagatgtgcaacagaatcagaaacaacaacacagtgacaactatggattatgcacaatggatatggaaagtctctgttagaaaactatctttattaccccaagagattatttccctcagtttatgcacgttcatataaagcgaagtcaagagtgtaacttttaaaggtttggatgaatatgatgttcatgactaaacaggcctagatggagccaggcagaacacagttagatgccagggaagtcacccttttcctcctcctccctctccagtacagttgccagtgcatttcaatgcaggtcagcctctagcaaagtcagctgtttcaagctctgattggataatactttatctatacacccccagtcttgacctgcactcttctcccagtcatggaaatatcaagaattctagaaggccacaataccaatctttttgaaactttacaaactttacaaattttcactacaagacacctagaaaaatcttcaagcctatgcttacctgtagccctggtcttggtcctcttacttaactggtaaaagaggatagccttatttatgtctttgaagggtattttccttttttgcttgttggtaagtacaagagcaaccatgtctaattttaagattgatccaaatgaagcaaatgcatttcaaatttacagaataccatagaatactaatgggtagttcaaagtatcactaaatgtgtttggagggttttgagttttttcaaaacatacaatgttccacacaggaaacatcagtgccaacttcaccctatcactctttctgtccactcaggagtctcctttggaaatatatctctctggagggtcttccaaacaaatcctttgaatacttccatcttgtttagcagagtattctaaaatatttgtcaaaatctgtgataataggttctggagatcatgtttcttattcttctaaatgctggtatttcaaatgaacaaataggatattaaagatctgtcctttaccaatgtcaaaatatgttctgtcaaaatttagtattgctaaagtttagacccaaagactcaccacagcctttggatctcatattttctgaggttcatggaaagatatttgacttctttgcacctcaatattttggactgccatttagagataatgagagttacttaccagacagcaatgtcatgaggaatatcctgttagtaatgatgaaacattctgaaataaaaagagtacaggtaagtgctaggtatttattttaataaatgtatgataacatggtaatcatagaaaataacccatttattcctcactttgggatactgactaagtggtagtatataaaaagtaaaggatgtttccctttgggaatggaaatagaattgtgcactaagaaagtatcttttgtaactgcctgcatgtttaactttaaggtctctaaccagttgcaaccagttatgaatgacttgctgcccatttctgcaattcactgtaacttgtgttgagaaggttatgttttatggttaattatccatggtctgtttaaaaaaataaatcaaaccactgtaaaccactaggatttgcagctccatttgagctttactgtagttttgatcaaacattttgtacataaaaacaagctggtttctctttgtttttagttgtttgttatttgtgttataaatattgtggcaatggtgggagaataagctatggattatttaccctcggtttcatgagttgtgagttattggccttatcctcctttataagtataaataaatgtataatattatattccaagtcttgtaagacaaatggaacgagtgaactgaaaccttttagacccaaaatcttttatgcgaagtcatagaacaacaaaacaaaacccaaattaacatttaaaaagcttctactgtggagcaacaaagtctttaaatattatataatctgcatttaaaaaactgctcatctaacaggcagcagtctatcattctacaagcttttcaatgcctttaacattcagaagctacaggtggttttcccaaagatcactcagcacccccaatatcactaccacaatgaaagccttgaaaatggccagcatgattactttaagccaaaatggatttagaaaaatcaggaattcgtgtagctaaaagtaatgaaacactgtataaaagaagaaccctatagaattttttttatagttaccatcctaggacttatataaacaaaagaagtccaaaaacaattgtccagagaaaatgagaaaagccaagattcaaaggaccctgtggcagagtgcatgaggagcatactcgatagctagaatcataagtatctaacacatttgcatatgaaacttaatgaggatcaccaaagtagcttgccaaaaattatgtttgttaaatcagccaacagtctatgtagcacagacccctaaaaagaacctctaggaaagatgtaaaattgtcttctgaaatttgcttcttttataaaggcagaaaggataaaaaggcctttctcataaaatgaagtgattggtccactactacagtctgaagagttctgtatcagatttcttcttaccctttattacttgtatggcttactgcttacctgcatcagcagtctgcagggttggccatagcaggtcccttacgagttcactgaaacacggaaaatatttatgatggtactattatgtgccagacacaactggatggattctgcttgaaaaggtaagtcagtaactgaggttcttgttgccacattaaaagaaaaaatctatccctactgccaacagcaataagaagagaagctagggtgaaagagttgtcaaagacttatgaaaaattcgaaactgtttaaaattctccctagcttcttttcttgcatgtccaagtaacagaaagcttaggcctgccacctgtcttaagcctggatcccatattaaaaaaataaaaaaaaacagaaaaatgagaaacagctaatgtgttcccaaggccttggttacaacagaaaatgagagccgagaagtctacattggcacacatcgagatttgaaaggtcagtcctgccctagtatggttcagagaccgtgaaaacccaccaagatgaaaatggaagctattctgacaacaagaggcagggaaaaagttcaaagacttttcctctgcttcttttataacgagatactttcaactatttttgacaatcaataaaatgcaaatctccctcacttttgtgttctaagttttttttttttaaatttaaacaacccatttgaaaattagggtactcagaataacttcttgtatacagaactacacatttaaaaagctttgtgcagattgttaatcatattaaaattacatcataaacaatgcactttacatggtgcaaatgttttatgtttttttcttttgacaatcaggcacctacatgcaaaactgcatattggaatccaaactcaactataatacatgtagaggaacccttagaaaaatgcatgtgggaatatgatatcccagttagagactagaatattctgaccaattttcattatttctctgtaataaatttatctgagctatagatcctgttaagaaaataaagctaaatggaaaagtattgataaaatacattaaatatatatatactagcttagtcattattcatattaagatcagaaaagatttccgcaagtcatcacaaatacagagatgggataataccaataatctcgatcacccagttgttaaaacagagaacctcacatttgggcaataatagttttgatttttatcttgtgcaccagatttttccatacaaaggaattctaaattgcaatagttaacacataagacagtgttaaacaaattcataactttagtaaaattaaatgaaccaatttcttatggctttaatatccagaagtaaagtatgatcttaaagaatgatgctgatctgagatacaaggagatcaagcgcttcaatagttcctcctcacacactaatgatcgcatccatcctctcttccacccacctcccaccttttctggttgtattaaaaacaatcaaaactaccaccactgctgctacccttcacacacctgaacttaatttcttctaagagatgcctaacagtgcctagggctgtgctatcactttatatccattttatgaccgcttgagaggcagaaactaaaaaggaagaccaaaacaaaacaaaaaatccctccaacctcccttatcagacaaatgcctggttcccagaggacaccagtcagttaagcaaaaccaaatattacaacagggatgaaggacttataaattgcatacaaatctcactgtgctcccacttaaggtggaaagggagttactccaatgaaagaaaagggggagggggttgtgggaaggagcgaagggctacagaaagagcgagagaaaaagagagagagaaagagagagatttattgtacatttgagacattaagaaggcagtacagtgaaaccaaaggtgttccagggagaaatgtgacagaaagctctaaatgagaattacagaaactattccttcttaaataaaactgttgtttagatgatgaattctataggaagtctgaattaactgtctctgttgtagcatctagatgttttctctttcattaagactttggagtttgaatgtactttgttaaaaaaaaaaaaaaagaagaagaaagagaaaaaaagaaaaaaaaaaaagcattagagctttatatagctcccaaagtaaaaagcaagagaaagatgggtttatataactggcttttttacataaatattacatcaggatacatttcaagtgaaaacacacaaacacacacacacccgtcttccttatactctttctattttaaaattcatttcatactttaaatgttgttggtttttcacaaaataagtaaaaacgaagtcaaaacatctcaaaataagttgccttatattacctggaaaattaacccatcatacaggtcacgatgtctcatttaaagccagttaaggtgctgacaattatgggacattttgctgcagcctagggcaactagaaagggccatggatgttaactaactcccttttaaacagtctgagaaaagggaaaaaaaactgtaagtttccccatctgttatttccttttttttttctttttggctgtggaaaagtaaaattatgcaagagcttttgaatgtaaaggctgtgtgtgctttttccctttttgtctctgtgtaccggttaagtgatgttgcgtaactgagtacagagtaggcggttagcgtttactattgatttacactatgccatctaatgaattcagaacactaaaaagaaaggagcaggagagggagggaggaaaaagagaaagggagaaatagggagaggaaaaaataggaatgaaggagaggaagaaagagcttattcagagaaacagttctaatgactggaataggttcatttttattcctatagctctgacttttggttattgttcagctctcacaaaaaaatggtcttgagctggtgaccccaatattccaatcctatttctaataaggattactggcaggtgaatgcctgaaagttctaatgtgtcaaattacttgaaaccaatttcactatactgtcagactcctccatatgcatctatttatgattctctctatgcatttgtgaatctgtatctgtgatcaccatggatttggtcctactggcttacccaatcaaaaatattatttgaaatatatcacgggaatgtcatcagggtaaagagaaatacattctattttacccatctcctttaaaaatacataaagaacacatttagaactttaaatatatcactattttactttgaaaacagacatgctacaaattgtttggctgaacaaaacagcccaatataggataataaaagagaaataggcaaaatgaggaagaacgctaaattgaggaacaatattcataaagaaatttaaataatttcttatgtctatggagagccttttacttttgtttgggtggaatgcctgtagcattctcagtctttgaatgctgctcagtgcttcccatgccatataatgaattcccaaagcgtggaccagaaagaaagggtgaagttgtttctgctgctaggtacaggtccttcctgtacctgagtgccctcctatggctgagaacaaccactaaggtgagaaagagaaagagaagttctctttagtaatcagctgaaaagctgggcagggaacttgatttctccctcaatgtgtgtttgcaaatgatgactgggaaaaatcacaggaggttatccaaaggaaagaacaagagttggggtttctagtcatccagttgtcttctcttttcagccatctgagcttagaaaatattaaacagatgcgtactctgtccacttgtcaaagatgctttaatgacccatggtggtatgcacacagttgtatacctagcacttgccatggtgcttggcacattttctatactcagcaaatatttattgaaactgaaaaatgatgatgggagaaatatctctgtagaaagaatgcactagaaaggcctgaaaaaatatattccgatgttttacaagaaatcttaggctatattgctctatcattaatctgcacacaaaataatactgtaagagaaatatcaggcagttatttaggggtcagttgacttcagttccattttattaggaaaaagcttaacaaaaattataatactgataacatcagcaaagttttgtgttcatttccaccagcccttttgggctgtctttcatttcagtcttgggcacagaaaagtctattttaatttccatggacacattctaaagaaaaagtcatgggatatcaacgtaattcatcttttaaaaaatactgagacaaatgtagccatttagtaatggaagagaatatggctttttgttgaagggcaaggcaggtggagttttgattaggttacacaaatttaaattactagaaggacaccaagaatgtactgatttccattttcttggttaaacagtttttttttggaaaaaaaaaattctggtttagaaagtcagaaatgccatctttcagttaattggagaataagacctttagaaaaagaattgcaactacaatttctcaaaaattccagcgaagattcaacttaaagcatgtttagcaatagtagccatattcttttaaaaaatggggctaccatcttgttaattctgtaggactgagcatgtagatattagtcaaaaccttcaaaaagttttttatttctctctcttggtcatctatttaatgtaatcggattcagcaacttccttcaataagcattctggcaatatgtcaacaagatcattcatttcatgattcttaaaagtggatgagaacttacctgttcttcttcattttatatatgaagattctgagactcagaattaattttctcaaaagcatatattttgaggcagagctgggactagtatctaaagctcacagttcatttttttcacagcacagactaaatcaaagttgtataaattcaatcttattttaaatgccataggggaagatttcaaaggattcttttataagacaaggaattcttacattatgtaaaatgttcacctcaaagctatcttatacttttttttatcttaaatgtgagcctactgttcaaattgttgcttctccttttccttgtcttaatttttgactctttagagtctttgcctcctgtcctctcacttgtactctgtgtctagttcatatatggcccttcctgacttcatattcttccttctctctctcttttcatctttttatcaaacttttatttattcttgttcctcacagaaataatttccttgttaatgtgatatcctcagaaactacaaaggaagaaaaagtgtaaatttagtattattataataaataggcctttggtttatatttaaaacaaaactgcaataagatattgacaaacagagtaaactacagctataggcttccctatagaaagttacagctgtctagacctccatattatcaatatgaaaacttgggggctagcatttcaaagtatctcatcaaagacagagagcaaaggctcatgatctccagaccactcattttccactacatcaggacacctttcgtttcccttttctttctttccattctacattattgatatttgagactgattacggcacagcaggaggagattcagagaaatctccttggcttaatgtggtcaaactctctcaattccaaaaaaagtcagaaagacctgcacactaaaattgtagttacacagaaaaagaactctgaggaggttaaaagagtcctctgacatgagaaagtagtctctggatagcagggacattgctgccaaaatcattgtaattaagattgggtcattgtttccattataaaccttatgcttatggggtttgtaattcagttaaaatgatcagctgtaggctgaaatgcagccccaagtatcttagagtgggaggtgtttctcccctcctatttcttaaaaaagaaaacacatagcaactatttaataatttcaatgagagttgtattctgacccttcccctacaaagggtagttaatcaatgagcttaatctagagtgagccaaggtgagcaacatccactgtggaatgaagcacattaacctggcatatgaatgggcaataaaaggatttcctattatttcataaggtttaatgtacatcactccattccactgtattgatgtgaataggctttcagcaacaccgtgttgaaaaatctcccacttctgtttgttaactcattattgtaggaaacattacaattataggagacaggaatttctgatggtttccttagatttctttcctcataagctcattcccagggtcagtattagataatcaataatttctaaaatttcttgctcctatttctttagcattgtctacaatatctgatacctatagtgtaatgctatgtgccaccatgatgtagagggattggggaggaaatcatagctatatattaaaattaacaggccagaggaaactggtatttactgagtacatactacatgacatatattccattaatattatttcatttaatacaaacctgcagtgaagtagctgtggcccatgttttatagattagcaacatagttaaagagctgttagctaacctgcgtaaggaaacagagctaatttaaaaagttgcgaagtgaggtttgaatcaagatctgtttgactcccaggcccatatgtactgcaatgcaatgcaacaccaggaacagaatatgaaaccatctaactgaaaaaaaaaagtctccatgccaatgatgagagctacctcatgctccaagtaggaggtagaaagggtaaatgactcctaaaaagagattcttgctttgctcttggctctgataaatccctgtttattcatatgcaaatatccaaatgcatatttggaaaatgttttgtcttagataagaaaatgcacaatctcctagaaacctttaaatgagaccagacatttgaatgtttacaaaaattcctttgaagatttatattaggagaaagttttaaaacataatgcataaaaaaaaatcagatgattggctaggcatggtgactatcgtcaccatgggagtcgctttgggaggctgaggtgggtgcatggcttgagcccaggagtttgagaccagcctagacaacatggtggaaccccatctctacaaaacacagtgaaaaaaaaattagcaggcatggtggcacgtgcctatagtcccagctactctggaggctgaggctgaggctgaggattgattgagcccaggagaccgaggctgcagtgagccatgatcgtgctactgcactccagtctgagcgagagaacgagaccctgtctcaaaccctccacccccaaaaatcagatgattaatacaacattaacatttcaatctggatgtgtgtgtttgtgtgtgtgtgtctatgtgcatataaacctataaatatacacatacacagatgaatttttttgtctttgtcaaaatttctggtaattattataaagtatttgacaaaagctaaacagtaaatatgttacaccaggagaaaaggaaacaaagaacaagaaaagaggagtatgtgtatgtacatacttccctcagaaatctaatcctaaaacattttttaagctaaatgggacatagtgctttagtctaaattgtgtgtgtgtgtgtgtgtgtgtgtatgtaaagataaaggacttttactatgttattttggcaagtgattatttttctaaaatctttgctgaatcgttttatgtagatatactataatactcttgaataaataaatacttgttcaagttaaccttagagctcatcaggtaaataacagaatttaaaaaagaatctgtagtctgaaacactgtagagtatgccaactttacacattacattaagtattcgttcaaaataatttataaattgaaaagtatactccattttattcaaacaatgcaattttttaaatgaatcttacacaaatttgtgtgtgtgtgtgtgtgttagagagagtgtgtgtgtgatcctcaagaccactgagtcattctttaaaaatattttaaaatcataatttggtgaagaacttaacaacaaagtaactgaagccagatttgagagaagaagaatgaacagttcttcaggaagcaccaattcattccttaacattcaataagtctttattgcttcgcccttccctcctttttttcctctagtctaaactctgatttggagcagaagttaggaggaacacgtattctggtccctcttctctcatccctgtaaggaaaagcaatggtagactaatgacagaaaaagcaattgcaacaactttggcagttttgtggtactgggaaaaagcaggctttgtatttgtacatttcaaggaatttcttcaaattttagcttctttgaatgttcctacaacaagctgaaggggagataagatctgctagggaaatagatgaggtttagagagggaaaatggagggactactttttttttattcaaatagcattcaaacacatgagcaagatataacttgcaacattaaaaagtaaattagctagctaaaaataactcacaatacccttctcactaaaacaaaataaaataaagcaaaaactcacaaccaattattttgactggtaaaaacagacagtgatatgaaagtaacagatggaagcccagttttactcacacaacacactcactaaagacaattgcaagtgtccccatgacaataacttaacaatggtcactttagcctgagatatctcctttaggtgagtttccttaaagacttcagaggggcttgtagaaaatactgtagaacgaaaccaactcatttgtctatatgtagaaataggcaagagttgcaaatcacagcctgtggacgaaagggatccaggtgtcacatttgccaaatctttttgcaagactggaatagatattcttttcttatttattttttgttgtatggcagtatttttaggagtggtgacatttctgtacttttaaaaacacaacactacacagcacctaaaaactttcctaaatcaaataattaacagtaataaatcttcctgctaatttctcctcaaagttgaaagaaaggttattttcttacctcacactgagccttctgatatgacagtgtcattcagtcaataatttcaatgtcagttactgatttctaactcttttattacaaagacttcaagcaataatgaaatggtgctgatctgcttgctttcactctatataacgtctatatttatatgcttatgcttctatttggatctatatttatctgctttatctgcctacagtgcatctgtttctcatacacacagacatatatttatatatatacacacatactgtatatatatatataggttatatataaacacacatacccacaaaaatgtatgaatgtatgctagtgagcttacttcaacaaccatgcaggtgcataaatattcaggcacatgacaaatatacaaagaacataaatgaacatgtaaacatagttacacaggaaaaagaatatcttaacaacagccctgtctgccatacttggctgttggcctttgagacttatacactgttgaatgatatgtcatagactactctgagaagcagaaaaatcttctgaaggcaaaagtatatgactaaatcaagataatgaattctaactctctcattttcgcaatgaggagtctgagatactaaggtgaacagcaaagattttacagctttctggaggcagagctggaagttttacccaagtctctgcctgctagacaaatgctctttctactactatgctgaattgaaaggatgaaaacaattttttcaaacccaatatcattattttctaattgccactctttcccatttttcccttttcttgctgtgtgaaatgtaaacaaacaacattcactcagggtcaggcactgttctaaatattctatatgtactataccatttaatctgtaaaatatctctatatagtaggtattattattcaaaatcttagtttagtgaattaaataactcactcaaagctacacagctagtaaggaaaagggctgagctcccataatactcaagacccatgtttttctcacttaactatgatgccttccctaatacatatttgtatataatactaacccttccctcaccaccacagcctgatagtcttagaaatctaatatttgatctgtttcagaacacataacaagtttaaaggttctctcagcctgaggaaaaaaaataaagggaagtagagcaggtataagttacatccctagtatgcagcacatgccctatactagagaactgaaatatgcaaaattcccccccaaaattactccaatgatagtgtgatgtgatttaaagccttaataacttccagtctatgaacattttatgtcttttgcaaaggattatggcaaactgataatatagaatcagattggaaataagaccacaagaaggcaaagggaaaatagcaaaaggaagaaagacccacacccacttcttcttcctctcttggcacaacacttccaaaaacaaacacccattaaaaacaacaaacccagtatcaaaatttggtatttttttccccactcaagtgttagagacaaattcagaaaagaaactaagtctacgtatggtaggtagttttatacaaatctcttcagatagtaaccagttgtgagccatccgaacacggaggaattttacactttggccagctaacccagaacccagcactgggagatgtcatgtggatttgtgaaactccctggggcatactgcatccataagccaaagaacagaaattatactgatccatacatgcagctcttcatctgtgccatattgataattactcttcatttgtgaattaaatcctagttataaaaacaactttcagacatttgtcacaaatggcacattttacttaactctttcataacaccatctagccacggtctataggaaatgggagctaccatactcccatataggtcatgatattataggaagaatatgatgtagagaaagagagagagagagagagacagacttgagtttgaatcccaggttttccatttattaacaataaagctgtaggcacatcacttaaatgattctgaaacctcattttcatcacctgtggaataaagaataaaaccacctattttgcaggaacgttgtgaagattagagacatcccagcacaaagaccccctcataaaagggggcattaaatattaattattgtatatttaagaagtctatttgtgtgtgactttctcttgtattaatgatacataaatctgctgggagtaacagaagatgtgaggtactttttatgcttttttaatcaaagacaaactttttggtgatcacatgtgttccatgtaaaagtggaaataaaagcatatcacagtgtaacattttcagtggacgattttaaagcacttaataacccttgactttttgtgattgctggcactctcatttaacagttgggcaaaatggggttcagagatacatcctccaaatcagtaataataataaagaaatcaccagcaggggttagtagaaagtctgtttttaacatctaaatcccacagtgtccagctaaggaataactgctgcaaggtcacagatacaaaaggccacactttccccaaagctctttgagattattcactgaggccaaaacattaggtaatgctgtgtacatctgctgagataacaagggtgagtcagggttaggtcacggtttcaggttagaggggtggggtgaagagtggctttcagatcaaatgacgagagtagtttaatttaagcaaagaacaaaccatacagtattttaagtaagaggggaaaaaaagggggtgcaactacagccaagagaaggtgggtgggaatatagaccctgtgggggtcaaatgggtaactgtggctcaaagaggaaacccacccacattcacacacactgaaaagcgaacaaaaagcccagggtgcagcataaatcctgctatcccaataacacacacagatgttccaccattgttttcttttatgcacattttaattaagagatcagaatcaagcattaaaatgttattaaatggcttgtttacatttttgctatatgtcatttataatgcattttctaaatgtgtgtatatctattcggaaggactatttggaatttttacatcagtgctacaattgtcccactaactcacagtcatttttgctaaccaaatatgtgtcagaaatccttttcagtttaagcaactggacaggagctctcactctttaattctcagtcaagcaattccctacccccaatcacacctcctttaagcatgacaaagtccaccacagtacttcaagacaataggaaggcccaggtacactggcaacctttctgatttttcacaagagtcccagtttcaaatattctcccattgtgctcacaagaaaatagtcttcatatacatgcccgaccctttccctagaacagttttgaaaatgtcgggaactcaaagctaccacatgaaggaccctgacctatgagtgtcccctggaggggacacagtggaagaagcgggaactagtagatttttttttcctccccacaatccatcttctatttgcagtctacaacttatccctatttgcctgggcaggaatttgagttctctatattattctggagttaaaacaggtatgcctttcccgtctctcagattccacagatatcatgactgatgcacacaatccacctgcatatgtggatcacaagtatcctgtagtctgctggcaccatataacttaattacttttaaccacagggcattgtcctagaagcccactatttatattgtaccttatcaatcatggtacttggaattgcaaagtctcagaaagcaggaatcatatctcctccacgttcagttcaatgcctaatgcattgtgagtgttcagttaggacaagcaagagaggtaaggttttttctttctttttgttatttgtttgttatccaggataagcagaatgcttgtacagaacatgcataagaaagaaacgcaatctaatctcactgtcaatttatattctgtaaactgtctcatttgcagcataaatgactacaaaaatgttttggttactctaagtgttaaccttaaggtaagagttaaattaagtctgctataactggtggaccagaaaggactcagagaaaagcaacagcatggctttgaatcaaatcacttttggaagaaaactttaagatgttaccaccgaaaaaataaaactggcaaaatgctctggagggcatcttagcaatatgcatcaaaaatttaaaaaatatatgaagactgttgacccagaaatctcacctctaggaatgtatctaaaggaattactcaaagatctacacaaagatttagaagcaagaatgtttaccatggcattatttataattgtgaaagactggtaaccttgtctgacaatagagagttgattaaataaatgacagtacattcctagacttaaatactatgcagtttaagaaatcatattttagataccacttaattacatgaagaaatgtttttggaatactgttaagtgaaaaggcatataaccaacaatatatgtacaggaaaatatattgtttaagtaaatattgctaagttaaatattgttaacttaaatattgtttaagaagtgatagttgtgtacacacaaagtgcaaaaagaccagaaaacactagaagtgcttgtttctgggtagagaaattataaataatttttgtttatttgaacttttccataataaaagcacatttatttcatagtaaaatattacttaaaatattcatctataccaaccttccttctctaaaggcctaaaagtgaccctctgtaggcactcttttgtctctagaagtcttccttctcctgtttttatagatgtatgtgttgcattctaaaatcttaagtatttgggactatgtagttataaaagataccctaccaattaaacaaataaaaaatcttattaaatctgtggttttaatcttaggttcctgcttagaaaaaataccaatttctctttaagtcctatattttgctttcaattcagcctccatagtattaattagttatattatttaggcctgcagcagaacagtttcatagttcttctcattctcacagttctttgtaagagacaccacccctctcatggttcttactcacccctacacccacaattgaccataggtaattgtgcaagagaccacaaatagaaagaaaatgaaggaagccttaaaaggccaaggtagttccaagttataaaacagagaaaggctgaaaatttaggcagagatgtggagaaaatccgagccatgacacttaagaatgaactggagtaaagatccatgagcacctggtgcagggagagacaactctacctatcaatccagtacatgctactcacacaggactattaattctagtaaataaccacagctttaggaggggcaaatgttctggaataggctgcctgttgaaaatacaagtgctagggcctttccataacctataatcaggacttccagaagtaatatccaggcatcttcattgaaagctccaaatgtgattctgaattatactagaggtgagaaccaatgggctactggggaagttcaaatcccttagctctagccaacttttataaattcatctcccttaacttcacaaacatatacactctgctgatgctagaccggtgtccttgttctccatccttgctccgtcataaagagaaagctagtttatgtctttgtacaatctacttatgactttatatcttgaatgccctgactgctccttactacctgtttaaatcttcactaattccaacaatgggttagagtttcaccttcctatgaattcacattgatttttcctacacattaaactacagaatctgtgtcttcccctatttctactcttacatcaatatgaaacaataatttgtttgtcttacaactcaatatgatcataaaccatatgtgcccttagaaagtgttcacatggttttgttggtacctctttgcaatgtatatcagggaattttaaaaaatagcagactgaattgagaccagtacttgcatgttcatcatcatataatatgggacatgtatatttacctccaaacattctcagagttcattcttcgtaccctgtaggcttatgctgtaaagaaaatacatatgcagaaataaaaacagagtttgaatctccagtcctaatccttcctctgaactcctgtctcatgtatccaactgcctactacatctctttatttggaaaagaatttcaaattcaacattctccaatactaactcataatcatctctttcccaaatctgctcatttctccatatcccctatagctcccaactccatgggatattgccatttatccagtggctggggtgaaatgcctgaaattcatcacacctgatgtctctctcatgtaaaaccacattgagaccctcagcaacttttgtcagccctaccttcaagttatgcagagttgaaccacttttcatcccctccccactgccattgccctttgcataactgggctactatgataactactacatgctcttcctgtatcaccctgaccctgtagactgttctccacagtgtagccctggaactcttttaatatgtaaatgagatcatacatgcttaaaaaaatcctctatagctttctgtcagtctttatcatggcctgtgtgagctggtccctacttatctacatgatcattcttactttggtccacttgagccacacatttcttcttgctcttcctggaaaatttcaagttgttcctactccaaagtctttacaatatccatcccctttccctaaaatgttcttcctgctggtcaccacatgcttaggttcttctaataatttaaatatttgctcaaatatcttccactcggtgagacctttcctacttaccctatttcaaatagcactttctaaattatatatccctattttctacctccttattatgcattattttcttcctagatctgatcattatttaaaatgatttttttttgtttacataattattggctgtctctccttccactataaaataagtttcataggaaactttgtttaatttctcactatattcccagtaattagaacaatgtctgaaacattataggtacttgatagctattaaatgactgaatgaataagtagatgaataaagtgttccagtacttataaatctcatcccagtcacataaactttaaataggaaatctttattctgcatggtgcagcggcttctctggattgtcccagaggcctctattctttccatctgactgcacaggccagtctgggaaaccacctacatgcaatagctcacatgtcttataataaacttcttgggaggagtaagtcaaattagatagttaactaaaaatagtatctctgagtttataaaggagacgttttcccagcccaactggtcctggtaagttagactggcatcaaatgctgacatggcaatcttatgcttgatgaaccctcaatctggagaggagtgagctatacttttatactatttattttgtgaaagttccaagtatagttcatctttgtatccacaatgtcaagaacattgctgagcagagagtagagcttcaataaatgtttattaaacagatgaacaaactaatccatgaagcaaacaacattctaagtgctattcttctatgtctaagctttgacgatgcgctatataaaattcattcttgcaattttccttcatagattagactgaaaaactcatcgtgaaggaccatgtcttatccatcttgtatcccaagttcttagtacagtgctggatgtaaaaggaagaaaaactccaaagcaaaggatagagaagttagaagtcctggcagcgatcagtgagtattaaagaatgccagtatgacgtgattatcagatgttaggtgatgaaaatcatgccagctaacatatggatttctaccctgtttctgtataagacttgagctctaaatttagttcctgaacacaggggatcagagttgaaggtgattatttactatgaaactgctattttccacagtatacatgatcaaagtgctagaaacttaatgcatgaaaatctacacttctttactcaacctctcttacagttatataaaattctttagaaaattaatgttataaaaaagagttcaggccgggcgcggtggctcacacctgtaatcccagcactttgggaggctgaggcgggctgatcacctgaggtcgggagtttgagaccagtctgaccaacacagagaaacctcatctctactaaaaattaaaaaaaattagccgggtgtggtggcgcatgcctgtaatcccagctactcgggaagctgaggcaggagaatcccttgaacccgggaggcggaggttgtggtgagccgagatcgtgccattgcactccagcctgagcaacaagagtgaaactccatctcgaaaaaaaaaaaaaaaaagagttcagtttgttcactaaagggctcaatttgttcactacataaaaggatatagcagtttgttcacgaaatcaaagccttttcaaatataataagcaatagaagaggtgacaaaatatataatgtaactattaaatcagtatgccttacaagtatccatcatggttatagtactaattgccttggtttgtccaagactgaggagggatgtgagcttttccgtgttcaaacagagaaagctccaggctagtcaggacaagttggtcaccctaataatggtataacctgctaagctggttatcagctattccgatgtatctatatgtaggatctataggtacatgtagaatatatgatagataactaggcattactaggttataagatgattaagaattaatcagtctgtactagtataccatatgaagtgcaaatcccttgtttcattttctcttcatttcccctcgatgttggacttcttatgtttttatatcgtatgcttatattgattttattatagtcaaatacattaatttggggtgttaggacaatttcattttcttcagaagaaaaggaaaagtgagtagcagcaatgcagatgggtctcaattgacgcatgagctcatctgttttttacaactccaagtgtggtaattccccgtagaattaaaatttcctaacacagaaattaaaattttcctagctgaaaatgccggctttttacatatcccaaaactgaacacataaagattaaactccaaaagtaaggcaagatctacagaactatcccagccctaattctgccgagatatttattataagacaaactgagacagtcccctgtggtctccttaaggtcctgatggccccctcaaagcatcatctggctttaagagaactccaaaatagtaattggtctttgggcacagaatagccattggaatctggattagagtctgaaaaacactgcattttccaaagagattacaatgccaggctttgaacattgaagggtaatatcttctttctaagtatctctggtcagtctcagtaactagacctacttttgaggctccatttcttttatgtcttttaaatttaatgataaaaaagaaatatctaaatttataatatacacgaaacagtgaaattaggagaaaaaattctatttgatgtgtccatttttttaagctcccatgactaaaaagatcaacagttacctacatttgtaatatttatgcctcccaggctcagtgtaatgagtttcatctctgatcgaatttttataactgactttcacttacctgtgaaataggtaataggaagccttggtaggtgctttccctaaagaatcagatgcaaaagttagacctactgcaaacaatacagaggaaaaaaatgtcactctaatatactactactatatccgtctgctttttgcaggaaaggaaagctatcatcctagacagaaatactgaaataagtgaagtacagacaagtgattaatcaaaatctgaaaatcatagtcttcagctttttcttccatgaaaccatggtgtgtcctcttaactttggccaagtgcccagctaagagaattcttccatgagatgaacatgcttcagggcaaaaccttattctaactgatggttttaaaagcccaactctacattctgctcaaggctttggttacgtaggtaagccaaaacacaggagacatgacttcctccattaaactggctgaagcccaggttacactaattgagcctaaatagaaaacctctgcttttcaatccctttgttctcttggatgtcacagcttcctgctctattcgcttccttttatagtcttctctcaccaagcatttcaggaaaaaaaaaaaaaagctaaataaagatcacagcctgttccattgtgtccccttcttcttcatcatcttcttttccatgtgtgcaatgttgtggcacctattaactaccaatgttttcagaatgacattatacaaggtgcaggctgtaccactgtgccctaaaaatatcaacaactgcattagtctcacaataattaatggcaggcattatgcaaatgacaactttttcgctgcaaaataatgacatttcttcattttgagcagagttatgcaaaacaatgaatttaggatgataaatcacacaggagaattaagaaagccataacgttcctgcccaggcaggcagaaagatagacagaccaacaatttagaagacattgttttgttctcacaccactataaaaaatcatagccagtcggccattaatgtgtgtaggtttttttccttctcccctttaggcaacaatgcataaggggatgctaaattctagcaattggatcattacaagtcacaagcaaatttttctttattaaccttaataagtcattcactcagagactatagtcatcaagcaaataaaaagtatcacatgccattctgctacacattaactaattccttatgcaaacatcacaacatatagcaattactgccgctcaaaaaaacaaagtcattttcaatttattttattgcttttatacttggccatttcctgtagcacattatcgtttctttccctaacaacccgaggtggaatgaagaagaatttcggtagcaatgagccccttcctctagccacctttgtcatacctttttcccctccgggaggcttttaaggaaggttagggataaggtatgtgcacgctccttcacaggaaatgtgcatcaagctcagagaaatggtacattcagctcctattcttgcagcaaagagagtgtggggtaggcagtaagacccaagtctgtctcccacatttgctacaataacactgacagctttcctttattcagtaaaacaaggtaaaagtgtaggcttagacctgtccccaacaggtgaacgttaaagtcaatatatgcaacgttgacctgagagatatagtaatggttaatgagaattatgaggttacttcgtcttgcttcactcagcacataacttgtcccttccagaatgctgaatgaagagcaataataaatactggacactaccccacaacatgcacagtattaaataagatctttgtgtgtgtgtgtttttaattctataacatcctttatccaagactcccaggatgtgaaacaaatgctaaacaaagcttacacattgctaacagattcttttagcccattttacagactgacaaatggattctgagcaactagaggctttacacaaagttggactggaacaggtcagactatctttccaatgttctaacctctgaggcccgtggcctcttataatcatgagcattctttcctgctgataaacaattatgctgtaaacagcctgtacatgtcccttttcacacaacaggatgataatctctctccgttctcctaaatccacaatccattcccccctttttaaggtagaacatttccgaaatacacacgggaaaagctctgttttcagtttctcctcctgaaggtaataacattttgcagttctccttaaataaaatccagcccatgctggatcaataagaatgatgcccatttccctaatggcagccgattgccatttgctattcaaatcagactagataaattacagtacatgccagggaacaggccagtgaattaagacaggcctccagaggaccagcgatattattaatcttttaagacactatcatatttcttcttgacagtgtgcgtagactcacagacacactgcacccagattgaaatatcagctgctgaaaaaaatcaatagtgttagaaacacaataatttttggtctgcagggtctacactaagcaacacttgtacccctcctgtgccatctcttctcccacttcccctttgccatatttgcctcctacctttttgctcttcccttttcattctctggttttaaaagcttgtaagtccaaatgacaagatattatgagaaggtttccactgctaacactggccattgtggttacagcgttgatttttcatgggttgtttgaaatgcaattttactagtctggcaaaatgttttggcgtgggattgtttttcctatgaacttaatatagattttcaacccttatgcacttggttctgtattatgaagaaatgaaaatatttataggggtggccatacctgaaagttctgaggaaagtggaatgcacagaagggaaaataatggaaacctggcccagaaatgaaaaaaagtggggggtattcattgaagatccaggagaataaacaaaacaaaacaaaacaaaacaaaaggctacaggggaggtgtatgtagagcagaacatggtaggaagaatattctacttagattctgaaaacttgaagttgacctctgcctctgctgcctgcacactgtgtggttttgccagttacttacccttgcagagccttggtttccttttccattaaaacaaaacaatctaaccacctacctcatagcattcttgtgagggctaactaacaagatgtgtgtgttttctaaataataaaattgtgaatgatataaactaatttctactagagagaggtttatgaaatgtgtctgcttttttcctttttcatagatacagaataccataaaggaactttagacgttatcaataaataagcaaactgatagccacagaaaggttattgaggttcacattaccagtagctagtagaactttaagtagaccaagatctgttgaatctgagccagtcccttttacattttaccagatggattttaccttttccatgtctctttctactagagatttgaggctttgattcttgtccatgttgcttttccactggggaggcagataaacaaaatgccacataagaaaacaaaaacagaaacaaaacctaccatgtttgtgtatatttatatgctattcttttgatcccaagactccctccagttcaccccccattttgattcttcctttcataacaaaatgtattagaaaaattgtccgtattagttattaccgtatcttcactttctattcttttcttaatctattccaatcaggcttttatccgttccactctaccatatctactgttgccaaatgcaatggtcacattttaattttcatctgactcaacttcttgcaacaatttaacacggataaccgcttcttttcctcctcgaaactgtaatatcttttgggatacccctcttttcaactttctctactatcttacagggcacttaagcctatttaagcctcatcaaatttgaaatctgttactagcaattcattcttatttctgaattgggataaacacagtatatttggaaaaacagtggactgtcagatgttttgatggtctgattttatgactttgatatacaaaaaagagtagaaaatcttattcttggtttggcttgaagcttttttattccacatacctcatggcaaaatttatgaactacttttgaaaattcataagtgatcatttacctagatccacttaattgctccacccagtttcttcaaacacttgttctttgaggtctacatggcaagaagtaaatacgaaaaccatttccaagtgaactaaagtaacctgaatatgttttctgtgttaggttgttccccctacccacagcaaaagcatgaagacttcctttaagaatacaagatatattctaagtctaccagtactccatcttctgatgtcagatggagttaaagttcactttcatctcaagagaaaaaacagtcattcctgacttacaaacatgagtggagggaagtacctgaacacagggattgctttcctcacatctggctctaagatacaaccacgcgctgtgacatataaaaaggtcactgacacgagaaaatatcgcaagatattacaaggataatcaaagccaaaatatatccaaacccacttttggagagaatcccaataacttcttttgaatgtgataataaaaataacatgaataaagatcattttcttaagaaaaaaaaggaacgtttctatcacttgcctgccacttgccacttaggagtagactctggctcccttttccgcttaaattcttccacagagtcagcttgccagactcttaaccaaggtttttcttttatctagactataacaaatactccattttgggtcatgagaacatagtagcaaaattcccagagttaatactttaattatacacatatgtatttattattttgtatgtgtgtgagctgttccactaagttaaactttaaccatattaatccaggaaaaaaatccctgattatcaactaacaattttgtaaacagttatctcacaggttaaatattaactcgaaaaatttaactcaaaactccacacaagcagaaggagccaaaaggccaggaagaagaagtaaagattagctgctttaggaggaacacagccaggaaagtgagcattttggtagctggataatgtgtaggaagtccagggggttgtgcaggggggggaaatagaagcaagaagggagcctggaggacacctgctgcttatcataatatcaaaacataaaacaatgaggtgagaccttaaggaaaagaaaattcatggagatatgaatccattgataatggccacaggaattcaggtgcaataaaggtttgaacctcaatgatatggacatagctaaaagatccaacacaaagctagctggagcggactgcctgcctgccactgaatatcatgaggaacattctggggtccctcttccactagaaataatgggatgaaggctgctctgcctgtcctgtttctgtttcctaacaataaaacaaaactgaagtgtctccctccagtattgggttattaggggcaccgattgcaagttctaagcctttatctaactgtccatcaattctctccctgattaacagaaccatatcacgtaagaaaaagttggaaccagcagtagactaagtcagaaggcttttctgtaccggaattgctgaactacaaatattgttctctggttaggattttgactaaaaaatgtcaagaaaatccacatggccagagaattcgcacaatcttgatatctgaggtacagggtaaagctgatgtattttaatgctgttttaggaaggttagaaactgttaagattcttcctgtcagtatgtcaaatatcagatcagtcctgcttgctgatttttaaggaagtcattaaaaaaatcctcccagtgagtagctttcaaggaagactcccatttgcccggcagatctaaagaaataatgaggccaaataatgcaagtttctcaagagaggtgtaggattgaatgaaaaaagggaagatatagaaatgtaggagaaataattcttacatatataatatatataatgtatatatgtatatattgtgtataatatgtatatattgtttatattcaagaaatatgatatagcttatcatatattacttttgatatttttcttatacatctagtacatgaatacatgcttattggaaaagtacaagtacaaggtgtagtctctattatctaaatatattatttaaatatatatctaaatatattatctaaatatagatgacacctcgtacttgtaaagctttttgcagtttataaaatatttttgcataaaatatcttttgctttcctgacaaccacaaaaagtaaaaagggtgggttctataatttctgttctatagacatgcaagtattactctaccattgacgtaactggtgcagaataaacctgaacagaggaaatagaatccattagtagcctggttatccatatccacatgccaagtaagaaagcagcatgatgactgtggaaatgtaaaggcattataagagtgatttttggagaggattaaggagggagacatcaaaataattcaaaaggaagtttagaaaatcagtagaaataaagggctaaatttggagtaacttttttggaaaaaaagtgtttagaacaaggaaagaaacttccaattcagaccatgtattcatttggcatatactaattgtatatctatgtttgattttctttgatagatgctattgggtaaataatgatgtgtatggagacactgacctgtgcctgacatatttaatatctatttgttgggataatgcccagaaggaattattatgcaataaaattcagatattcagaataggggtttagagagaaaatcatcactgatatgtaggctgacaaaggaaagcttcagtatgatgaacaaatctagttatactttgaaaaacatgtaagatttgggaggtgataagacatttcaagttgtgtgaagggcatgagagaaagcatggaagcagaaaattgagatatgtatttgggagcagcaaataaacaagttagttggaattgtaataggaaacaatgctggaaagatgggttgagtgtggaatgcgaaacggggtccttgaataatgggctgagtagtccactttattctgtgaacacaagaggtctattaaaggcttgtaaagtaggacactggcatggtcacagtgatattctagtataaataattgggaatggtggacagaaaaaactgaaacagggagagcataaaggtaatgagagagaaagagagagagtgcgagcttgtgagagcaagagaatgagaagtgatccactgcaacaacccaggtactatgtgataaatatctgacttcggtagtgtcagcagaaatgtacaggaaataacatgttctagagacattgtggaggaaaaaataacaatatttactaaagttctactctgtgccaggcaccgaactatgtgctttatgtagattaacccattaatctccatgctaaccctaagaggtaagtaactttattgtttccattttacagataaggattaagcaactttttcaaggttatgcagttagtaagtggtgaagcctggattcaaacccaggcaatctgactccagagcctgttctcctaacccccacacttactgtttttcctaggtacaagggatcttttggtggattatatatgacaagatttgatataatttgatgactgactacatatgagcaataaattcgtgggattcttgggattctcaattctgagatttttgggttatattatgaataaaaagaaggaaataaagaagatcttcttgacttcacattgtacatttgttcctaatggtccaattgctttttggacttaaagtatcaatttacaataaaagccacagaagcaactgaaccaccaaaccggaaagctctttgaaaatgattcttctttctagtttcactaatgtatatctggagtatagcacagttcttcgcatataggggatgcccaacaataacatgatgaatgagtcaactggagaagtattaattgtaataagtgagaataagggagtggagggtgtaaaagtcaaaagagtatgacccagagtcagacaaatattggttcatatcctggctcagggccctttctaactacatgacatacagaaagttactttaaacattttgtgtaatatggggtaataattcataggaaagctagctaccttactggattcagtggttttatataaaggcaatgggtgtatgcaaacctagtaaggaatgctcccaaaggctgttacctctgacagaagaaaatctgcaacccctttctctttgtttaacttacaaaaccacatgaagacctaagaaaaaaaatctgccaaataaattccagttacaaaaggaaaataaattattttgaaagtaaaaactataatttcaactgaagaagagattttaattgcagggagatagatcagttgaatggtttaacttggacttgagaaatcagtagcagccagtgggatacatattaaagaaaaaaacaagtttaattacccttaagattttatacagcttggctcttccctcccacacctagtctgcttccatcaggtcagactccttttcaatcacactctcttccatccttttctcagttgctgtcatgacaagccaatgagagaatgacataccgatgaaaacaaggtttgagtaattactgcactgtggctggttgttgtctgggcatcattttatttcttccaatcaaacaggtccttggacttcacagctctgtttcaggtgggggtgatgctgattatattatgacattatagcaaagacaggcagatcagatgaagtgaatttcactcagtaattaaactgcagtttctttcgtctaaagtccagggcaggattaatcgaaacgtagctctttatcattcctattaatgctgggatttgaagagtgagctctgatttgatagctagccctgaatctggctgactggtgtccccaaatctgtctaacttgcaaaaataatatcagatcaagatacatttgcaaggttatacccttcccttttattttacttttttttttgataaggaaatgcaaatagattcaaatatgctgccatttccactaccttgttttctattacaaaaatgtctgtgaaaaaaatcaggtccttccaaaccccacagcattttacaaatggttttccataattccacttaacaccatgctctaatggcttctaattttgtgacttttcattatctgagactcaatatgaatatttggatggcccaagcgacagcttttcagaggctcaaaggttctacttttattttaaaggactcattctgggacttatatagagattttgtttcattcaatcactcttgtaatgcatatgatatcaccaaattctttaacaagtatgagttggatcactgattctcaatcctgggtgtccatagaaggacctgtgaagctctgtaaaaaatcagcctccagcctccactccaggccacactcacagatcggaatctctaggttttagacacaagattttatatattcttgaactccataagtgatttgaatgtgcagctagagttgaggaccagagtcagccacacagtgtattagctgtatttgcaaaatatttattaaaacaagccattgttcagagaaattagcctcacattattgtgagagatctctcaataaaataataaaaagcttattccagtagcctttgcatagaaaaagatatacttgggtttctttccttcttttcttttttttttcttagacggagtctcactcttttgcccaggcaggactgcagtggcgctatcttggctcactacaagctccgcctcccgggttcacgccattctccttcctcagcctcccgagtagctgggactacaggcgcccaccaccgagcccggctaatttttttttttgtatttttagtagagacggggtttcaccgtgttagccaggatggtctcgatctcctgacctcatgatccgcccacctcggcctcccaaagtgctgggattacaggtgtgagccaccgctcggcctcccaaagatatacttgggtttcttaagggaagtagaggaaaaggaagactgtaaaaacagacaggtaactgttgatggggcttccattgttctctctgataacattgaaggtgatggtttactgattgagctcatcacatggtaacactatagctaccaaccatataatttaagatgacagttgactaacatcatagaatctcagagtttggacataaacttggaattagctgtcatctattttaaccccttctctattcagctgcctttttagaaagagaggcagaatttagaagactttatttcaaattctgttttcagttctgtttcagagtttaagaatacacgttctagggtcaaactgaattcaactactagttgggtggcctagatatttacttctctaagccttaattatcccttctttaaaatgcggcccagaatatgtatctcaaagagctatttaggttttatattaattaatttagataattaactagaatgcctggcacacaaaagtatcagaactcaataaattaagtctattgaaggaaattgcaatagtcacttttaaggttgtcactgagactctatgcttaacaactatcagtttggtgactcacagatcagttttctggaagatttgatttgccaaagaaaaagagagtgagtccaaataggaatggctttcacatttaattgagccataaaataaaatacattttattaaataaattttataaaatacaattttattttaatgatcacctggaaatgatcattaaaaatgcaaatttctgggctccaatcccagagattctgattcagtttgtaggagtggagtctaggaaccatccaggtgattctgactcagggtcaagggtcttcactttaataaagacagttataaaggaatataaattagccaagcatttatcccccaaataactacagtgtggcttgacctggaagagaccatgctttctattccttaagtcagaattcagttagatgagtttaaaccatgtgcaaatacaaaatgtttatagagtatatttatgcacacagagttaaaaaatctatttctcttcaattaaatatgccttctcaacaattatcatttagccactaacattatcttcatctcttttcatcactactgggtacatgtaagtatacagacaagggtcagatttgctatcgactcatccattttcttcttacaaaataataaacaggtttcataaaattggtaaattccttgaataaacaaaagcagctatttcctcctctaaatgcattgtagaataaagtattttcaaaacgcattaatcgaaattgataatgaaagtcaatatataattgtgagttgaatattttaaatgcaattgattacttcgctaaaatgaatatactcaacttacacatggagactgttctggatctaaggagaaatttaaacattttcattcccaatcagcgaaatcccagaaatgtgtttagagtttctaatacaatataccaacaaatgtgcattaactctctatattctaaaagttattgtgtaacaaataacaggagaattatggtctctaattgcagttgaacataaaattgagctggggagaaaataaggcatcaacatgagaaaagtttttcagcattatacaacaatataggctagtggccaagtgtaaggctgaaggagaatctttttagtacatactgtgtgaggcagggtaagctaccgaagatctgcaaaagtcaggcacagtaactcactgagggggttgtggtgaccacagtgggtactgaataaatgtaacctattatttattataatagttgacagtttattttagtaacacaagatatatcacagataagactatgtaaccggtaaaaggtgaatggtacaggcactgagagttacagggagccaaaactgagagaatgctggcatgactggtaagggttttgtgaggaagagacatttgaatggataatgcaggagagagaggatttggctagacagaggaacaaagatcattttagacagggtggggtgttttgatatgaatcgcaggtcaaagttaaaaagtgtttaacgactgttaaaaaaaacagtttaggatgaagccataaagataaatttgaagtagaacaacagagggttctggattccaaaaatcacttgtagtttctggtagaatttttaattgtcaaaatattttctcagtggaattcaatatctctttagatcagtggttctcaaattttagtatgcatcagaattacctgaagtgcttgttcaaatacaaattgctgtgttccacctcaaagtttcttattcagtaggggaaagtgaggcctaagaatctgcatttctaacatattcctaggtaatgctaatgctgctggtcacttggagaaccactgctttagaagacagtgagataggccgggcgcggtggctcatgcctgtaatcccagcactttgggaggccaaggtgggcggatcacgaggtcaggaaatcatgatcatcctggctaacatggtgaaaccccgtctctactaaaaatacaaaaatttagccaggcatggtggcaggcacctgtagtccccgctgctcaggaggctgaggcaggataattgcttgaacctgggaggcagaggttatagtgagccgagattgtgccactgcactccagcctgggcaagagagagagactccatcacaaaaaaaaaaaaaaaaaaaaaaaaaaaagtcagtgagataagagaagagttggatgaagagtttcatggataagaaagagttggacgactatttcctaaagtcaccatataatggaatagccctctttatttcctataaaatttcaccctccctttcataccaacacatagagaaacctacatgaagattacctagggatcaaaattcttctttggctttctaatccctctattgggttcaggtccttaactgtgggaatgaagaggcccatgatcaaaaggagcccaggcccaccaacctggaaacttgaagacaacttaatcactattaaggatattcaagaattcaaaataacagacccaagagactaaagaaagaaggtggaatttttattccaaaaagcctctgtcagtttcatgttgaacattttgtacttgggctgcacttaactgcctgccccttaatccacaaactaatatcatctcaccttggttcacctttttcttttcttcaaaaggcagtcagaagcaagcaggggcaatgagaactttctacctaggcatgggccactgtttaagcatctccaccttctgcttcaaaatctttctccaaaacaaacttccactatgtggtaactatactgtaagaaatcatttaaaaggcagaaagaggaaatgaaatgctctgagagactattttctcatgcataacttcgagggcagtatctcacaagtcagtactttatttttgatggcagacaaaaaacatgttgtgtttgaagattcatgtagaaatctttgtgaaaaaaggtcaaaattggatttaaaatgttcaaaactccaaaaatctctaaagaacaggagcttgtttattttctagcaatttatctttccttaaaataagaagctatataattacaaagtataattaataataataacaataattaccacaaatacaacagaaataatgatagtaagcaccatgggcccagatccccatagttacaaaggataagaatttgtctcagtatatttgagaacagacagcagcccaataatacaggaaaaaaaaattggaaaggaaataatctttcttgtgctccctggaaaataccacagaaaaatagacaatcaaatttaatacctgttgttaaatatcttcattgtacagattaggtcaggcaatttaaatagacaacaacatgaggcctctaatgtctcttaggaaacagtttcaatgtaaattcctaggaggtcccaattcaatttctagttaagcatccccatccactcgtaacactcataagaaggagaaatgcatttgtatggtgttttacagtttataaattattctcacaaacgtgttatttgattgtctcaaaaatcctgtggggtaggtaagtagagaaagtattaatagtatacccattagaaggtgaaagaattaaggatcagagaaaaaggacataaattaatctttattaaatatccacattgggtcaaactgtgcagacctggaaagaagtccaaataaagttttacataacatggataggcttggagaatttgttaactgcccaaagtaaaaaaatggaagagctagaacttgaatgcagataatgcagctcaagatgtaatggtctttccatcagaccatagactaaactctcagttgtaaccatcgtctagttacagtaactgcccctctcaagaggaggctatttcattgccaagaaataaaaccgtgaatagtggtcaggttttctgtttttagttagactgaaagaaagcacatactccttgagaagacgtgcatctttttaacatgacttagtctgtcaagagaataagagagagaatgtgttatttcattcatgtagaatactgacttttaaaagtcactcaatttctctaatgatcagtgatgttgagctttttctcttaggtttgttggctgcatgtatgtcttcttttgagaagtgtcttttcatgtcctcaggggagggcagtgtgggggcagagagaatcaagaaaaatagataatgcatgcggagcttaatacctaggtgacaggttgataggtgcagcaaaccaccatggcacatgtttacctctgtaacaaacctgcacatcctgcacatgtgcccaagaacttaaaattaaaaaaataaaaaataaaaaaactgactccagctacccatggacacaagagacaacacggtcccatttgtcaccaaaatagacaacacagtcccatttttcactaacatactctttgcaagaaagataaactaaaagactatccaacattaatagctagattctggcatagtctcagcttaaactattagtttctaaataagaggcaatacatatgcatagtaaaatagagaataacagcaatggatgtattaacaaaatgcattttccattaattgttatgaattaaaaagtctcgaagctatagatcgagactttgaaacttctggaacaaattaacctatctctttttatttttactttatgcatgcatttacttgtgtagttggtgttgctatgttttcttaaatttgtttttaagataattatattctccctctacttttatacatatatcttctgaggcatttaaaggtttgacaaagcagtgtcttctcacaagagacagaggtttcacttagaagccatcttgggaatttgggctgcagaaatcaagggaggtctagtacgtaagtaaatattagtgcaataatattaaatttttgaatactaaaggaaaacatttattgaaagaaaattgctttatatccttaacaactaccttgctatcgaggatttttagagaattgcagaatttcagagttgatgctatatgtaggattttcttttcttttaattttttttttagagacagggtttcactctgtcacccaagctggagtgcggtggcatgaccatagctcactacagcctcaaactcctgggctcaaacaatcctcccatcttagcctcatgagtagctgggatcacacatccggctaattttttttttttttttttttttgtatagacagggttttgcttgggggcccaagcttgtctcaaactcctgtcttcaagtgatcctccctccttggcctcccaaggtgctgggattacaggtgtgagctactgtgtctggccccaaagattttatttttataatgacagaatatcagtgttagcagagtccattaaaattatatatgacaatcatctgtttaacccatttatgccaaatgttgcaattttgtgtgtgtgtgtgtgtgtatgtgtgaaaaatcagaacttggtgatgaccttgagcaacaggatatacataactgccacaagcttagcattccaatagtggaacactaggcataaatgggttatggcttcagtatcctgcaaaatatccctgtaaggtagctgtctatgcttaaacaccttggtcttaggaaactaggatttgtggatattaggcaatgttatgggctgattgtgtcccctaaaatacatagggtgaagccctaagctcctaccaactgtatttggagataaggcctttgaagaagtaattaaggtttaatgaggtcataaggttggcactctaatccactaggactggcgtccttataaggacaggaagagacatcagaggttctcttgagctcacaaagaaaaggctgtgtaaggacacagcagcagaaggctatctgcagccaaagacagaggcctcaggaaaaaccaaacctgatgacacctcagtattggacttctagcctccagagttgtgagaaaccaatttctgtttgctagtccacccaccttgtggtattttgttatggtaggcctacagactgatatggtgcctgtatcagtgcctatatggtgcctatctcatcacaacctgtaaggaaggaattacttaaagccaatttataggtatagaaacagactatggaacattcaagaaatgtcccaagagacaaggattcaataagtggcataactgagatttaatctaggtctatcttccatattattttttaccctcctattttttacctttgaacacagaaggctgctacaaagttagtgtttcatattgacttgagtattttattcttgtaggtttcatcactggctgatggtctatttgttggagtaacagaaagcaacataatttatcttttagatgactgtcattcatatacttgaagatagttattacattccttcctcctgaatttcctgttaatcccggttcccttaaccattgctcatatcacatgtttcagttccctaccattctggccacttatacctgaagatgttcctatctatttaaatttcttgtactgggttggaaagtcatatctctgctacgtcattcatgactagtctttttaaaatataaaggcaatatcttgcatttatccatttagaaaatttcatctgttagatgtagcccataattccagtctttcaatgtctttggaattcgattacttcattcaacaacttttctatgtatctggactcatgtcatctgcaaatctaatgaatatgttttcattccagttattgaaaaaaacttgtgaccaagataaggccgaaaatatccttgcaatatgccacaggaatcccctatattatgatattgagccatttgtttgtacctaatagtgtggtcaatcaaccagttactaatccagctgtacctacattagttactaatccagctgtacctagattagtaactaacccggctgtacctagattagtaactaacccggctgtacctagattagtaactaacccggctgtacctagattagtaactaatccggctgtgcctagattagtaactaatccggctgtgcctagattagtaactaatccggctgtgcctagtttagtaactaatccggctgtgcctagattagtaactaatccggctgtgcctagattagttactaatccggctgtgcctagattagttactaatctggctgtgcctagattagttactaatctgtctatatatctaacccaggagatatcagatcacatattgtagacatcattttactgaagccattctattgtctagcaagcaccacttctttcagtggatcatgatacattgttttatactttattgctttaataatccattctagactgttgctcaggactaacagcaagtagttgcatcatcataaattgcctttctatactttctgtaaatcagaagatttccacatctctagttatctaacattgtttctcttctcctcaaacatggatggtagtaattgactatctcattgacaaatcctctcatgagtatatggttctctatccctatttttaggctcttctccttttcctttttttcctgttatcttccaaggaaagagtcactcatgtttaatcatgaacggtatgttggtcagagatagacctgcaaactggaacaactgagaagatttatacaaagtgttgtcctagagtccctgactgtgcccgtagaggaaaatgtactatgattaggtgaggctttgctctcatctccacacagggctctgcatggcttttctatttcacttctggcagtactcctggggaaggctacatccttttcctattcattctgggtgacttcctttgccaaagattcaagacagctttgtatttttcagtctttaactgagaaaggttgtgatatataatgcctttattttcccatgaagactttctctgaggcatgcacatagccacgacctttacctaatcaagaaaagttgcttgggcagtgggggatggggatgcaggttggactttaaatgcacaaatcagttctaataaaaacactgagattcaggtgcctgaggttagaaatactggagggaattcaattacactaattaatatttaagaagggctagagatcacacactgaatgtgggaaactaggccagtcagacatgagcatatggggagggcaagatcaacagataaaagtaacaaacaaatcatacataaatgctccaacaggaatgaaatagagaatataaaataaatgttccaacagacactgaagaggaggtaaatggtctaccagacataaaagcaaaatgttccaacatacacaagacattttattggtttaatgtaaacacatatattataaaaatgatttttccacataagttagtaggaaatgttacccatttatagaaacagacttacgggttctatgaattcacagcatactatatttgctctcatttcctcactggctcatcatgcaggagtctcaataaggcttgactttcataacaggtagttctccaatgcctaagcctacctggatacccaacgcctgacagaaggctgaaaagctgcagagtgtgcctgcttctgcacaagtttttctagttccggttgctctaatgtgatttggttggtgtcacagctaataccacattctctatttgatctgatttttcatctgtggcccagacagttgattctgatttttggtcattcttttatagacttgaaagttttctagagaaggcactagtggtgccaggactatcttgcttccttctgtcctgtctacactagcatttaattacacttttctacctcttttctacctctatgccctctcaccctccttcatcttgggagcttccaaaactagaagccaagagaattaactaggttgctttataaaaattgtatatatgtagggtaaacatgacattttgatatacattggattgcttttgctatcaacggcatcatgtagaggtagtagtagaagcatggaagggtagaagaaaggactgagactgatatttggactcctctttcaagttttctgatgtacacatagagtaactagatggcctggactgtctatgtacaatacggaattttaggctcctggaggaaacaaaccaaaacaaaaataaaaacaaagtccttttccttcagtagctttagctttagaagaataaatgattcacatataccaaaacccacaagatacggtatccccaaaaagttaaattgtctcttacctaatagaggatcagaaaaagaaaagatagttatttcctaaaaattgtttgaaccaaatttgtggttttcaaactatgcttcatggtccccagacttacaaagagatgattacaaaaagattatcaaatagatataaataaataaaaaaataaatacatatataatatgtagtaaatacatatatatcaatttgcaattgtgataaaaatgacatgcaaatttaaatgtattatataaatttaaaaaacactggagaccaatgtgttattacaagttaattatgtacaataagaataagcagctttcatgcaggcctctaattaaggctctcagattggaatacaagctgttgaaaaaaactgttacaatatgcaactacttatcagtctcatgatttttttgataccatatagtatagtacagaaagtcttcacttattgccatccataggttcttggaaactgtgattttaagtgaaacaacatataatgaaagcaattttaccatagactaattgatataaataagagttaagttcttatggcaaattttgggtcacagaaacatcatcaagtttctaaataaagatcaaaacacttttgatattaaacattgaaataaatgtgagctgtacatgcatttaagaaagattaataaaagcaagaaataaatgtgagctgtacatacatttaagaaagattaataaaagtaagataattatttaatcaataattccagttcagggtcatgagtggatggagcctatctcagcagctcagggactggtaaggtgggaaccaagcctagacaggatgccattctatcttagggggcactcacacacagccacattcactcagacacacccatgagcctaacacgcacatctttgggatgtgggagaaaacccactacccagagaaaacttatgcagatatggggagaaagtgccaactctacacacacagtggctcactgggaatagttcttttttttttttcccatcagcgttatgacaccatgttatttgagtatctgctatattccccatacaaaaatacattgatttttgagccaatacaataatccaatgctgagtttttattcctttgtatatttgccattatattcttattgaatgactttataatattcaatatgataaataatctgaatttgaaaatgagtttatctcaataaaatattactcattattccatatgttaagtttctaataagatttagtttgaaaagaggattctgcttgtttaaaagaaatatgaaaaatgtctggatcaaataatatatatgtatcctgcaactcaaggcagtatgaatctcatatggctccaggctgctcagtttctgaatttatcaacttgctggcttagaccactgtatacagcagatgcattgggcccaaactagattttatatatgggccactattccttcaggcttaagaacagtatttttatactgaggaatagcttatttatcatgaaaccatcatacatcaaaagaagtcacgttgccttaaacttatccagtacatgaaatttatcaccctcaaagttctagattatcagaatttaatatattagtttaaaatataaccagttgataaccaagaaataagtcaatggaaacctctttaattatctaagcagctcatcttgtttataataattgtataacttacagatacatactcatttatttttcaatcaaaatatattatattgaaagacttcagaagatttttttcttaatattaaccaacattacttatagttaggaacagagtgagccaaaaaggattctcaccactacagagaataaaactagcaaacctggggaaagatccattttccaaaacctgaactacactctatgatggtaacgtttcaagtatttataacacttaagtataagtcaagagttgattgaatgaggcctttcatgatgtttatgtagagtagtcaaaccagaattatttatgtatttgtttatttttaaaggctgtcatttgaaagttatcacagtataaaggtaaaggatacaccggagtttccattctagctccacattcctggctgtgtgaccttggataatttagttaaactaaacttcagttttcacttctgtaaaatgaaggaaatagtagaggttctattgtcatgaatttctagcaagaaatcaatgaataaatgaaatgatgaatgaatgttgcttagcatgttgcctggcacataaaaagctctcagtaaatattaactgtaattaaaaaatatctaaaagccggttgctttcttttggttatttttttaatatgacttgattttattcataacttactgactatattttcttcccttctggaatgatgttctattgaggtttctttttcttttattccagaatgttctctgagcaatctcttcatttctgcctcattcatcagataggattgtaggcgttcattttggtagttctgcatttggttttctgtcactgcttatgctgttttcttgttctaactcagtggtttaaaaagtaaaattcaagtaaggactaaacataagagaatttactgggactaatggttatcaaaattgggcataaagggatgttattaaaaataaatcacacagagggagaacagctgatgacagcagctgtgaaatggatgtacatggtgggaatcagtgagccccaaagaaacaaacaaaaaacactggagggccatgaaacttacatgatttacaagggaaacccaagctttatgaacagcctctgaagactacagaggccaagcaagtcacttctggatgaaaatttggataagacagcaatactgaaaggagttatgttccctgatcaaatgggagctacagataagaaaagaatgagaaataaaatgaaaatctttaccgagtttgatttctttattgtataacctgcactgaggggacaccatctctgggtataccactatagatacacttaccaaatgcttagtgattattgcaatagttagaagagaatatattttaagagccaaagttacaaatctatggacaagatgaattaatattagaacccatgttgagatatatagggcccaagtagtctatgacacaaaagtttgtgtttttatttaaatagaactctaaagacttagttgtttgaaatatatttaatgtagagaaacatttttttgaaaatttggtttactgtaaagatgaatggagatgtctaactttttgccttttttttctagatatggacccacctctctattttcaagagcattaaattcagttaaaaactaaaaacaaaaatactgccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaatttttgtttccaaatggaatttaatacatttcatgaaacaaatgaaattttatcagaaataaaacatttaaattaccaaaagcctagcctccttaggaaggctgttttaggaagacatgggtagaaatattttcatcaaagccctgatcatcttccctttttgaggtgaaatcactctactctgctggaaacctacatttagttatttataaaccagtattaaatgtatattgtttcaaatctctatgtaggaaaaatatcccacattcattcccattttactatgaactgtataaacttccaaaatcatcatgaaaagaaaaacatcaccctttctgctaattaagtgttcttgctttttttctagtaatgggtatttgaaaaataacaatatgcaagagtatgatcttacagtgaatatagccactaggtcaatatgataatttaatgtgagactttaaaattgagctttccttttatgctactattctctaaataacttctttatttgctatgattaaaatatcttttcatcaaatttgatataaatatactagatatggtaaatatatttatcatttaaaataacaattgaattgtacaataagcactatatcattgcccaatttttattttgataaaatctttttaagtgatatcatttcatgttaggctttttgtgctgcttaatattataattaataattcatatttttgtctttctcctctctgacaacttttatttttaatcggtgggcatgtgccaaattggtttgttatttatttataatgtaaaatgacaagggaattgaatatgtgaaataagatagattttctttcatatgacaaaaatttcttagtaatggggatgcttcttgcttacccttatagattcaagggttttagagaggttaggtcaaatgtcacacttctcatataacaacatgtggtaagtgcattaaatagactgttcattttttaaaaattcattttagttttgtgaagacatctgggcacatgcataaaaaacaggacaaaacaatatcaaaatttgtaaaagactccctattccgataaatcctatagtgtcaattaagtaaaaattctgaccaaacagatgtatttgtattctttcctaaaaactaaaacaggcaaacgtaataggaataaacagagaacgtttcaaagatacagaatttccattgaaaaaatcaaatgttctgtctgtaggactttatagaacattaaataatcttttcagtactgtccataaccagaaaccacataagctggatgctagactattgactagttatgacaaaaaattcacagtttgatctcaagggcatcagcgatcctgggctcaggtgatcctcccgccttggcctcccaaagtgttgggattacaggtgtgagccatcatgcctggccatcgtgccaacgtattgaagtggaaagaactaatgctgagcagagaatgggccatacctgggtggttttaagaggtgctgctataatgaaaaatcacaggctcacccaagaactaccgtggaatcagaacctctagggatatggccctagaatctgaattttaagccagttcctgaggtgcaattcagtttgagaactacagtcttaaggcaaaacctttctatcataccagagcttccaattgtcaggccctttgaatccaccctttgtgtcaaaccttagataattcaagagacataacaaacgtgatcatgttacatgcttcctcacagatttcagtgtctcccatttcttctattagtttaaaaaacatagtccaccatcacagggccctgtttaagccagctcctcctctgtggctctgcctttgtggtcaacctgtgcaaaactttgaggctgtgacatcacttagtcagtctccaacatttggaacaagagaactttttctaacaatttgatcccaattcctattttaagcttgagcattatgaaggctgtatctgtatataatattgaacacttcaaaacaattttagatcttaattattttgttattaaaatgttgggggtgtttaagttgacattgagtcagatgtaggaactgatatacagtgaagttaaatcctttagggtaaactcattcagtggtagaggctgaactacagagcctaggcattctgacattccaccactgtgcttatcagcttgctccttgagcaaaccttttcctgcctttatgagaatatgcccattttatgggctctgtatctatgagatattttacctatgcttatgtacacatggtgtttatctttcaaagctggactatggaaaagcctaattttacaaacatgttagtaaaagattatgtaatctgaggtgattacgtttaaaatggcaatgataatgatgttaattccagtcctgtgaggtactgtttctgatctggaaagagcagttttcttttttaacagcttattttgtattttcataatccattttaaggtttggtattaatatagacatgagaaataaaatataactgttgccatgccaaatgtatatcaaaaagttgctaatagccatgactgctatttggttaactgtatttcactatttaaataaaatgatggaaaatggtgtgtctaggatctcattcataataatgaaagacaatagaaactattagcataggtatgatgctaatgaatggtaaattttcaatagagatccatcgaccagattgtttgaaaaatgtttcctgtgggtacgaaaaatgcacacaaacaaacacatgcatcaaaatgtccataattaagtttttagggaaaaataacaatatatgttggttaaggactttcacttaaatggcattatagatctttcagaaatgagagttgatttatacttcagtattttggttcccaaaggttgggacagtgggtggtagaggagaagtagagtaaatggaaggtatacatgtatgtgtgtgcatatgggcaactttaagcaccttgaatttaatgaacaaaaaatgtcattattctgtgtttatatatttttgtgtgaaacaagtacctttctctatcactggagtttacatggattttctcatgatatcttttgagaatctctttaaacactaaaatacatttttccaaatgaaaactcccataattctgctttattaatatctgaatgaatatttccattgatttgtccagaagaaggaactgagtactgtttagagagcaatctttttcatgataattggcagcaatgtttccctgctatcagaaagaaaactatagaaatacgaaactttagataaacatggagataaaaataatattatggagtccaactggtatctttgaggtgaggacaggctgagatggactccttggcttccttctgtccaaaaatttcctgtttccctatttcctacggttaccaccatggaacatgttaaaatctcagtagggactctgtttcaacttttcctgtcaaaacacagtgaaaaagcttaatggaaaaaaatgtccttcctatctccatgccaggcacagtgtaagatccacaaacttaaaagccaggaaaatattcttttatgtgccccaaagctgggcaagtgacctagtactacaaaaattcccaaataggcatgtgacctgactaatgtgtgctgtgagatgagtcaagaaaaatggaaccatctgtacttttattggacagtcaaataatttctttctgtccacccaaaaacataatttctatgttaagagtgatacaaggagacttttagaaagtctaatttttaaaatcagagatattaaaatatatgaaaagtataacctattaaacactggtggagataagcaaataggcttatgaaatcattattgctttaaaaatttgttacctactcattgtgtactaaggcttctctacgacatacagaagaggccggtgcggtggctcacgcctgtaatcccagcatttcgagaggctgaggcaggtggatcatgaggtcaggagttcaagaccagcctggccaagatggggaaaccccgtctctactgaaaatacaaaaaaaaaaaaaattagctgggcatggtggtgggcacctgtaatcccagctactctggaggctgaggcagagaactgcttgaaccttggaggcggaggttgcagcaagccaagattgccccactgcactccagcctgggtgacagagcaagactgtaaaaaaaaaaaaaaagaaaagaaaaaaagacatacagaaggaaatcagggaaaatgggaaaatgaagggaattaacaaattgcaataatctttaagaagtagagtatgaacaattttccttttctaggatgaaagctaccaacaactgaactcttagagtgagtgatggcagaaaaaaatagcaatcaagaataggggcatgttagtttttagacatgtttacaaaactctgccttttatttcttaaacccataggtcaaccacccatcatacctacattaccccatatgacaagtggatttgttgtatgtttcaagtttttaatcttggtgggaagggggagggcagagaagtatttattggtaaaatatcataataaaggttgagcctgtcaatgattgtacctaacaataataaatatgtgtaggaagtaagaacggcaaaaatgaagccgggtaggatactgtggatatggtgacagacaagtatctatacgaaatcctgagatatttgtcctccatttcataaattaaagtgccccctcttttgctttacagataaggaaactgaggtgcattataatagcaacagcagctgatgtgtagtagatccataccacaagccaggtacgatgtcaaacatttaaatgtatcatttaatttaattttcatagatctcctacaagacaagtgctattattttcattttacatacgagaaaactaaagctgacagagattaaataacttgtccaaggttgcatagtaactaagtgaaagagccaagatatgaactcagatctgtctgatttcaaaacccaggcccttaaacactaggccagtggttttttaaccctgattgcacattagaagcacctggcaagcttttaaaacctactgatactcagaccctaccccagaacaattaaatcagaatttcttgtacctgggccctgatgtgggtgtttgtttcaaagcctttctgggtgactgtaacatatagcttgggtaaagaagaattgttgggtgtctcccatggaggtcagtatatctgtgccaatatgtgaggtagtacaagactcaagtgtcctcagtctgtctgcagtggtttttcccttgccccatcatgttcactttgacatcttttttttattatgatttttggagaagtaatatacaagtgacaatttttttacaaagcattgtcacagcagaacatggtcataagtccatcaaagagaaacctgttcatatctatgtacaggctatgatgaatgaatacaaagaagactatgtttattactctcatccccaaagggaagtataaagctggccttaaaagctgttcataccaaagctaatcactaaaatttggaatggcttcctcctctcctttcacaaatgcaatagggtagccactggatctaaggggaaaagatccaattaccactctttacaatgctttttcacttaggatctcaagacgactgacagtcattcaaaacataaaagtaaagtgaaaatatctctagtagaagtgaaaagaaaatgtctgtagtaggaagaaggcctaaatttgtgtctatactctgccactttactgcaatgacttgaggccaaaagtaaagtgacagagtatagacacaaatttactgccatgacttgagccttgatttccttttctatatgtacttaagccatatcatccttagggcagtgatccaaaaaatgtggtccccatcagcatcatgtggaaacatatcagaagtgaaattatcagtccctaccctagactctgaatcagaaacttggtgaaggggcagtaatctgtgtcttaccaaacattgcaaataattctgaccacctccagctgactctgatgtatccacctccatggggttgttgtctaagaataaaaggagatggtccataaaattgttattttttttactatctactgaaatcagaaatttcaaaattctctcacagagatattttagagaaataatgttacagcctacattagttagataataacctcatttctgaatttcactttgaatgtgtagacgaggcacaagtcaaccagaggttatgcaattagcttggagtcaaagagaaagcaaggagtagagctgagaaggaaaccccagtgtgaacttgatttttattcaatcaaactgttaaggtaccaaccacgcactttcatctataatcacaatgaaccttttaataaacatgtttctatcctcttagcttaaaaaatataacagtagctttttggattttaaaacagattgacttctatacttctgggctaaaggcagctcaagagtcaataagaatcacaagctttccacagtgagaagaaagtgcaattgcccagtcctctctatctatgaagtgcagacagtattcctcttcctcacctcacactttcgattattgcaatggtggaaaccatgataaataaaagcgcttatctagtggtttggttttcactaaaattacagacttctgtaacattatttggataccataaaacacaaaccaaattttaggagatgctttagggtgttttttcccctgccctcctgtcggaagccctctatctttttactgtaatttatctgatatagctaccaagatgcttgatacttttacatgcaagggtgctgaaaaacaaagagcgagggaatgggttgttaatgaaattctctgattgtaaaaagcactctggaatgatcaggtggtaaataataataagaggaaataacataaagtgcttaggtgctacagcgatagtcaccatataaatgcagaagagatcagacatgaatagaatttgcattttatgcagctgctgtgtgtgtatatagaatatacagtagctaatttttcaataatgctggtaaaatattgttcaaaatctattcttgctgtcttctcactttaaaaggcattatatagaaaaacacccatctgtcctagtgcaatggtgaatgtgtgcaaagagcctagaaaaagagcctctttgcatacgtgaaaaaaaagaactcaaataaaaggagataatgaagaagagacaatagtaacactattagaacagctatgcagacaagcacaaaggtgatctttgaaaaacatcagggataaataactctgttaatgtgtggcagagaaactacagttaagacatacagtaatataccaaaaatatagacatgcttttattttgtctactgggctattgtgatagtgatggttgtttttgaatagaaaggaagaagagagtgggaagtaggatttcgttgtttgttgttactgttgctgctcagtttagaacaacaacatcaactacacaccagacccgtccaacagttccacaaacaatgcttaccatgaatctgccctcaattttcttgttgttattttcccttaatacttattgataacccaatgcccattcattagatatgctaaatcctcgtccatggttactctcctttggaagagactgagaagatgctaagagggagttcctcttacacataagggaagagtctgtttaggaatctgagaaagcagaggccaggataaagagaccactagtcaatcaatactaagcaccgaagactgaatcacccaaagatacaattatctcccttcctttgttctgtctcttagtcaaataaaggattgtttgtagaaccttttctgttcctgatctctaaaaagcaggactggacttgcacatccaactataattcaaaatatctcacacttccaacttgaaagaagacataaactgtttcaaagaaactcagagagagcaaatgcatattcacaaaacttacacttattcctagaataggaaaatggagagagaactaaccacataagaaagggctaatcataataataatagtaataatgatgatatcaatcaatactttggattctagagaatgatttatcacaaaaattcacctgtattaagggagactccaggacaaggaggtcattaagctacatttccatcttcaggattcagccaaactcagactctccggaaagctgtaaatgctctcagaacagactttagtaatgagattggaatgaacactgggcctatggcgtaaaagcatctccctgccccttgttctaaaagttaactattaaaccatgtgcggttcatcctgatttggtttactcaattctagaaacaaggacatgctgatcagattgccctgggcaattgaatacctactgaagcctttgggaagacagtgttcttcccaccacccctacttaaaaggcttctgttaccagactatcaattctgtgttactggtgaaggatagaaagtatcttcttttgaaggacaagtttttcactcactgagttttctgctttgggtatatactcaacatgttaagtgcttaatcttttttcccccattcccctttttctactgtagtgtgttttgtttgtttgttttttgtttttgtttttttttaattatttgaagagtcacttgtctggatgcttcgttctagtagaatttggctgatttttttcccaacaccttttagtggaatgcagtaacagatgcatggagggagaattggtcttaacagtatttttaggtttcatctgtgtcagagagagatctcttccctttattgatttcttgcatacactatccacactacagcttgaaacagctacaacagtgtttgaaaaattggttgttcctcactgttcaaaccatttttcaaaacagtcgttacaagcttcattttactttctgttataaggagggttttgtttgggttggtttcattttccttgtggcgtcatgctagcagagaaacacagtcaggaatatagcttttaaatgtggtatgattgggattataaccatatcagaatctatattgaaaatttattagattgagccatgtgcagttaaaaagaaagaagtcagaagtcttcgatatttttcacaaacatgaacaccatctcatgcaaacgttaaaattcaccaaacaaatgataccccactgttggaaagatattttctcatgtcaacaactcaggaaggagtggggagggaatgggacatatacatgtaaaatttttctctatatttttgataataactctctgtgaatatgttttactacctaggtaatgcttatatttgtaaaaacatatagttatatcagaaagtcaattttgaataaacctgagaatggcaaactataatttttaaaatactaaccttttagaactgttcattttcacttttatttccaggactcactatcttaaagagaagaataaaagttgaagatccttgggattaacagaaagggtggaaatagccaaatgtattcatatttttggccaggcgcagtggcttatgcctgtagtcccagcactttgagaggctgaggcaggcagatcacctaaggtcaggagctcgagaccagcctggccaacatggtgaaaccctctctctactaaaaatataaaaaattagccaggcatggtggtacacacctgtaatcccagttcgggaggctgaggcaggagaattgcttgaacccaggagatggaggttgcagtgagcaaagactgagccactacactccagcctgggtgacagagcaagattctgtctcaataaaataaaataaaatgacgttcatatttttaaaatacagcaatattcatttgtttaaaaaacaagattgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaaaaaaaccaagattgagagcacagttatatagtgacttttgatacatacacaataaaacttattgaattttcaaaaagtgagaaaaaaactactctgctttaaatttaaagtaataaataataatgaagacatatcaacattggtaactgtcagagtgagaaaaggaaattgaacattcaatgtgaccagaggaagggtgaacatgggagatactgcccaggaaaagtgctcatgatgagtaattcaaagacccagaatcttaacataaattttttatagttttcttttcaagggactatttgaaaaaagatggttctggggtttttgttgtagcttctttctttctttctttctttctttctttctttctttctttctttctttctttcttctttctttctttcttttctctctctctctctctctctctctctttctttcttttggctttgttgtagcttcctctttctctctctctctttctctttctttctagctaaaatttcactctaaattccaggaaattttcacgagatccttttagaggttctgacacaaataaagtaaaagtaaacctgttgtggcaaagttactaactagtctacactaactctcagtccttgctcaaagcaaaataatggagtttggggtgcaatctggtgaactcaatggtccaactgcataaaggcaaagaggaaagccaggcttgggcacttctgtagaaaatgaagattactggtttgaaggccagtcttctcactgcttcactgtatgtggtgactattgttaaattagatatccctattctgatgaaaaggcaatgtgctatttttggggtatacatgtttcaagctgtaaactgcaaagtgctgtataaaagtaaagtggtgttaatgcctcataagataaacatatagattgatgatggaggcatttaaaatgctttaattgcccactttaataaagcactaaataattataataaaaacaattcttcagaaaacttggtgggaaaaaggcctacaggatatgtttgttaagaataattagattttagttttggaggaaaaggtaggacaagtcacaggaggcactcgatgagaagtcaggaatgcctagtacataagccacacatattaagttgtagtttcttcaaaactgacaataacatgtcctccaaaaccaaagggaaaatcaaaggatgttgcctatacttatgtaccttttgctactggagatctagtcaatctatagccttggattcatagttctataacatgacaacatagcaaaatctcaccaacactttgttttaaagaaattggcagctgggtgcggtggctcaagcctgtaatccatgaactttgggaggccaaggtgggcggatcacaaggtcaggaatttgagaccagcctggccaacatagtgaaaccccgtcgctactaaaaatacaaaaaagtagctgggtgtggcggtggatacctgtaatcctggctacttgggaggcagaggcaagagaatcacttgaacccaggaggcggagcttgcagtgagccgagatcgcaccattgcactccaacccaggcaacagtccgtgactccatcaaagaaagaaagaaagaaaaggaaggaaggaaggaaggaaggaaggaaggaaggaaggaaggaaggaaggaataaattggctatgcctccaagtgaattatactataaacttctttcccattaccaataatgtaaatatataaccaggcacaagcatgtggaaatggagaaaggatgaacgttagtcttagaaactttggtttgtatcccatttccaccttttaacaagtcatttagcctctctaggtcaagattttcttacctattaaatgaagataatggtacccatctcacaaaattgttttaagaattaaatgtaaaatgcttggcacagagaggtcactcaatacatggcagccaaatcaccacatgcagtaaaacccagataaaatatattcagccaggactgttgctctgtgagtaggtctggtatccatgctacaaaatctattaagcctaaataatttggtcattttagcaatactctttagagattttttaatgacatttcccaaaggtcaagctagcttatggttatgtggaactgctgcatttataagagagtttagtgggttcataaaataagtcttgctccccaaatccggatcataaagaccttctatcataaaggataagagtgacatttaaaaaaccagtttttaaaaaatgatggtagcaaataaatgcagatgatcaggatgacagcaagtaccaagtcaaagcaacacggagaagaaataggccctagcctgcaggttacactttaaacactgaggagaaatgggagagtaaagagcaacactgagcctcatcggactgtaggtgaaaaaagattcaaaatctgactctaaagcaataggtaaagaaatattttaaaatgcttatctgtaggaagaaaagcagtaaagcagaattcctaggaattgagaaacacttaggaagaaaatgcttaagtagtacgatccaaggtgaggctagctgcagaaaatacaaatatttatgggttaaatcaggactgaggaaaatataaagccaaatatgggcagctctgagggggaaaaaataggcagcttggtactcaactgtcatcacaattcatttgtgtttcacgtcccactgtttgtgacattaacagaattttgaatttagcaatggactatttttgtattgtgaatctctgcagccattttccatatgtagctaccactgtaactagcaataacagccttttgagctttaaaatgcttccaattaataagattcaaaataggggtcacctaagagttttccaagttaattccctttgtctactctttgaagcagagtggtattcctgctattcatttgcattgaggccaaattatttgaccatttcagtaagatatccttaggtagcttttgcttttattgtcattttccaaaggattaagttagttttagatttttgaactgcattttcatttaactaaaataactaaagcaatctttttatgagggtatttaaatagatcaaatttataccaagttcctactgtgtgtcaaacattagcaaagcaatttaaaatgttattatttatatatcaatacatacaaatcatatgtgttatatattaatgagcttatagccattatacacaggacttttatgtgttattattgttgtggttatttctgttgttcgcaggtatcagttatcaagtacctattatgttccaagaactctaccaaggactatacacactcaccatgtaatgaagatattattggtttattttccatttgaagatttagtcacaaaaagtaacttgtccatgagcatataatttgtgcattctcttaaaatcacttaaacttccacgtaacacctggattgacgtatgctttttcttacaaaatatacttcaattcaataaagattctttagtcacctactatgtggcacctgctaggatagttatctttgtttgctattatgctaaatcacagatctgaccattagaatctcttccttcctgaaaataccctctttaggtaaaactgtatttcttatcattttccatcactgattgaataaagaaaggtggcactatctggaaaacataagagcgttggatttacaagtttcttttaataaaacaaaccaagttaatcacaaattgttgcaacaaaatatgtgacatgaagggcatttaaggcacatttagacattatttctatctagaaacagaaatttagtccacataatgtcatttatctactgagctaaatcgtattacaattttcatctataaaatccagattcttaatgtgtgttggaaagataatatctctgacccgctctcagtaagaaatgtgttttgaattgttttgttagtaataataatggagttgtactggacaaaatatattttcagcaagtttctctggtaataaaaataactataatagtagtaataatactagtaatcaccaataaataatagatagcatttattgaactctactatgtgccaggtactgtgattagcactttacatgtattatcttattaatttctcaaaatattacatgaggtaagtaccgtaaatccaatttaacagaaaagcacattgagatatagaaatccaataatttggtaaagatcacacagatagaaaagaggtacaagtcaggattggaacccaaggaatctgactctcgtatctatctactctaggtgggggatatagcaggtgctatggtgtttgttcaagagaatactccatttgtgttgttttatctaccttattagggttggggcccatttggtctgtaagccaaatctgaagacagctgaaatgagttaaggtttgaattagtgctattcacactatctgccaattaaaatgctcccttctgagaagctgtagccagttggcataaccttaggacataatacatgctcaaaaaagtatctgatgaatgttaacaatggtttctctaagtggtgattttactttctttaaaaaatactttttcctattgtctgaaatattttcaacatgggcacattacttaggtgatcaaggggaaattcaggactttacttaaaaaatgtttttgttttgttttacaattaggttgttagtctcagttaaaacataactcctgctgggaagcctttcctgttgctgtactctctgaccttttgaaggacagtactccttactctgtctgcctcagaaccttatgaaggccacatactattgttaattatcagtcttctctgctttatgtgaagtcccttgaagattgaccccattacttatctacctcttagagctctaagcatcttgagtgcctaccactcagttcaatgaaaaaacccagaacacacatacaccagaacaagcacaaaagatgaaaaagaattattttagggttgacaatgcacactcttggtatttgcagatgacttgtttctccccttacattatgtgcaggtccccatggaaagaagtttcccacaagaagtgtcttgaatttactggtctcttctctggaggattttacaaatgcatcaaggaatacacacacacacacatacatacacattatgaaataatatgaggataattagaagtaatggggaacacaggaggcaatttctaaaaaatgaagcatattttttatatatataatgtatatatgtatacctgtatataatgtatatatgtatacctgtatatataatgtatatatgtatacctgtatatataatgtatatatgtatacctgtatatataatgtatatatgtatacattatatataatgtatatataatgtatatacacatacatgtatgtatatatatacacacacgtatatatatatatatatatacacacacacttttttttttgagacagagtttcgctttgttccccaggctggagtgcaatggagcgatctcagctcactgcaacctccgcctcccgagttcaagcgattctcctgcttcagccacccaagtagctttgattacaggcatgtgctaccacgcccagctaattttgcatttttaatagagacggggttttgccatgatggccaggctggtctcaaactcctgacctcaggtgatctgcccgccttggccttccaaagtgctgagattacaggcgtgagctaccacacccagccacatttatattttatattaagtaattttgttcctttcctaccccattataatataaacttcatgaaagtagaaactttattttattcactacagtatccctagtccataaaagaaggcatggcattacatcctcaataaatatatgtcgaaaagaaggaaaaaggtatagatgtttccactgtatttcttatatttttctggaaacaaaggggaaaggtgttcccaaaaggtttccaggaaaacttcaatcaccaatgaaactgcaagctcttgtcatgttcctcagaccactacctaattaattcctttatgtgcaatacatcctttctagcctgttgatactcaatttctggcgctgctgtaacttgtggagcaaagagtgccacgtgagaggtgcttgggccccttcatactgtgcctcacctgcgaactggggaggccactgccatttaggctccagcatcttttacaggccagctgagccaccagaagggaaggggagaaagagacatgcaagttctcagaatgtctggtatattcactcacacacatttctcttctcttctcaaaaaggatcctggcaacaaatcactgattaatgatgagagaaatggaatcaggaggaccccatgataccctctcatcctagttttgggagataaaatctcccactgtggggaggaggaagaccctacagggttttcttatgttttgcagcttccaaattgtagtagggtcctattctataaaattgctaccaacaactgtatacttagtgatataataccatatggaaccttgagttttacttaaagagtagattatgtggcaattcatagttatcctagtatggataagaaaatatcctagtaataacataattattctagttatgagtttttttcagacaagaaactcttttattcatctttttatctctagtgcccagactcaacatatgactttgtatatagtagttcttaataaatgatagcttaaaaattaaataatatttttaaaatggtgagatatggcttaaaggggttcaaacaaattcagagttttgtctaatctaggtgtttctagatttatgagcaggcaatcacatattattgagtatgtattagtgttttagttagtgttaatacagtataataaaccctcattgattgttgtagagaaatcctactattttacactcatatactagaaatgtttaaagtcacaattttaaaatagtggacttcaaactttattatgcacaactaacctgggcagtttcctaaactgcagatccaggctacattctcagagcttctgatttagaaattctggaatggggttcaggaatctccattttaacaggtgctctagataatcctgatataggtaatccctaggtaatcctgatacagttggtccttggactacttaccatggactaggctacaaggtaatataataataaatctatacagttcaccttttcaatacgaagagaagagactagcctattaaatgtgacttaactatcaaaattacccgtgaaaagaataggcaatttgctaagacttctcaaaatgaaccaagggaggacataagggcgagaaatattaaatttcaagccagaaatgactctttttaaaacttcaaagagactgacaatctgcttaaagtaaaagtggaagaagaatggcagcagtacagaagtgttttatgaacaatttaggaaagcaacattgattcaagaggtttatttgataacatgttttaatggttattataaaagtgaatgccttctaatctttgatttgctgctaaaatatatatgtatttatttacatgaaattttttttttaaattccccccttaactccctactttccacacatttttagcttgccaacattactgcgttaatggtgtcctttttttctctctctagaaacacatgccctgggattaaaaggggattactttggtctacttccacatccatgtcccagggaaggtactgcttctgcttccgacctgacctttaggtatctgcagccttcaattctttacagtgggagttgctttagcattgatttcttggaaaactaagagctgttttcaaaagccattttcaagacaaataatgaaaattattttcttatgcttatggatgttacaaactgtgtaacaagcttttctctttaactttgctgcaagaaagtttaaaggcaactgtatagcacttcactgaatatagttttatgctgacctcacttctaactccatttttatatcctttcctttattgttttatttttcttacctatttctaattcatgtattttgctgcaatcatgtatttatgtttattttttcattgtcagccattttaattcccttattggtgcaataaatagtaaataagacaaataaacaaaacaaaaacatatgtatgtatgtgtatttggtatttacatcgcatgtactcaaaataaaaaataaaaactaaccacctaaaataattgacatatttcattattctttgggctatagattcacttgactgcagcacttccatttagggagatataaaattaaaataccaccatgaaaaaatccatatgaaatttgacataggtattttcagccccaggtcattaattcagttctgactgacatctttcagttctgttttaaaatttttgtgttcagtctttcgattacacacacaaaaaagttttggcttaatcagcctaataaagtgtatatttctgaaaacatttttatgtaaacaaatatagaagtatacatgatacatacacatacattttttacttagagtcttcaaaccaaatatttcagtcctttgcttccagtattattttcttttaagtaaatacttttcattaagcaacaaagagtgatagtcatctcaacaccaaaaacttgtattcaggctaagtttagtctactttgcatattttcctctgagaatgatccagccagtctcagtctgattctagtaaaactcaggtaatgtggaagaactctaattgagtattagacattttaacaattatattcatattgatatgtccttatacgaccactctaggtgaaatattactatgcttgggacttaaatatgatttttgttcttttattaatttctgaatctcatatccttccagataccaaaggaatacagtaccacctgggaataatgtcaattttcactttaaaaaaatattttgttgcttttcccctcagcatgggcaaccaatagctgattcatactttcattacatcacagttggattacagaagggctctttagtctggcctccgcatgtctcttgcaactcatttgtagacagcccagaaactagcagctggacttcatttttgttccagcagtcaccattttatagtgtttctctaagtcactgtgagtttcactgatgacaagtctaaaactccacaggtattcatatttagtgggttaaatcagagagaaaggattatgcttaactttctataggttcatgtcactcaactatactttgccattcacttaccatacgtcaaaaaggtggaataatactattcttacatagaggactaataagatatacttagcaaaagtaggtggttgcaaaacatttttttaaaaatcagagtgctgtatttttaaaatcttgcatagaactctggttcaatttttgagtccttccaatttctcataactctgtggtattcataataaagcaggcagatggttaagtctctgaacatatgctttaaatgccccctttgctatttctaaataatggaccaaattttgccctcaaatagtcacaggaaactttaaggaggctgcctcttgaaatctgaggacagaatgtgatccagtgggaattaaacctttaaaaaatatattttctaaactttcttatgagctctattccctataccaagacaaattacattttttaataaaataggatatagtaagagaaaaatcctaaccaatacaatattacttggctcaaggaatagattagaaggcaacatatgttttatttatttatattttaaaattctgattttctaaaacatgagagtcatctgattaatttctgtgtgattaccagattttccatttttattattattcctattactagtatcatgtagatgttatattgttaaaacatcttgcaattattaattagttaatttagtttaaattatgattatgcctttgttttaaatcaatgtttttcatagttattaaaagccaaaagcactatttttccagtcacttactttcatttcaaaaacagtttgttgtcgatgaaagcgcattttccaggttatcacagaatatgcaattcatctgcaatggatatatatattctggtaatgttgctcacataacctagctgtacttgtaagagtatctctgtttcttaatgtctatattttatacatggaattaaccttcatttgcacactcatatttctatgtatttaaatttattcctgaaagacctctgaactagtctctcctgtcttacgatgtccacaaaacttagcagtctgattaacattacagataaaaagaccacacaattgacaataaggacactttagttattatagacgtctgaagtttaagtattccaaaactataatgtccctttagaaattctcaataaggattagcttggtcctaatgaaaacagtgtttacttttaaaaataaatgcaatagttgtacccaaatatgttcgaaacactgtatgacgtgtcataatcaacaatgttgaaaataactaaagatctttaaatcaagtgataattttacacatatatccacaaatatctgaacaaaatttataattactattgggacaaaacattaacatattcttctgctaataaagacaaacaactttgagaaaatcctctctcattctcacgtctctaactttcacaataaatgcagcactgaaactaaatttccaactcagaaatacgctgagctccaataaacaagttgattttaaaaactcaccagactaacagttatgctttttcccttatctttcctttgctttcccttgttctttcactttccatgcacacacaatcacacttacctgcacaagtctgaaacatcagtctatgtattttttttgaaatgtactctgtaccgatgcatttttctgtgtttctttctaaccctcgagaatgttaagaatttaggaagagagccacagcttaagagtgcaattatttgccagtaaatactcaatttgcttgtcctgtgatttttcttctaacttgcatattcaataatccgtccctgactgcgtcacgagcacaaaaagtcttttctccaaaggagaagactttcgccaatcaaccttcagccatgccagggcacagcttgtcagggtgatttgttagctttaattaataattcctcacactggccattttcacaaataatgcagtgaggctgggaggctagattgctatgattcagacagataaaactacagtggaaaggggatggggaggggtgtgggggaattcagatgccgtttataaacacctctaatcatactctttcagtttacaatatagaggacatctcagttgaattaccacgttatgtccaccaatttgtattcagatggaaaccatatgttcctccactttatctgctagggactccctggtgccaacacagtcattgggcagacaacattcacaaaagaggtctctagcctctggattgcaaaagtttactgcagggtgaagttgagaaatcagacatatactgcacttctcagtgagcttgggtaacagtctggaaacacagaagtatgagttatgagtgtcagattttctcttatcctgctatgtgatactgggcatttcatttagccttaaaaaaaaaatctcatacctcatcctcaaatcagtttgcaacaatgactgatttgttcatgcattctatgaacatttattgactcccaaatatatgctacacactgtattaaatgctgagaattttgcttgaaagtaagacttttccatttaactgacaatccatgggcttgaacaaagccaccaaacagatagtgtgcaaataaaaataaggatttctaacagtttctgtgtggctcaaccaaataatcagtaattgacaacacacttgagtccattatgcaaaagtaatgctcggggtaaaaaagaatatacagagattaaaaaatatgtttttcaaagattaaaaaatttccctcaaagtgactagagcactaagaaacatattaatatgttcataaacaatttccaaagattcacaatcactttaggaacatacaaataaaaaaattttattaatgtccttaatcttatataagaatatatgcctgtgtttgagactgcaaatttattaatttattggatacatatttattgagcatctactctatttcaggaactgaataatattggagataagtaaagcacagcctcgttattcaagaagctcacaatttagtcaccagactctaaaagagaaaacacacatctcaactgaaaactgtaatacaatatagccagagcaatgacacaaatatacataaacatgtaggatgggcctcctagaagtgatgcatcaactatttgtaaaggttgggtagaagtaccagtggtgagaagaacattctagggagaggcaaacctttgaaccctttctcaaactgttactagaagcagagcaccagttctagaaaagatgggatttaatacatgacaatttcagataaatgtttcagatggtaaatattgcaggatttaaaaataaacttattaagaaacaaatgttccccaaaactataatgtcttgatatcatcaaaaaagcatgcagcatctctagcactggcacatagtaacatacatgtctttctcactttgtgtgtttcagttctctgaggcaaacatgaaacatgcttgacacacactgcctttctgtgttttcttgcctatttatcttcttttactatgggcaggcttctactgcttctgttttcactgtaccataagataaatcatatttgcatgactgttaaaggaaggggaaaaatctgtgtccattttgtggtcacacatctacttctagtcagatagcacatgctatatgggactaagagtgcaaatgttaaatgagaaaggaaataatactcctaaacccccaaaaagctctttcatagatagtaaatactcctagaaactatacagaattcttggtgttatttaacattttgctttatattatatttaacagtgtaaggcaacagccagaatactatttaccatagttcagtaacatctagccatttaaagaatttacaaagtttattaattcattaaatatgtatgtattgagctcctactatatactgagcacttatcagtaaatgtttgatttttattcccacaatgcttacacataataatagttaacattcattgagtgctgactatatgctagggactaatctaaggactttacatatagtatctcatttaattcccacagtaacattatatgttaggtactattaccacctccatttagtatattatgaaactcacaagtagagaagctagatatacactatgtgaattcattctacacaatgagaccagggcaactaatgtccaccaaaaatcagatttattactttatagttacacagtcacaagtaatgtttatgttgtgaaaattaaagaaaataagtccgggcacggtggctcaagactgtattcccagcactttgggaggctgagctgggtggatcacctgaagtcaggagttcgagaccagcctggccaacatggtgaaatcctgtctctaataaaaatacaaaaactagatggggtggtggcagaaagctgtaatcccatctacttggggggctgaggtaggagaatcgcctgaacctgggagatggaggttccagtgagccgagatcatgccactgcactctggcctgggtgacagagccagactccatctcaaaaaaaaagaaaaaaaaaaaagaaagaaaatgatatgcttaatgtgcatagcacaaaatctagcccagaataggtgtaaaatatatggcatttgaagtattcagagttaaagattaccacatacaactaagacttactgtttctggaccaaatgaccatatattattgaagcctatcttagacaataaatgtaaataaatcttagctaaagcaaattagccttggtagtctgggagggttttcctttgaagatgttaataatatagttgaactggttgtgtttaagaaagcagagctgacagacaaaatagagatagatgacacaggaactcaccagttaataatagaaaaaattcttgtttttccaagtgattaatacaatattacattgtatttaatgtagatgaaaaagcttatttggtactcactggggaagccaccactcagtataatcatatgctcttttcaaataatcccatgctgctaactttacagctaactgccagcatttgccaactccgggcactctgatgccctctccacattctttcttctctcttgacattgactaagtccagccacccataattcttgacctaaactatggcacaaatatccatgaaacagaacatttatttttggtgataaagctggttctagatgaaatggtggtatttctttatggaggagctgcaaggaggctctcttcatttgcttgtgtgtgtaagtaaagtttctgatttgggataaaggactgcctggaccctcaattattggtgtttattctatggatattggctgagatattttgtatgggaaaaccagcagatgagttaatgagcatccgtctgagccatactaacctagtggcacctcctgggaagccagggcgttctagaatctgtttatttctcaaatgaaaatcctaattcatagaagttaaaagtatagaagacaacttcacgtactctttcttcatgatacctggattggttacaacttagtaaaattttagcctgtttggtccctccttccttactggctgtctgagtctctagccttatataggaaaaccttgtcttctaattgaaaatgatgacaaacagaagttatgacagacacatttcaaagtagatgctatttttcccaaataaatttcacatacattctaattcctaaacttatatattttcacatactttatataaatacctgacaccttaaaatgttttacttagtgagacctagataatgaaggaataaaaaggtgacttaatcccagtttttctaaacaagaagtttagaactcacgtattttaaacttgttaagtgatgatcaatataatgggctgtatatttggttgagagttaaaaatctaaagttttctcagagtactttaaggcattgctttctcagtggaaatcttcgaccttcacattctcaaaaggagaaaaatgtttcttgtcagaaaactagtcatggctagtccataagaagaagtccaagattgtatcagcttccctgtgaccttgctatgagatttgctacaagtaatttaatgcttttctatgtctcagtttactttttatctatgatacctcaatgatattattaagataatgtggatcaagtgttttgatcattgcatagaacatatgcatagaacatagaatatagaaatccccaaatataagaatgaaaacttaaattgttagaatgacactaactctgctacaaccttaaatagcatatatagtacctcagtgtctccatttttttcagctataaaatgagaatagtcatctttatgtttttcattaaacagtatattggaataaatagagattattacaaaatctgttgaaagatttcaacaaaatgtcatacatgcaagtgaggtgatgaatatattaattggcttgattaaatatttctaaaatgcatacacagatcaaaatatcacattgtaccccataaaaatacataattatttttcaattaaaaataaataaataaaattaaaatgtaatcaaacctctgaagctgattttcaaatatattagaggaattgattttaaaatatcaaagcgtaagaagtaaatgttttcaagcatattcagacacttatgaaggaagactattaaaagacagggagcaggactgccttttctttgtgtggctggctgcattttatgatggattcaaaaccccagtaatgagaaaatataatcagaaaaagtgatttttagcaggctgttgaatgacacataaaataaaatgtattcattaatgagtcagcaaaaatgttatgcatgagctttcagagccagaatttttaagcagctttttcatacttggtacagccatgttcctgaagtatcctctcacaacccccttctacctctctctctctctctttttttttttttttgtcctgtactgccaggttggaataatgaccaaagggaggggcaaaacaaacagatatgctcactgtggcagaagtcactccaaagatcaaagactcgattcagccgtggctgccaaaatcagaaccacagtgggtgctcatcagcacggtgccctcagaaccacatgggctacccttgataggttagcagcttggggtgcaggccccgcatcctgcttagaaccacctgctgagaactggatgtgcacattaccttacccactcacaacatttgatttcaactcaattctgctctagtattatgtttattgaatgacggaagtctaacagacactgtaaaaatccaatttcacatcttatagtacccaaaagggaactgtgattttcctatatcagtgagcaaaatcttgagcaattagtaaacaagatcaccaatttctagtatttctatgagatatatttctttagttttctgtaaggagaaaataatatattggtaccttagtatccagcaatcttatattcatttatagggttatctcaagttaacatagtcaaaaacccagaagagggaaaatagagcccttgggaaatgaaaagaaatgccataaggtacacgctgttgcccaaatacatcattacttaccaaggagactttaatttggaaccaatttattcttctttaatacacagtaacaccagtaatctggaccctccattcatattacatgggaagaaaacactttcggaagaaagtacaatgatatctgtaagaaatgatggctctatctcagaatgaagaggagacagaggaggtgagggagaaataaaagtatgcaaagctaagaactatgtacagcttgcaaacatctctattattgagtcctgcagaaatcattgtggtaaagctctgcacaaaaaatagtgttcataattattatgggtttaattgtgccctcccaaaattcatatgttaaatttctaaccccaagtatctcagaaaatgaccatatttggaaatagggtccctaattaagatgcagtcgtaatggagtaaggtggttctctactcaagtatgacttatgcctgtagagaaaggggaaatttggacatgggcacacatacactgggagaatgctatattaaagatgaaggcagaaatcagggagatgccttacaggtcaaggaattccaacgattgccataaactccagaaactaagcaagaggcatgaaacagattccctcccacaaccctcataaggaaccatcccttctaatagcttgatctcagacttcttgcttccagaactgtgatccaataaatctctgttgtttaaacaacccaatttatgatattctattatggcagccctaggaaactaatacaataatgattatcaggaaatcatcatgtaaagactaaatcaagttcagaatatattgtttaagaaggttgaaaaatataagattcattgcagaaaacgaatcaatatgcttttgcagaaataaagcattcagtgtttgagtggcacaaatatcgaaacaataaatgatttctttacatggaacatatggttttcaatttttcctaatccaatgagatgttgccatctttactaaaaagacaaactgaaatatactctacagaacacgtcaaagaaagagtccccaacctccaagaagcattttgactaagaaggaagataaatatcaacttatttttatttgtttgtttaaaatacacagcctaatatggatgaaacggttacaaagagaagttctgggtaaagaagaggttgtctacttagaagaaaactactaataaatggggtttgaatctacataaaaattaaaaggcattcatccagatgagaagttaaagagaattctaagtatgaagaatggagaaacatgagaggactgaacaaagcaagagtaagagaaggtaggggcagaaacaacagcagagggaatatgagaaggctagctggtattgagagtgttatcaatctgaaatgggcacagaaacggataaaaaagcctgtagacaggtaagaaagacaagaaacagtaacattcccatatttaaacaagaagttgaaaacatctagtgcaagaattaagctctaatctttaaaacaggtgctcttaaatgcttttgcatgaataagagactgtaccttgatttttcttcaaaaggattcaatagtgggatggaaatgtgtgtgtgtgtgtgtgtgtgtgtgtgtgtgtgtgtgtgtataagctaagctgttactgcaggtaggtcaatgaagaaatacttcatggaacaggaagttatagcgttatacaatgtgttccctggagaagtttaaaaaaacacacacaaaatagccctatgaagtttgtttgctctgttaaatagctttaaaattctacccctactaattgttcttaacattttatttcagccaattatcaatttaatctgggagaagaaagatctacttgactttctgacagccaagtcaatccaactagaaaattcaaaccctacaagaaaactgctttgcaacatttttaactgacaacagaaatccatgataacataatcacctttttctttctttcccaaactcattctctctaaagaaaataaacaatggtacaaagatacttggatgaaatgaaaaagtgaagagagctattccctctttatggtaataggatgttcttgttcaagatggttaaaaatgtaacctgagttctttttcaattctctatagaagttggagatggtcttgtctacatatctaaagtaactgaattatatcagcaaatataagaattacagcttaatttcacccattttctatcttaaataattcataaattaattagtctctttattttattcattggaaaaatgttggcttagatgatgatattcaagtagggacccaaaatgttaaaaacgaagataaggaataggttttgcatagatactaccttttttcccactgatttctatggattttctattacagaaataacttctgcagagcactagtacttctgcagaacagagtaggatattctcaaaactgggatggtgataaaatgaataaaatcagcatcaagtgatgagaagcagatgagtaaaggaatatgccacagcactaaaataaaatgggcccttaattaaaagtccttgattaaattttaccttatgaagagaaatattgaaaagaaaaaggaagaaggagagatgaagggaggaaagatggaaggacagaagaaaggaagtgagggagaaaggaaggaagggaggaaggaaacagaaagggaggagggagggagaaaggagaaaaaagtgagttaaaaagcaagaaagaaggaaagaaaaaaaaggtaaagccattatagaggtattttctcatcctttccccactggctggccctctaatcttccttctctgcttcccaccccaatccaaatgtctgggacacaagtaggatagttgggaaaaaggggaaaaaaggaaaatttctttctccagctgatgctcactttggtaccaatagctctaactcaacagttccaagtgtttttaatctcatgtggtcctttgagaataaatgaaacttatcaaccttctctccaaggaaggggtggggagaaagaaaaagcatatttacaaatacatataaagtatacatttagataaaatataaagtatatttgcatacattttcaaagggcttatataaactctgaaattcatccctgcaccatctaattatccattagcttaatatgaaaaaccattggctctagaatctggaccaagccataataaatggttggggatagggatttggagaaatggaaatgagatacaaaacaaaccgagcaaaaacacacacacattaaaaataaaaaggtgttccttctctccaagtcaacccttaaggatctggctcttcattgttcctggaatttagatcaataaaaaatatgacttgaccaataactatttaattaataaaaatagataaaattatatagcaatatatataatattgtagcaattcttcatgttttaatcattaattctacattactccctgttaactgtctttgatagtgcactaatatataatactgccctgattttgaacattagtctaatacttacaataacattgaaaaccaacaccatttaatattgtgattagcaactcatcagacatataggaaattacaaggagactctgcaacagatacaacaaagcaaataaacaataataaactaatttcaatgttttaatggctatatgtaagaggaaacagaccttgccttaactgtactaatgggaattgtttatatttgtttaaaacataataatgtttcgcatagtaattcataatcttcaaatgccttaaagtatatttagctcatctgatgtgactatcaactctggaaagtaaataggagagatatcattatccttttttcataagcgagggaagagaggctacaaacgattaaatgacttcattaatatcacaaatctaacatgtggtagagcaaaggctagaactcacaggttctgatacccagtaattttgctaccatgctacacagtactcaaaaagtattcattacacatagcttgcttaggcacatgtgttgtcttactttggaaatgaggacaatagaatacaccctcaaatgagttgatacccatagcacttattctttcacgataaaattttattttggcacacagtaaaacagaaagtatattagctatttaacaggtgcaaatagatatttttgaacgtgtactgcatatcttatggatgatgtttgcatgtagtacgtgtccatgtgtggggactagtgtacgtttaatcattttgttagaaaaataataccgttgagttaagcctgtgttttattgttaatcatgcatttagtaacagcacaagttgacaaatcacttataattgctacatattatagcagcacaattcacaattgcaaaatcatggagccaacccaaatgcccatcaatcaatgagtggataaagaaactgtggtgtgcatatatatattatatacacacactatcatacatatatactatatacatactattccatcatatatatatgcatatatctgatgcatatgtatctatttgcacctggtaaatagataatatactttcaaatatatctatttgcacctgttaaatagctaatatactttgttttactgtgtgccaaaatgcatatatatatatatatatatatatatatatatatatatatatataatggaatactatgcagccataaaaaggaatgaattaacagcatttgcagtgacctggatgagattggagactattattctaagtgaagtaactccagaatggaaaaccaaaaattgtatgttctcctgatatgtgggagctaagctatgagggtgcaaaggcataggaatgatgcaatgggctaggcatggtggctcagacctgtaatcccagaactttgggaggacgaggtgggtggatcacttgaggtcaggagtttgagaccagcctggcccacatggtgaaaccctgtctctaataaaaatacaaaaattagctgggcatggtggtgtgcacccgtaatcctaggtgctccagaggctgaggcaggagaatcactttaacctggaaggcagaggctgcagtgagctgagatcatgacactgcactccagcctgggcaacagagcaagactccatctcaaaaaaacaagaatgatgcaatggactttggggtcttggaggaaagagtgggaaaggggcgagggatagaagactgcaaatatggtgcagtgtatgctgcttgggtgatgggtacaccaaaactcacaaatcgccactaaagaacttactcgtatagatcacctgaggtcaggagttcaagaccagcctggccaacatggtgaaaccctgtctgtagtaaaaatacaaaaaattagctgggtttggtggtgggtgcctgtaatcccacctactcaggaggctgaggcaggaaaatcacttgaacccaggaggcagtagctgcagtgagctcagtgagctgagattatgccattgcactccagcctgggcaacaagagcaaaactccatcttaaaaaaaaaaaaaggaacttattcatgtaaccaaataccacctgtaccccaataacttatggaaaaaaaaaagaatccacttcatgtagtaatatatgataagcacttagtaaatgccaattgttatgttcttgcctgggcaacttttggttgtcaactgagtagaaaaaagcgccatcttttagaaatctgtaattccttcttatctgtatgttaccttcattttcataaaaggtaagcagtaaagtgtattgtatcatacagtgatgaattttggaaattatgcataacattttaattatagcttgaatatcctttatctacaatatctgggagcagaagtatttaggagtttaggcttttttcggattttggaatatttgcattatatacttaccagttgagtacccctaatccaagagtctgaaatctgaaatactacaatgagcatttcctttgctcatcatgtccatgttcaaaacatttcagattttggagcatttcagatttcagattttcggattagggatgctcagcctgtattttaaatatgaaagacatgcacttgttaaggacttttgcagagattttactttgcaattatgagtcagcccatatatgacttctgttacgcaattgcatatttctcagaactctattttttttcatttgtattacttaaatgtttacttaactgggaaatagaagatttgttttttgttaaagtgcaaataaatgacaaaacaaacctaaataaaaaattagttgatttaaatactcaaaaaacccaaaatgcttcatgaataacatagtagaacatactttgagaaaaaaatataaacatacatatatctgacttcaactatcttgttagttgatttgtgattacttaattagatttattaaataactaaaaactgacttacaaatttataagcatatattcaggtttctgttgtaattaaagtaaaaaaaatagttaaaaatttacaatcttattgtccttatctttcctgtttttacttgggaaattatccttcttacttaaaaattttacttcctgtttttatctctgaaatatatagtctaatatgaaaatacacaagatggcagattgcaggggtgagctcatttcttccttaaggaaatgatataatagaaattataatctagtggatttacctgtactatatttctctcttaatattcaaagcaacccttccatcccaaataccagagccaaccttgaacagaattccaaagtgtggatgaaatttacctccagttcctcttccttatcccctctttgtccacgtttccttttgaccttttggcccttcctttgaccttatctaaagatgtatttctggtgttagaaagtgttagaactttcctcttcattttcagcttaaactgaagtctttatttaacttggattcctaactattgcatccttagcccatattaccaacctatgaattgaaatgttgccatctatctgaccaacctaataatgtcttgcatcctgctctcaataggtcacactctcttagataccagtgaaagacttgagatttttctgtttcctgcatttatctcagccttccatgtgaatcacctgtattaaaattttagtaatccccactttcggaggctgaggcaggcagattgcctgaggtcaggagttcgtgaccagcctggccaacatggtgaaaccccgtctctactaaaaatacaaaaaagtaaccgggcatggtggcacacacctgtagtcccagctacctgggaggctgaggcaggagaatcgcttgaacctgggagatggaggtgcagtgagccgagattaggccactgcaccccagcctgggtaacagagtgagactccgtctcaaaaaaataaaataaaataaaaaataaattagtaatctcatttctgattcacttgatctgggcttacttccttttcccagctgggctctctctatggttctagtatgctttgtagtgattaaaaggattaggataaataaaaccactgccataaaccaaaaaatttctggtctacctcaagccctaatggtcaacttggttttccctcgcccctagttattctgtttatcaaacagaaaataaatactctttaccaagtttcataacatatatattaaaaaaatctactaatagcatttagaaggtgagaattcatactgaatcttctacttctagatcaaaagcactagaatactcagagtactctagaaatgtatgatggaggtaggtgactcattcttttagaattcatctgtgggaggcaaaataattgcaccccaaaatgcccactgcctaaagcccagaacctgtggtacatggcaaaatgttatgttacatgaaaaagcgactctgtaaatgtaatgaaggttgttaacactaaaacagggagagtatcctagattatccaagctggcccagtctaatcatcttaaaagcagagaacttttttggctggaatttggaaaagaggtgtggtagaaggggaaatttgaaagatgtcaagtgtaataatgattcaaggtgctgctgctggctctgacatatagggacagcacacatgcaaggatctaaagatggttcccagctgatagcaaggaaatggagatcttagtcccacaaccatgaggaactgaataagcatgaaagtggattttttttcagagtttcctccagttaagaatccagccgacaccttgattttggccttgtaaagcctacagcagagaaactggtagagccaatctaaacttctgatctgcagaactgtcaaataataaatttgtattgtcataagctgctaagtttgtggttggtacaacagcaacagaaaacaaatatattatccaacatactatcccagtccaaaggccaacagacacattagtttaaaatcatagagtaaagaattgggacaggaaccactactatgaaaaaagaaagttcttaacactataaatacattttccccgatattccttcttttagtcatatcctcagagaaagtaaaatacctcgagactaaaggaaaaagaacacagggagtgtatatctactcaagtgcaaattgtcctcaccaaggaacttcacaaatgtgctcttcctcacaggcaagaatactatactaacagtgcaacattactcaaaccaactaaatccactctcttcaacaggaaaaatctgaaaagagcttgaaagtttataaaggcatgaagataatgaacatttaagaaacaatgaaaaaaagagaaagaaagtccaggcaaatgtacccaaaattcacagatcacatgcctactggggtatgttttgcctactatacaagttgtcttataatcatacctttaaaggaaattatcttcaaaaactatgattatttatttttatatgtcatcaccaaagctagtttttaaaatttatcttccaaaatgaattttctttcttactcatattttttacacagctagcttctggtcttaactgaacaaaggaatattggaagaaaggcagttatttccaatgattttcggcattgaagatttagaaaagttaacctttgaaaatttactcaacttcagaacctaaaactttttgaggtataactaccaacaacatgctgaaaacaaatacttttgcaatcgactagaaataattttcacagtaaaaggtaaattctcagcacgctgcacatattctactttataattatatcacagtatgaaataatatgaaagaaaataaggggaacaaaccaatataatgatttaaaattcttatagaaacaggataaatgaagttaattttatttttctgttgagatagaaaatatactgagctaaaaattactaataccacactttgaatcttcccttttgtcttccatggaggccacacatggaaggatagctccaatgacctgggtaagggcaatgcaggatagaaatggccacgtgagaaaatgtacacacattcctttcttttgaataccacattctgcttcctagaggtccctgtaaacttattaaaaacttcagtcattttgtaaggagataccataatttcaaggggctttgaggctcatttatagcaaattaatccccattttatgtctgtccccatttaatatttctaaagggggtggataacaaatctcgccaactctctttttaagggctattcagatactaaataaaccaggaacatttaaaaatacaatctcacaaaaatctgctttgcttaaccttctctccttctttaaaaaataagaaaggcatgatgttctttttttgttaattaattcattttagacaattccttaaattttcattttaataaatttttgtgtgggtgcattaattactctcaaagatgctttacaactgttacctattaaaagcctttgttagtgaataaaaaaaaagaaaagaaaagaaaaaacttccagcatgctcccttccttctctattctgagcaggtccttgctatcaactgctggagtatgcttgctttgcacctagagctataattattttgctttaattttacaaaaccttttgttccattcccacgagcccacctgatccttatattacactcgctctattaaaacactcatgcagaacaaagcatggctgtactgattcataagtaactttttttttttcctcagtaaaatgccactggctaggcttcgggacacagtcctgggcttcaccatcctatgccaattttcatatgttagaacaaaaaaaatatgttgtatcagagtgttgtactcttccccaagatccttcctttgccccacttgttttttgtgtttttaaacatattttatcttatacttaactttactctggggcaatatacatgacagaatgttgaggatggtggatatattaaaagattgtaatcatgttgatatttcttttattcatgtggttaaaattcttaaaaatgacttctgttgccttatttaattttttttttctttctccttactccacctcttttccttgagatcttgcaatacatgtgggcttttggcaaaaaaaaaaaaaaattgcagtgactcatcaagaaaactgtttgtttgctctgaggagcaccctgaggaccctctgggctgcacacggagccctttgatcctaggaaatttatttcttccagatgttttcccgacagccacctttctgcaatgtccctcttcattatgtagcataagaatactcaagacccactgctatggtacagttttcctgaatggagtgtgacagggagttgacatttgattgagctgttggattcttcttgccttaggcacaatgatggaggaaggttaacactgaggaaaggcagaactgggtctgttcaggtacagtgtctttaggattaggatggaaattatgtgaaccaggccaaagaaattatgtaaaatctacaaatctgcagaccattgatcatggacctagttttcttcaaccctgtaaaatcttgatgcctggatctgccatgttgttactcctccaattttttttctttttttttttttttttactaacatacaaagtgcggacaggaaagttaagcctttggacaactcttgttttttcttggcctggctgacagtgctagcggaaaggagaagggagaacaagggaagaatgcagagcaggtacaaaggtaaacatggtgtggtgggctgaataatgacatctcaaaatgtgtccacgttctaactcttggagtctgaatattaatttaaatgaaaaaaaaaaaagactttgcaggtataattaaattaagaattttgacatatggagcttatcctggattatctagatgggccctaactacaattctatgtatccttgtaacaggaagattccacatggacagaagaggccaacttaatgtgaccagagaagctgagattgcagtgatgtggccacaagccaaaaaacggtagtggtcagcagaagctgaggaaggcaaagaaaaggattctcccctagagcatccagaaggaatgcagccctgctgacatcttgcttctcgcccaatgataccgattttggacttttggcttccagaactgtgagagaatagatttctgatggtttaagtcaccaggcttgtggtagtttgttatagcagccacaggaaactaatacaaatggtaaccatttcaaaactccattgttcagagcatttgtgaaatcactgaagtctcaggttgaaggcacagtggaaaacaggatgccaaggcttgaagacaaaattctctgtggagatactggagatattaagggcacttataatctacagcaagtagggaactaaaacagggcaaagagagtgcacaagggcattcaacagaagattaaacagattatgaatgtaaatgttctaattttctaatgctggtttgcattttttatgaagtaggacaaatctatagtattttccatttaagttaatgcttacacacataatgtattaccagccattttccccctaaatcaattatcagtatcattaactttagtgacatttgatttggcaaatataaactatatttggcacatatatactgtattataaaaataaagatcctctatctgcacttgaggtaactttcctttagctattcaaagaaaaatctatttttaaggtttaacccaaagataatatggaacctaaacccaagaattcttaaatagatatattaaaacaataacttggctgggcatggtggctcacacctgtaatcccagcactttgggaggccgagggaggtcaggacttcaagaccagcctgactaacatggagaaatgctgtctctactaaaaatacaaaattagccgggcatggtggtgcatgcctgtaatcccagctactcgggaggctgaggcaggagaatctcttgaacccaagaggcagaggttgcagtgagccaagatcacaccattgcatgcagccaaaaaacacatgaaaaaatgctcatcatcatgggccatcagagaaatgcaaatcaaaaccacagtgagataccatctcacaccagttagaatggcgatcattaaaaagtcaggaaacaacagatgctggagaggatgtggataaataggaacacttttacactgttggtgggactgtaaactagttcaaccattgtggaagtcggtgtggcgattccgcaggggtctagaactagaaataccatttgactcaaccatcccattactgggtatatacccaaaggattataaatcatgctgctataaagacacatgcacatgtatgtttattgcggcactattcacaatagcaaagacttggaaccaacccaaacgtccaacaatgatagattggattaagaaaatgtggcacatatacaccatggaatactatgcagccataaaaaatgatgagttcatgtcctttgtagggacatggatgaagctggaaaccatcattctcagcaaactatcgcaaagacaaaaaaccaaacactgcatgttctcactcataggtgggaattgaacaatgagaacacatggacacaggaaggggaacatcacacactggggactgttgtggggtggggggaagggggagggatagcattaggagatatacctaatgctaaatgacgagttaatgggtgcagcacaccaacatggcacatgtgtacatatgtaacaaacctgcacgttgtgcacatgtaccctaaaacttaaagtatgttaataataataataataataataataataataataatacacattcaaaaaaaaaagatcacaccgttgcactccagcctcggcaacaagagcaaaactccatctcaaaacaaaacagcaacaacaacaaaaaacccaataacttaaaattggaaaagtccaatagcaaaattattgtgaccaaaccacccagtttatccctttctctagttcatcgttaaaaacacttggtagcagcattattaataaagaactaaaaatacacctgaactctatgattcttcttagctatatggcttttcaacaaccaaaccattaatcttcgtaatcaccatgaagctaatagatgtagactacagatacagataaagaaataagattatggaaagcttaaagagattctagatcaatcagcaaatgagaagaactgagaaaatcaagtagaaatgctggctgcgttctctagtacctttgaaaagctactagagatagaatccttcttttggagaaaatagtccaatgacagaacatgtaaaagatggacagagtcatttattttttgctactttcatattaacacagagtattcatttggcagtagttttcaaaacaagaagaacagtctatttttaaataaaattaaaaaaagtaactgatgattaacataactactgtaccaaaagaaagataacataagtcattcaaagtaccaggaggctaaagaaattctaatagttatccctatacaccttcatttcaataaacatgaaaaatgggaatctcaatgtgttgtcttttcaatttcctaataataccagggggactcaaggcagttcaaatctcaggacttcagaggccactgagttccactatctggggtgctgagcagtcgatatgaattccaacttcatactctccttgtctccttgttctatttgctttaacactatgtacacctaacttatctttagaaggacaggatgcatatcctttctataaaaaaactatgcagattttcatagtgccatataattacaggtactctttatttgtttatgaacccttccaacaacccaataggcaattgttaacattcccatttatcactatctcacctatttctgagttcctagagggttgagaacattcttttcctgttactatcttctcttagttctatcacccctggtaagaagttaagtagtaactagttgacatagaactcacggcaccgaagaatgggtggccaggatcagtgcagattggttcatttgggtttgtaacctttgtgataaattattgagtgctatagagataaaatataaaataatttttaaaaatcctactacaaaactaccttaacccttttagcacagattatgatcctgaaagctaataatctgtactgtgctataacaaatataagaggatgcctttagtatgataaagtttgctgtgatggagaaatggttgagataaatgggactttaaaatcaagagtcaagaacatttggaaagatatgagatacacttaggaatcttacaaatgaacaaggacttgtctctagtttcttagtcataatgtttctaagacacaaattaatcaaaatcccaggttatcagttacttaatataaattttccaataaacaccccttgattacacacttaggtcttcaaagtgggtagatttatacaattcccctctacacaggcaaattacatacacaaaaattatgaagttatttttttctttgaagtagtttagtgaatttttaaaaatctgtaatgaataaaaccagactttaaatcctgaataaaaccagactttaaatcctgaataaaaatgttctgtatcaatgattgtcatgatatgtgtcttggtaatagattattgcataatttttttcttaataaaatggtatctccatcaaacatgtagatcatggagtcttcccatagggacttttaagatcatgtaatccaatccttcattttacagatgaagaaacaatatgtgagtgttttaataaagcctactttaagtttttcattaagacaaaaatggttgttatatgaagagaaaaggagaaaaagaattaatagtagaaagttggaagtgaagagtgaggaaaaacagaaaggctttttcattggtgcagagcactaagcagagatgcattctctaatatatatccatgtcattgctagagactagcttaaatagtacaaagttggtaacatccttctcttttcttttttttgagacggagtctcgttctgttgccaggctggagtgcagtggtgcgatctcggctcactgcaacctccacctcccgggttcaagcgattctcctgcctcagcctcctgagtagctggaacaacagacatgcaccaccatgcccagctaatttttgtatttttagtatagatggggtttcaccatgttggccaggatggtctcgatctcttgatctcatgatcagcccaccttggcctcccaaagtgctgggattacaagcgtgagccaccacgcctggcccgtagtatccatttttaaaataatcacttagattataaacacgtaaacaatttagacaggtttacctctagggaatcatatgacttaccataaataagcaaacatattctgtattaccaacatgctaactgttcattcatttacactgtatattacctctcacttccccagaatatgcaagttgaaggaaacataacaaccattgtaaaactctatcttaaaataaatattattctataaagaaaaaacaaacatttttaagagtcatataaaggcaaattttaatttgaagacttgatactaaggaataaatatatatacctaatatgtattcacaaaagttaaaaactaatttttttaatgtaggctgtggaatcagactccctgggactgaattttgattttgccccatccttgaccttgggcaaattttttctctctgtgcctcagtttcctcaccagtaaaattaggataacaacagtgactatttacaagagttgttgtgaggatggaatgccataaatttacatataaatcttttagaacagggactggcacatagtaattaataaatgttagctgttacttctaatatgtacaagcctgttaaacattttgcaggggggagataaggtgtttctcattaatgggacttgttaaggcattttgtctttcaaatggctgcctaacttaattcataccaatattttatttcagtaggattaatgaaatagtatgaggaaaagccttagtgtggtttctttagacatgtttgagacagatattctcatccttttaaggggagtaatctaaaatgctacacccatttgtggcttaaagtaactgagaagtgactctcacaagatgacatgatttagctgtgtccccatccagatctcatcttgaattgtagctcccataattcccacatattgtgggaggaacccagtgggagataactgaatcatgggggcggtttcccccatactgttctcgtggtagtgaataagtctcatgagatctggtgattttataaggggtttcccctttcgcttggctctttccttctctcttccctgctgccatgtaagatgtgactttcaccttccgccatgattgtgaggtctacccagccacgtgaaactgtgagtccattaaacctttttttctttataaattacccagtcttgcatgtctttattgtgagaacagactaatacacaaggcaaaggagaaaatgggggagcagaagaggcttagcaggatgcatacatcttctgatatggagaacatgaaagcactcactgaggaaagtggaggtgctggctcttcagcaagcaaatgctccacctatatgctcccacagtatcttatacatgtctcaaagcctttaacctgctgctttgtaatgatttgtttacatatacttttttttgttattatatggtcttctacttgaagacaaaaactgtcccattcacttttgctcagtagttgctcagtggcatatttctggattgaatgacttagttaattaataacagttactacaatgggggaggctattgattttaaagcgagagctaagactcacaggttctatccaatggaggggcgtgttgaagtagaagtagctagctattatggtactgacaatggatctctgatctctgtgctggggataaatgctctaagtgagcatgaaatatttttgaagtttatacatgtgtaagttttttttccccttaaccataataactttcttttttaaaaatgcatgaatatttgagtaactaagtgcaatgttaatgttgggtgcaaatataatctgcctaataaaccatggaaaaagcctgaaaataaattcaataaatagagtcctagataatgtgttgtgggagatgagagaataagcaattaattatagatggtggaattaaggtaattttagtagagaaggtaatatttgagcaggatcttgatgcaaatactaaatctaaatctgtgaaaatagagcttatatccttaatgtagaaactggctgatatgcagagataagttgaaagtcctgtgaataggtgacataaacatcaaaggtattcctaattcccaatatacttgaaaaattggctattatttgatgcatatatccctgtatggcaatcagtccagtaaataaaataataataatgtcctttaaaaaattcatttattcatgaatattcattcatccattcactctttcaacctaatgtgataatctactgaatatcaaattccgaactgtgctgagtacattggaaaccacggtggtcaagacagaataaagtctctgcataagaagtaggttcagacaattaaattaataattataatgcaatacatattatgttaggtaaagtactacatgttatggaaatatgtaattataagcaatttatacttaaactcattacataaatatggcagaactatatttggataaagtgctggtggtttttattgaccttgaatttcttctgatttggtcttgtttacctacagagtagactgccacatctgggtcttacttatactgtttgctattcaaaatcttgcctcttgaactacctatttaattatggattcatgaagcacaaatcaatttattttcttaaattccttaagactaaacatggcagcatttttcctactccagtgtttctcttctgttaagatacatcttttggccaggcacggtggctcatgcctgtaatcccagcactttgggaggctgaggcgggtggatcacgaggtcacgagatcgagaccagcttgaccaacatggtgaaaccccgtatctactaaaaatagaaaaattagctgggctggtgacacgtgcctgtaatcccagctactcaggaggctgaggcagaagaattgcttgaatctgggaagcagaggttgcagtgagctgagatcgcgccactgcactccagcctggtgacggagcaagactctgcctcaaaaaaaaaaaaaaaaatacatcctcaggaagatgatggtgatgatgtatgaaactgaaaaaaatatgcttagttttgtgagattagatctacagggctgagaagagtaaaatcttgtttggactagtatattgaacaaaaaccacataggagtcacagtggaaacaattataggcaataccaattcttatcattttaatgaggagaagttaaagttggtcttttcgttgtggttcttaaatgcaaggtataacctatagtccataacaaatttttctttagaaattatcaagtacacagtgggttttctttagaaaccacaattctagattttttaaagcagaaaatatgctgtcctccttcattttaattcttttggaggaatagaactttttttttctttctatagttaactagagttgccacaggcaagaggactaacagagtaaaatactaactgatccaatatatactgcatttatctaactggatttcatctagctcaacatcatggctttgtagtctaagcagtagatgaacagaaacaataaactgggcaagtaatgttttgtgtgaataacagaaaagagtgaacagaaatataacacttcaccattgcacaaaatacaattaaatatgatttttaaaaacccagccactgatccactgcccaatcataaaagaattgtaatcagttcaagtagtcttaaatatagtgaaaatgtcctcaagatacacagcatgagagaacaaagagttttcactatcatctgctggactcagggaaggtgtgctatgtggttatcatttgagtgctctgtgtttaagttaatcaatattataaattatgcatgtattttagaagttcataatttctattaacttgtaaagttattgaaaagaaggatgaataaaccatactacaaaaataagaatgtgaataaatgccagtttttcctcagattacagatgatataacatcgctgctattttaagaaaatgagactggatcagatgtgaacatttatcccttctctttaggatagcctatgaattcaacacattgacactaattataacaatagctaacagttaactggagtactaaccatgtgcaaagcacactgtaattatttcacatatattatctcatttaatgctaacaacaatactatattataaacaaggaaactgaggcaaagggaagtcatttgctctagatcaccagggtagtaacgggtggatgtaggattcaaaccagacatactccagaatccatacaatatcagaatagtctgaccccaaaagacacacacacacaaaatggatctaaccaataccttgggaacatcatctaacttttctgggctttagatccttcagctgaaataggagttgacaaaccttttccaaaaaggataaaatcttaaatattttaggctttgtgggtcaagaggcaaaatcagagatgtcatgctatttaggtaattatataattggagagaaaacttgctgtatctcagccagttagatgaaaaacacataatacaacaggaaaggataatcttcaaactattaaattatattctctttgtacgtctaatgtggagacaaattatattaagaacacggtagctgaaataaaattatttcagattagcacatcaggtgttgaatgttatcagtggttatcttagggggtgacagaagaagattttagggacagagggaagttttttcacttccagttaaaatttattttttaagtggtggaattgattgttatttattattattatattttactttgtgttttggagtagttttcagtattttttcctggttttattgaggtaaaactgacaataattttacacatttaatatgtacaatgtgatggttatcaaatacacattaccacggtcaagattattaacatatccatcacctcatatagttaccattgtgcatgtgtgtgagtatgtgtgtgtgctgagaatacttcagatcttactctctgcgtaaatttaatggatgcaagtcagtattattaactatagtcactatgctgtatatttgatcaccataagttattcatcttataattgaaagtgtgtaccctttgacgaacttctcctgatatccctgtccccagctcctggcaatcaccattttattctttacacttttgaaatctactttttttttcttaatttaattttaagttctgggatacatgtacaggacgtgcaggtttgttacataggcaaacgtgtgccatggtagtgaacagccatgttttcaatacatcacaagccatagtagtgagaaacaccatttctttttttttcttttttaattattattatactttaagttctgggatacatgtgcagaactttcaggtttgttacataggtatacacgtgccatggtggtttgctgcacccatcaacctgtcatctacatcaggtatttctcctaatgctatcccttccccagacccccactccccaacaggccccagtgtgtgatgttccccttcctgtgtccatgtgttctcattgttcagcttccacttatgagtgagaacatgcggtgtttggtcttctgttcttgtgttagtttgctgagaatgatggttttcagcttctttttaaaaagattccacataaaagtgaaatcacacaaaaaaaggaatttcagaaaaactaaaaaattgaattaatatactgtcataggaaaaaacagaatttccaagaggagtgggggaaaataatagtatcagaaatataataataatagatctttttcctgtggaaaatagtacatagaaatagaaagtactgaaaaggagaatcagaaaagattatggctccagaatcacattatcttctacagtttgaagaaaaaaaaatgtggctaaaagaaaaaaagtatttccattacacaccttttataatgactagaataaaaaaatactaatatcaagtattgacaaggatattgacaaggatatggagctactgaaactcttatacattgccagtgggaatgcaaaactggaaattacccaaatgtctttcagtgaattaatggtaaatgatcttctgtatatccatacaaaggaacactacttagcaataaaaaagaaacaaatcgtgaaacatgcaatgatatgaaagaatattttattttatttttttaaagacagggtctcactctattgcccagactaaagtgcatgatcatggttcactgcagtctcaacctccctggctgaagtgatcctcctgcctcagcctcccaagtagctggaaccacaggtgcacatcaccatgcctagtcaattaaaaattttttttccttagagacagggtctccctgtgttgtccaggctggtttcgaattcctgggctcaagcattcctcctcccttggcctcccaaactgctggaactccaggcatgagctaaccatacccagccatgaatgagtcttaatgcatcaagctgagtgaaagaagccagtcttaaaaggttatatatatatatatatatatatatatatatatatatacacacacacacacacacacacacatatatatacatatatatacgtgtgtacacatatatacacgtatatacacatatatatacacatatatacatatatatccatttatatgacacgtatacatatatatccatttatatgacaactcttggaaagacaaaactataatgataaaaagatctgtggttgccatgagttagtggtgagaggatggataaaggaagaagttcttcagtgtgatggaactctttcatattctgatagtggtggtggtgcttgttacataaatctatatatatgttaaaattcatagaactgtataccaagaagtttattaatgtcagtaaaaatattcaacattttcagaggaaaaaagggagtaactgattacatattgaattattggaaaatacaggctcaaataaagccatggtttctcctactaataagataatttggtaagagataacactgttgatgaaaaagaaacctgcagttctacctccctgccattagttgaccaaaatgagaatgtctaacatagctacaaatttaaataattctctgcttgtttaaaacatagtctctaatagttcattacagtcattactgcctgttaatcaaggataacactagtatttgaattttgtaagtatgacagcaaggtaaagactgttacttaagccaataaattaccatatttcataaaaatctaatgattctgtgaacagactatgtagttcaatttttcttctaaaccctgtaactgcaatgtattttcactgatatttttaaagagttttcaaaggtacatttttttattgtggtaaaatatatattaaaaattgaccattttaaccatttttaagtgtacagttcagtggcattatgtatactcacactgttatgcaagtatcaaaaccacctccatctctagaacattttaacttttccatattcaaactgtgtaaccattacataataatcccatttccccttcctcctagcccctggtaacctctattctactttctgtctctaggaatttgactatactaggtacttactcggcacaatgcattaaagttttatccatgctatagcatatgtcagaattttatttctttttaaggaggaataatattccattctatgtatggaccacattttgttaatccatttgtccattcatggacatttggattgttttcaccttttggctatcaactgtgcattccttttgacattattgtcagccaccagttttttcctcactagtcagactcaagtcatattctgacactctttaggaatataggacatttcatttacaatagttaggtttaaacaggatgtattcatttgctctcacactactaataaagatgtacccaagactgggtaattatttaaaaaagaggtttaatggactcacagttccacatggctggtgaggcctcacaatcatggcagaaagtgaaggaggagcaaagacatgtcttatatggaggcaggcgagagagtgtgtgtgtaggggaactactctttataaaaccatcagatctcatgagacttattcactatcatgagaacagcacaggaaaaaccgcccctgtgattcaagtacctcccactgggtgcctcacacaacacacgaagattatgggagctacacttcaagatgagatttgggtagggacagagccaaaccatatcaggggacctttcaagtttggtcacaaggtctaattaattattttcatgcataggatctaaagagcaattgtatatttatcaacttatgtgttcaaatttggtcattagcttaacatatgtgtttgtatgcatgtcacatgcatatctgtgtgatgatacatagagctgtattatgcataatgttaaagctttattattgtctggttagagaagcagtcactatccagaaaaatggtttccaatgtgaagaagcatgttaaatttgacttcactgaattgaaaattttaagatgaaacaggagttgggttcctataagcggttagcgtgcaactagactccatcttttaacaaccaaagcagaacatctgggtgggtccaatgcattaacattttaaaaaaactttataggttttaatatgcagctagaattaggaacctctgagacaaaatgatcctgagttgggggagctaagagtaaacaagtgaaggtaattttaaaagccggttagggcctggagcatactgagatgaagggaagagaaatttagaattataaatagcaaaagatccactcaagctagaaaagattaagtatccttttagagttaagagtagaagaggcatcagttacaaggataattaatatctagattataaggatctgctattataaaacttatactagaacaaaagtcatgaaaatggtctgcggaagtcatgaggtgagaagaagataaacaggtaaatatttaagcagattatagagttctggaaatgtcatcaagtctcttgattgtgtatatttttgttccatttaaacacttgtcctgaggtttataagtgaaacatgatgtaatttatcatctaagtaaacatttatcttatacaccaaagcacggtgaatacacacacacaaacacacacacactcatacacacagacattttcattaacaagaactagtaccaactacagctcaggaaatatttgttgattaaatgaatcagtctgcttacagtatgcattttcttttgtgctgcagaagttgcaatacaaatgaaactaaaacttctgtgtgctgattacttttctcagtctgcttatctgagaattaaagaatttttaaaacaattttatgtattaatttgcaaacttctttaataatagatgttcattgtaactggtgaaacaataaaagctatttaaagaaaaaattaataatctttcctgattcctttttttgttcccaactctgtgaaataaccaatgtgaagaatatggtatgaattattttctatagctttcttcatgttcatataaacatacgcaacatatttattcataaatactcattaccctgaaaattatggtcattcttccaggttaacagctatagatataattcattcttttcctaatggctgcattatcttcaataacatggatgaatcatctgtccatatcatatgatatgcatgtagtccaattcaagaaatcagtatactttttttttttttttttacaaattttactaaaagtattactaaatttttacacaggatgctcaacaaacactgaagacctatctggtaccagctttggtgaccaagaaagaaaatcagtgaggtactcctggttttttgccctccagaaagtcactgactatcataggggagacataacagtaagttttttttttttttaatttgagagaaacttctcagagaatttatagtaacaaatgcttttaaagcaactatttaaaagaagtaatatatcactagcaattcattcttcattgtttccaatgcatgatcagtatttagtagcaacagaagacttccctatatgatgactcaaaaacaaatttccaaccactaagaactcagataaaggaccttactcttgagacctcaaagtgatttacatttccactagtacttctattgtaatatatgatatttataaactagccttattccatggaactctaaatatttaatgcttcacatatatcatttgacttttctgcatgtgtcattaagataggagaaagtgtcccctacagataaggaaaatgatgttaagacaaaactgacaacacctgaatcaagtctccagatagccccatactctttccttccaattatacttgctgccttgctagtggtaagcaatgataacgtagacagtattatgtcatcaattagagagtctcacttagcttgatataatcagtttttatttaaaaatgagagctttccatgcaaactgtttttctatcttctaaaaggcttgtgactaaaacttcactgacaagtttttcaggtgagatgagtgtaggttaactactgagcagccagagtctagtcaggcccctcacactttccagtgctacaagaagatgagcagatgtggggttagatgtggaacccaggttcatagctgtacctgccaaccctaacctagagaagggaagagaacactgatggtaaccatggcaacagtaacaatgctacacatctatcacttattgattatctaacaaagtcttaaaatatcaagtaatgtaagcaaagaacaattcagtgaaattttagcaaaggttaggcaaattttatatggtcaagatagtacatttgcaaacaagtagaagaccttgtcaaaaatctaaatcttctaatatccagtaactctcttgtctgagccaatttattttcctacatctttgaagacattttattaaaaaaggttataactgagaattcgacagtaatcagaagagtgatcttcattctgtattcagtgtctcttgaccccctgaaagaatctcagctcagcatggcttcctcccttttccagttgactcagagaacggtgctttcaaattgccttttgggatacatgaaggggtgcatttagagccaacctgaagtgtaacactctttattgttcctgagaaacgtgtgcccaattccctagaaatttactgtttcaaagagtcacaagctcctgattgcttctcatcagtcttgaagagattagataagcttcctccctcttacaaaagctttttcttcattcaaaattcctttgagaacaaaacattgaaccagaattggatttttaacaaaatattataagattgttgaaaacatttttttttctcctgaggagaccaaacaattcaaaagatatattaatgcacattctgatttagggctactagcaacatattgcaaagagtaaggtggtgccaaagaacaaagtcccttctgctaagcaggaaagatattttttaactgccttactttagaagatttcaatggactgctaagggctttcacacagataatctcagaagtcaaagctcaagaagtagggggaagaaacaactactggaggaccctaacaggtagcattgcttctaattaccgtaaaattgttatgtatactgatgccccacatcccattcccagactcagataattattctacagtaagagttggctttagaatacttgttcaagtgtgtcagtaatagaaaatgacctcttcagaaatgggggtgtttacatgcagtgctcctaaagttggcacacatggaaggtaattcagggttatgtttgcagtggcacccatcatcagcaatgtttcaacccccgtccatctctctgtcctggttttaccaagggattcacttcaaatgtattcctcactggtctttagaaaacagtgctagcaattcataagtatgtttgaattttcaaagtttttctttttctttttctttttttttttttttttgagatggagtcttgctttgttgcccaggctggagtgcaatggtgcgatctcagctcactgcaacctccgcctcctgggtttaagtgattctcctgcctcagcctcccaagtagctgggatttcaggaacctgccaccatccccagctaattttttttatattttttagtagagacagagtttcaccatgttggtcaggctggtctcgaattcctaacttcaagtgatccatacgcctcagcctcccaaagtgacgggattacaggcatgagccaccgtgcctggccccaaagttttgcattttgatagcagcaataaggctgagtaccttcataggcctttacctctgatcacactataaggctttaattaagttagtcttaagaagaaaaatgtacaccaaaccccaattattaaacattggaattattccttcttattggtctaataattacaattttttacttctcattcatttttcaaaggtttttttcagtagatctaggttattggaacgattatatgtgatatgatggggtattgggcacagacacagtaaatcaagatgatgcagaaatgaaagtctaatgctaaagatcttaccaatcttcccagatccccatttttcaaaggaggaaatgtatagaggacattacatttatttccagccattatgatataattataaagccaacctctcaacgcactctctctttttgggaagtctatgacagcaggtattacaattctactttgccagatgaggtgcgtaaaccatagaaaactaactagcatccaagagaagaacagacttggatgtgggtagaataataggaagaacacttacagtcagatatatcagagtatgaatgcaggctcaagcttttttccactaaaatgtatacagcaatgtaatctcactgagcctcagtttctgatactgtgaactaaagattatgacatcaatctacagtcaatgctgtgagaattaaatgtgaagagttttatggagagggcatctgctaaatgtaactatttttcttaccctcctaaattttttcagtcttttagacatttgggctattagagaactaatgacctctgtgaccacactagcttaggctataactaaatgcaacagatttaaaaacaccaagcaggagatagcacagagtttgaatcagtgaggtctaatagtaatacaaacctcacttactggctttgcaattttagatgctacttaatcgttctggggctcagttttttcattataaaatgggaatggttcctactttgctgggtagttgctgagtgtggtagcaaggattacagacaactctttatacagtatctggtatattaggtaaatggattgtaatatatattgttcagattttttattaattaaggtttgtacatagactcatctcctgcacttaatatttctttttctacacaagaccttgaaagggttatgataggggctttgatcacatattagctggtttggctgtggtaatttagctcctgagtattgggattacagtaccagcccctgccattgactatttaactatgacttggataggaattctaggcctgaattttgttcgtctccaaaatgaagaggttagaataaataattcctaagattccctgtcgctataacattttctggttccagggtctttttactgagctatagcagataaatcctcatatctttagagcttaagctacttctctatggtttaatttccacattccctctactctatttcttctttaattgcaaaaggggataatttccatcactttgcaaacaaaccaatatctctattctggcttagtggcataccatgttattaatgcatcatacttaaaaaaagcctggattgttcttcaatccagaaatccagtcatgttgtaggtagtaataatgagaataatgatgatttattttcaaggttttctatgcctccaggtgcccggtcattgcacatgataaaatacaccaaaattaaaaatgagattaaggtttaacagataaaaaatacattctaggaacaaaacacatttttggtatgcatctctacattacacaacagccacttaaaaataaacaaaaacaagaaatccgttaaccaacaacagaattttaataattattaactagaaagaaaataaaattaacttgaccttatcttagaaggttgtcagagatctactctgtttatgcaagtgagaaatatgttttgaattataagacctctatttcagaagtccaagctctcctcaaactcagaggtaaaccttcaggaaggatttaaaataaatgtatggattttgttagcatgtgtatattatttacctttgaattaattttgatcttgtcctattcttgagctatccttcaattggtatttttgtgtgtatctactatgtgctttcccactgcattcagaataaaattaaaattcctcactctggcatttctctgaccacacctccagccattctgctttgctcactttgctctggccactctgaagtccttttagttctttgaatacagaaagtctgattcaaagctttgcatttgaatacaggattttgtatatgcagtttctgtctggagctttctcccctcccatactccgttctctaccccaaattcttcacctggctgatattattttctgtccttcaatgttcaaatcaaaggacactctctctgagaattctgtcctgaacacccaaaggacagtataagagatttcccccactcaatgttgtcttgcatacataacactttatgtggaccacagcttgtaatgttgtaattatgtttgcacttattacatgtctaatttccttaggagactatcaatttcatgatgaaggtctaagggatcatttctatatttctactattaaatatagttgaataatgaatcaatgattctattgtggtagactcagtagggctaagaaatgttaattaaatatggactattcccttaaaattttgttttctagtaaaggaataaggcatacacataaagtgctataaaatatagaaagtaattcctgtctcaataaaagtgtagatgagtattgcattagtttcttagagctgttgtgacaagctaccacaagcttgttggcttataaataatacccaatatttattatctcacagttttggaggctacaagtccaaaatcaagttgtcagcagggtcactacaggtggtaagtaaatttgatagttaggggagagtggattgtttctgtccaggtcaaggaaagaaggattcatgaaattcataacattggaaatgaacttggtaggatgggttggatttgcatatgaaaaaattgaatgatggacattccagatgctggaacaatatgaataaaggtgagtaagagaactcggcctgagtttatagtacatacaacccggtaggtgacaattaactaagaaatgggatcagagttagattttaggatgtcatgtatattgattagggattgttatacacagaattattgaaagttttatctgaacaaaggcgacataatcttagtactcctatattaggaaagttaatggggcagcagtgtttaggataaactgatctccctgctccatctctttcaattaggagatttttgtaagcaagagaagataaaatcctgactggaacaggtatcaaagaaagagaataaatgagacttggccacttactggacatctaggatgtattaagaggaggaaagaatgatatattttgagtaaagatgtcctagagaattggagttagagaagctaggatagtcaaaagcaggatggtttttaagtagaagaataaattaagttttgatatgctgactcagagaaactagtgtgatttctagttgaagatttaaataaggatgttggaaatataggactaaagttctgaagacatatcaggactggagatataaatttctgagttatccatagtgaaataattgaagtcatgtaactctgagaagctgtgtcaagtcatgagaagagtatgaatgtggagtatgacagatgtgatcacatcctgtgtctactatttacctgttgtatatcctggggcaaattgcttaactccaccattttctcatatataaggaagaaaataattttatcccttaattaggattacatgagttaaatatttaaaagctctgtcatgtttaagctgcttttatattttggtgcataattctcataagaaatacacttattttgccatctagtatcttaaaaatatgtgatgtgctttaaaaaatatttattttcctgtgattctagtatatgtgatcttttaaactttcatgacctactaatgcgttgcaacccacactttggaaaactgatcctcccatacattatggttctcatccaattcctcctctagtcactgtccccaacaagcattctatgttgaaatcacaccaatactatcaatgttctcctgactttcatttattactccctcttcataggcttcttgctagtatcacattattccttcatggcctagaaaaaaatgataaccatttacttcctctgctattccatataatgttttgtctataagaaagatgcgattttcccagataaattatgaattccttaataacagaaaatatgtgttatttatctgtgtatcttggtaaaatattttgttataggaggcacagaacattaattcattattataaaggaaagggagaagaggtttgaagagagaactttgttgaacatctacatctaggaccctgctctggtatcaccatgtctcgattcctccttctctatatgccaaagcttccatggaatttttaaagggcagaactattgtctctttgtctttgaggcacaaagacttaaggccactaactttcagtacatggtggagagagggaagacctggatgggttaaaataaaggaagaaactagaaaatgtccagaatttagctttgggtaaaataacaggtttttaccgtagcctctttggattggtaaatgacagaatccaatgaaagcaatgtgaaacaaatgaccagagcaagtaattcattttaaaatattaaagcttatttctttttttttctgactctggaaaacttttctctgatggaaatgacccctggcaacagtgacattctgacaccatgcgtcgtacacacccttgggaagtttgaattccacaccactatggttctgttcagattactggtttcatcatgtctgtaagcccaattaaactactgaagttctaatggtcttatgtccactttgtaaatcatcataaagaatattaagtcaaccaaataaatttgcctctacaggactcgttgctcaaccaaaggcatgatactaggaacaaaattaaaaaacaaaaaaacaaaaaaaaacacacaaaaaaacctcttttgataacaaccaatgttttcaggatactcctttatatatgaatttgagattctgatgaaggggactacaattcaacaagtctcaaaaaatgagcccaaggcaatttgctcctcaggaaacattgcttagaccctgattgtagtggaaagattgaagcctcagattgtaaattcagatagactatcacgtctaggtctctaaggatgatctgcgatggtggtcaatatggtttgtgtaacctttgtgccctaccctgtgcctcaatttgcttatttaaaaatgaagtcactagactttgtttcttacatcctttcccactataatgtttggtgatgctctgcccttacatttgcctaaacttttcaatcttaaaatatataaaatgtttttataaaattcttttatgtccttaaatgttattgaacatgataacagtagaattcactaagcctaaatttcatcattttaatattgcctcagaggtcaagttttatgagagccttaatttgcatcaccagaagctcatttaataaaaatgaaagaatcccttttggaaataaattttaaaaactgatggtggggaagaggggcagataaatgtatgtaaaaaagaaaaaaaaacaacttagaaggtgtcaaatggttctgagttctaaagaatattgtggtcatattagtgttgaaaagttggtcctagctttttatgcactaaaagtacattctgctaatggttccttcccaaatccctggcctcttgacccaatacttattgtaccacttgtcccatttccctgaaacaaaatctataatatggcaagacgaactgaggtatcagagcatcatctaccctggaattgggcatatttatttgtggagttgattctagtgtgtgggatataaaacacacaacttaagtggaaaaatgctgaagaccatttcataggtgaaaaggatgtggtatgaatggtcaattctcactttggtcaggaaaaagaagtgtaaagtcaatgaggtaaggggctgggagatggatacctcgtatgatatgataagcagaaaggttgtgtttggcaaattcctttatcatcttcttcctgactgtcaaaaactgtattcaacctgtgtttacaataaatattctctgacagaatgaaccctggatttctgacttttaaaaagttttgaaattaaactaatagcagctatttcatgattacctattattgtgccaagggttagaaattacaaaaatgagtaagaaagagagagcccctgctcttagagaccttactgtctgtgggtttgaactgttgtagttatgacaacaataacaataactatcatttattcactcataccagccaggcaccatgctcagtgggcaacatacacaaagtgccaaagtctccttcatttcaccagatgcaatcacagtaaggtaaccttgctctgtccgtgcatcatcgcttaacaaaaatgaacttagcaggaattcagaccataggcagagacatataagcaactccagaactgtctactgtcaacacacaagaactacagtcaataaagagtgcaatgaactacagtgaaaatggaagcaattgtctgaatcacctttagtgtactctgttgactgggggctgtgacactctaaaaaccacgatacagtagactccacatctggcattccaacaatagaagggtaagtgttttaagactcttagcgaaagaacttgcaatacattaaactgtaaaactgaggaagacatcataagcttctggattttattaccaaaatgtacattttgatctaaaattaaaaataaaaacagattgactttccttgtagtatttcacaacctttgagtgcagcattaaaaatgcttttcttttttttcttcaccaactataagcttctgttttcttaccctgggcgtctgaatcttttatatgcttgggttctattcactgcctgttattcagacgttgaaatcccaaatgttaattgttcttccaagtacattgacaaaacagcagctaaataagggtagaccagactgtggtagactctgacatgcatttatggaacaatggggctctgagagacagccttgtagctcacgggaagacataagatgtgctattttgactgcttcgtagcagaatggggaacacacgcacacaagggaattatgcattttacttagttttgcccaaagtcctcaaggcaacagaatcttgtgatgtcatcatgaactttctttctctccatttccattgacacaaaggctaaaaatttctaatgacatcacaaaggaaaatgaaatctactttgattccaaaagaaatcttttaccttcagtgagactagtaaaaataaaataaaataaaataaaataaaataaaataaaataaaataaaaaagcaagaatctttccagacagggtgtgtgtcactgtgctcatgcacagtgggtgacaccctccctaatgaaattcaaaccagccaaaagaaaggattcacaatttaggttggataaaaaagacatactgaatattgagaccaacaactttttttttttaagaagaaaatcatttaaacatatatttcttcagggacattcaaatttttactcatgtctggttactatgttaccaatgtttttgtccttttttgggttggtcacagaaacacagaagaaggtacagaaagctttgacttacaggaatacagtgcagctcaatcttttgtttttaaggtgcagtgatttcagtctctaaatgtaacttcaggcagtctgaaaagaaacaggttaaaatctctttcagttataattggtatttcagatttaattaaaaattaaactttcataatgtttcaccatccaaagcaatgcattatcagtcaagcgtggcttttctttttttcttttttttttttttttctgttaaggaaaaaaaaaaaaaagaaaaaaccctcttcccagagtagttttttaatgaaaagaaaaggatctaaagaggagaaaaaaagcaattctgaaaaacaaaatacgcctccatgttaaggacttcataatgatatgactagaaactcaatgtttctgaattttagctatattctgattaaaaaaaaactcctaaacaatttctacagcctaaagattacagaaaatattaagttcagggaataaagaagaaaatctatgggtctgaatacacatattaaagggaaattatgacttcaaatggaattgtaagaaatgctagatctcctactttccagtgactgaattgctggtgaggtagatggtgaagaagggctaaataaacatatttaacaacacaaaatggccattgaaatgtactgtattatgggtttagcgtgccccatttcacatcatattgtacatcttgtcacatgcagccactgctgtttgaagcagcacaggaagaccaagagagtctgaacaacactccctggtttaagtaactgtaagcatgttgcttattttttaaatatgtacttataattccaaattaagtaacagtccaggcattaagagctccaagtatataataaatattaggcttaaaatattatactattttttgaatcatttctttcttcaaacaacaccatctataaataatagtattttttaaattaaaaaaatcacatcacacactagaattaaatcatccttacttttagctttgaaaaactgatacaatgggatttagaaaaatttagtttttaaaatataaaatgaggtaatataattcgctttcattcactttacagcgtggcagaatactttctatatatttataacactaaatgtcatatgtttacatccaatttcacattagtgcaaggtaatattttaatatttccccatatgagagcataatcacaaatcaccccttaaattgtactattattagaaagcatatgtagttcttacttgggattcctgttttctttttctcttgaaatgtatagaggaatattttgggtaattggtctatttgatgtacatagattttaagcgtaaacatgctcaggttcacagtaaattcactcatgaatgagattagatttaaaaaaaatcactgacattgactaactaaacttttccccctcctctcacatgcctgaattaggctaaaaatgaaccagcgtaaaggcagaaattatggaggcgtcaccagggacaactgaatgagaggaggggagtgcacattatttccttataaggcagcaaaatattcataaaagaaactgacaaaaataacttgtgctcagaaattatgagatataatataaatatattgaataacaataatctctgaaaaatgattcagaaatttaaaactgcccacctctggataaatctaattcaccaactggcattgttctactcaccaacaaaatatggttagcgaaacaaattcattctctagtttagacgtgaaaaggtgatagaaactaggctgaatatttacatataaacatataactaacaactagtaattcaattcattcagtcaggtttccttctcctcaatttgccagatgttgaatgaattgaactatcagctcaaaataattaaatcaattatatgaatagatggtcagtgtaccaattttcattccccccccatgccatttctccttctcctctttgatctttttcttctatttctgcttgtttcttctccactttcactttctttcttattcctttttccttcttttttttttttctcttggtgagggtaatgaggctcaaaaataacatcttgtatcctgttgagggaaacttggtcacaactatccttccagatgacaaactcattcttaaatgtctgtttcccaatccaaagaaaacagagcaattgaaaaaatagagactcaacatcacttacaactaccaacaccagccctcttaattcccatgctgtactactcatcacgaggagaactgaaatttatttacattatacctaacctcaaataggaccacaaataagactaataacaggaccattttgtggcactcaggcaaacggctgggcaaaacagatggatcttactttgcgccaggactcaaaaaatatagtcgccaactcactgttggcgactacatatcttggcccaaagatggacctggaagtaggaccagttgtctttgatatgaatagtgctcctcttcttatctcctcatggaacaaatcagtaactctgtcactatatagtggggttatcaggtagaattgcttaaaagactggtcatcaaggatgtaaaatattctgagggaatgtcaggtgagatgaaggaacagaaagtcaggacaaataccttatttttggcacttttgtctattttcaactttctgtttttttttttttttttaattcaaattcactactgtacactgaacccacctttaaaatagatttcagagtatgtgtcatcaataagaaaacttgtttctcacatttcaggttccaaaatctgttaaaattttaagtcacatagatcaatctcagtcattattaaaattgaccaccagtgtcagacttctttaattggaagaaaactatgtaaggctttatagattacagtcaacatccaatgatgcactgagcaacagctccgtaatcaatgcaatatacaaaatccggaagaatgcttctctggcagagaccctttagcaaaagagttgtacattctgcactccttaaagattctgaatggctttccagagaagtagcaaatgcattatattgcagtaacctatcttgtaagtcacaaggccacaaacaaagcctctagtcaataaaaaaacaaaacaaaacaaaacctgaaggggggtgagaactacagatcttaccattgactacgaacaaagggctgcttctgaccacattctactttctaaaatcctcacacagaaggagttttagatatcaccaggtcacagaacttcaaggaaagaacaacaaagcattccagcttaggaggtctatgttaattcaggcacttctcttattgctcttccaactattcagtactgactgtatcttgctcagattgcttttgagagttcactcatctctctataatttatttattcagacattgtgcagatttgatttttaagagacagccctgtttgtggtcagcatagaaggctaattataatactttaattatttattttagtatttttttctttccactatttaaaaactttttattataaaatatttcaaatatatgagagagggcagaatacagaaaaatgaactctccagtacccatcacccatagtcaattgtttttccaattatactttcacctactttttcttccaccagagcatctgaaagacaatcccagatagcttattattttatgcatgaatactttactatgtgttactgaaagatgacaatcataactaatatcattccacatcaaaaataatagtaattctttaatgtcattaaatatcctgtccatgttaaatgattgacttttaaatggtcttttctttttataactggttagtttgaatcaggatctaaataagatgtacacattatattcaaacgataattatcctttaatctataaattctccatttgctttttaaaattttaactttgtattttggaacaattttagaattatggaaaagttgcaatgatagtacagagagtacccatatttccttcactagtttttcctaatgttactatcttacataaccatggtaaatttgacaaaattaagaaattaatattgacacaatactattaactaaactacagactttattcagatgtcaccaatttttccattaatatgttttttctgttccaaaaatccaatccaggataccatactgcattttaattgccatgtctcctcagtctcttctgatctgtgataacttcttggtcattccatgtttttcatgactgataattgtgaagactagtggtcagatattttgtgaaaccttttacaactttgatttgtccaatcccgtaactagattcggattataggttttagagaagaatacaaaagaggtgatgtgcccttcttataacatcaaaggtatatgatatctcggggtatgttaaccttggtcgcttgcttaggagaatgtctgccaggtttctctatacttagttttaataaacataacagtttattgagatataacttatataacatacaatccactcttgttatgtgtataactcaatgacattaagtaaatttagagttgtataaccatcacctcaattcatttttagaatatttttgtcaccctacaaagatccttcatacccttagggagtcaatccctagacccagacaacaaatattttctctctctataaatttgccctttttggatatttttattaatgcaatcaaataatatgtgatctctttcatgtagctttttcacttatcataattcatttttaagattcttttatgttgtggcatgtagcagtagtctattcccttttactgatgaatactattccactgcatggatataacaccacattttatttatccatgcatcagccaatggacatctgaattgtttccagttttttactgttacgaataatgctgccatgaacattcacataaaatacgtctctgtgtggacatattttttttcctcttagatacctcaaagtggtattgctggatcataagggtaagtttattttaacttttaagaaacttccaaaccactttccaaagtgactatactcttacatctcccctggtaatataggaggcttctaatttgtctttatcttccaacacttgttactatctgtctttattacagccattctagcgggtgtgaagtagtcttttacggttttaatttacttttccctggaaataataatgttgaccatgttttcaagtgcttattaggcatgacttcatcttctttggtgaataacttcggtgaattgtcaaatattttgcccagtttttagctgggttgcttgtctttttattattgaagaattctttatatattatgcgtaaaaattcttatcagattatgatttgcaaatcgcaatcttgcaaatattttcgcctgtctttggtttgtcatttcatttctttaatgggtcttttgaagtgcaaaagttttaaattttgttgacatcctaattaccaaggattttattgaatcaagcttttggtgtgatagctaagaactttttctaacccaaagtcatgaagattttctcctgttttcttctagaaattttataattttagctctcacatttaggcccatgattaaatttttgtgcaggatatgaaataagaactaaaatatgttttttacagtcctaggttcgtgaatattcatttatatcgcatataatcctagcatcaattacagagcactgcttattgaaaagactatcccttcccatgacaaattgccttggcacctttgtcaaatttaattgatcaaaaatatgatgaattttctgaactttcaattccattccattgatctgtatgccaatatcatactctataaagtaagttttaaaaccagaaattgtacgttatctaattttgttttcctttttcaaaagtattttcactattttggatcttttgcatattcgtgtaaattttaggattagcttgtcaatttctgtaaaaacgcctttattctttttgacaggattgtgaattgaactgttttcttaatttcattgtttgttgctagtatacagaaatataattgatttctgtacaatatctcttcttatattcagttaacttgttgaattcctttattagttcgtgtgtgtggtgggggaggtgtatgtacattgcttagaattttctatgtacaagattatattgccggcaaataaatagttttactttttaatttccaatctgtatgccactgattgtttctttctgctggtctgtctaacccttctctttcccttcccctccccctcccctgcagctgctgctgcttcttttttttttcctctaatttgcttctctctctctttcttacatgtatttatcattctgcactggattgaatctcctgtacaatgttgaacagaagacataagaactgacaaccttgcctcttttccgatcctaggagtgtatcggtcaggttttcatcattacatacattataagttcttcatagatgccctttgtcaggttacagaagttctcttctattccttttgttgaaagattatatcacaaatggatactggattttctcaaatgtttctgtacatctattgaaatggtcatgtgttttctcttttattctattaatatgctatattgcattaattaattattggatgttaagtgaaactcacattcctgggataaatcctctgtggtcagcactgtataatgcttttctactttgccacatttggtttgtgaatattttgttgagttttggtgtctatattcatgagggaatctggtctgcagttttctttcattgtgatgtctttgtctggctttgctctcagtgtaatattgtacaaataattgaaagatgacctttcttgctctatttctagaaaagtttgtgaaatactggtattggatagaattcaccagtggagtcatctacatctaggattttctcctaactataaattgtataaattgtatgtctttttattacgagtctgttcatattttctatttcctcttgagtcagttttggtaatttgcgcatttctaagatagtccattttatccagctaattgctaacaattgtccagttgctaacaattgtctaattgttaagcaatgacaattgaggtcaaccaatgatcagtcacaggttgtatttctaactatcaagcaatgaaaaggattatgaggttataatatttgttcatagtatagtatgagatcaggaatgagagagaaggtatcaccaccaaccccatagaaatgagaatgattatgaggttatactatttgtttataatatagtattaactataactatacctcataatccttttcatttctgtggggttggtggtgataccttctctctgattcctcattttggtaatctgtcatcttctctcctttttccttgatcagtctagcaaaagaaaaactaagttttggttgatcttttcaaaaaactaagttttggtttcattaattttctctattattttcattatctatttcattgatttctgttcttatctttgttatatccttccttctgttcaaacagaatttagttttatgtttatatcatgtctatacttacctaaataatgacgtgatgaggtccttttgtttaggtgaattttagatacatttttatcatttcatttccacttaaaggatttccttcagtatttctggtaaggcaggtctactagcaacaaattgtctcagtctttgtttatttgggatatctttattttatatttatttttgaagaacaattttgctaaatataaaattcctaaatgacattttccctttttttccttcagcacactgaatacgtcatccctctacctcctggctttgtttctaatgagaagtaagctgttaatcgtagtgttgttttcctgtatgtaacagtcttttttttcttgttactgtcaaaattttctctttttcattcaaaagtttgactataatgtgtctatgtacagattttttttgtgtttatccaacatggagtttttgtgcttctcaaatgtgtagattaatgttattcatcacatttgggaagtttttggctattatttcttcaaatatttttgagccctttctttctttcctcctcttctctaccattacacatatgttagtatgcttgatggtctctcacaggtctccgaagctctgctcattttttcattgttcttttctcttcaaattagaccatttctattaattgatcttcaatctcattgtgtctttattctgccatcttaaatattctgttgagattctcttgcaattttttaatttccattataatattttttaactccagaatttttgttccttttaaaataacacttatgtttatattgatactctctatttaaagggtaattatagtaatactttaattatttaacatgatttcctattattttgaacatatttataatagtgctttcaactctttgtttgctaagtttaacatctgctatctccacttcaacccaaatataatttctttttttttcttcagacactttcttttaaccacttcttaaattgggtatgagtcacactcctgtttattacatgtctcatttttttcttgaaaattgacattttatatagcatattacagcaactctggcttctgacttttccctgttgagggttgttgctgttattgctgtgtttgtttatttaggacttgcctaacataactctgtgcagcctctcttccccatgctgtgccgctgctgatgtttctgctcagtttgtgtaatttccattttcgtttttgagctgggactttcccctgtgttaacacagtttagtggtcagccaacgatcagtcacaggttgtacttaaacacctagggccactatgctaacgcctctaattgatatatacgtgtgtgtgggttgtagaatgcactcaaagttcaggcagtttacaagtgtttttttgatttttactttccatttgttctctcttatcttctctctgtgtgtccaaagccttaggtcttccccagagtatgtgtgcagcctttcagacctctaggaatatgtggtagcttaccaaagttcactatgatagtatccttttccaattctccctgctaaatttctggccaatctgccagttcttttctactctgaattgtaacttcaggctacatatgatgtttattctccctgcttgtttgcccctgagattgtcactgttttgaccacacctaagggcatggggtttttctatgttctgctccatcaaattatcgaatcaccccctttcagcagtgaagttgtgggttttcatgacttgtcctgccctggcagaactactgatacaatggaactgtggggacggataataggaggaagcactcccggctaaaacactgtgggctcctaactgtgctagttgtcccaacataacttttaatttggccactttcactcccaaaagtatccagcttctgtgatatgatttatgaccttttaatctatagtgggcataaacgacttatgccatatgccatttcttcagcgaatgaccactgcctaattcttttcttagtaatgcaggaatcaggggcctagctgcaggtatccatgcatgtggggtggcgggggggaagtctaactgccattgaatgaacgttttcataatggttacatgtgtatagaaaatcttcaactgcccctcctactacatctctagaaagtttaaaggtttgggggggattaagaatttctagggaagtgtatgggatatagggataaggttaccaaaattctcccatgggagataaatagttttgcctcactctatagagtttggagaaaccactcagcgagaaggactagaattactttggttaataatgagttgctatgaactttggagctggactaacctattctaagcaattgtaaagaatatgtcatttagacttaatcttatacaaaacaataatagctcagagatctaagcaggtccaaatacttacttggatcaggttagtatttgccagcttattttctcacagattcctgggctcactcaggttatacttccttgggaacacacaaagggaataagctccttttggaactcaaataacttgtaaatcagaaagttcccatatggatatagagaataatatttactatataataatttttcctttacatgatgatccacaataaagttcccttgagaatacacttccctagagcatttaaattatgaacggatttacaaaataactcctatcacatgaaaagagataaacatatagtatctgcttctaggaattatctaaactcattttccttcagagacttaaatagatgaaaaaaatcagcaaactttgtttaggaaaaattcagaatgtataaagcattaattgtgaatatcttactgatatctttggatcaacataatacttcacttttacaacatgttgaggaaatcaaagtattcaccaaacttcatctcattaaagtgtcataacctttaatctaggaacccgtaatagtaaagattactgtttctgtctggaaaacaagaaatctaatccatgaaacaaaatcctgaaacatcacatacattgcttaaagatgtaagtctgaggatggagaatgtgatggaactccgtcaccttgttgtataagtgtgtccggaattggtgggttcttggtctcactgacttcaagaatgaagccgcggaccctcccggtgagtgttacagttcttaaaggcggcgtctccgcagtttgttccttctgatgttcggatgtgttcggagtttctgccttctggtgggtttgtggtctcgctggctcaggagtgaagctgcagacctttgcggtgagtgttacagctcataaaggcagtgtggacccaaagagtgagcagtagcaagatttattgcaaagagtgaaagaacaaagcttccacagtgtggaagtggaccccagccggttgccactgctggctccggcagcctgctttcattctcttatctggcgccacccacatcctgctgattggtagagctgagtggtctgttttgacagggtgctgattggtgcgtttacaatccctgagctagacacaaaggttctccacatccccaccagattagctggatacagagtgtccacacaaaggttctccaagtccccaccagagtagctagatacagagtgtcgactggtgcattcacaaaccctgagctagacacagggtgctgattggtgtgtttacaaaccttgagctagatacagagtgccgattggtgtatttacaatccctgagctagacatagtttctccaagtccccaccagagtagccagatatagagtgtcgattggtgtacttacaatcccttagctagacataaaggctctccacgtccccaccagacttaggagcccagctggcttcacccagtggatcccgcacccgggctgcaggtggagctgcctgccagtccgtcgccgtgggcccgcactcctcagcccttgggtggtcgatgggactgggcgccgtggagcagagggcggtgctcctaggggaggctcgggccgcacaggagcccacgtaggtcgggggaggctcaggcatggcgggctgcaggtcccgagccctgccccgcgggaaggcagctaaggcccggcgagaaattgagcacagcagctgctggcccaggtgctaagcccctcactgcccggggccggtggggcaggccggccgctccgagtgcggggtccgtctagcccacgcccacccgggactcgcgcttgcccgcaagcaccgcgcgcagccccggttcccgcccgcacctctccctccacacctcctcgcaagctgagggagccggctccggccttggccagcccagaaaggggctctcacagtgcagcggcgggccgaagggctcctaaagtgccgccaaagtgggagcccaggcagaggaggcgcccagagcagccaggactgtgaggactgccagcacgctgtcacctcttataaggttatcaatagggcaatatccaggctacaatgaaaaagaaacttgaagtctcgaacacctattgtgtatacattagagtggattcaaaataaatatttaaacagatttctgttcctgtggaatggtatttttccagcaaacctctccagcgattgtttttattaggctttgcaatttctataaaaggatatcaaccctgtcccaacttcattactatttctgctattaattaacaataaaaaaaataggctaggcatggtggctcacatctgtaatcctagcattttgcaaggctgagatgggtagatcacttgagtccaggagtttgagaccagcctgggcaacacagaaaaatcctgtctgtacagaaaatgcaaaaattagctgcgcatggtggcgcatacctgtagtcccagctacttgggaggctgaggcaggaggatagcttgagcctgggaggcggaggttgcagtgagtcaagatggcaccactgcactccagcctgggtgacagagtgaaaccccatctcaaataataacaataacaaaaaatagttgtatttcaagtaatataatctagataatctaatataatataatctagataatctagaattcactgtcattcaatgaattatatctgtgtgaagtgttctctatttggtccaaatcttttaaaaatgggaatactaaagttcacagtaataagatgttgtcagtctacattgaggactacaaagaagcatttctataaaatatcctttgttgctaatgaaagttaatatttatcttgatatttacattataatacagtgatccctatacatactgaagagcatcctagaaaattgatttttcttagtataagcattgtatttctttaaaatatataatcagagcccaatctgtaaatgtaggtaagatcctttataggatgctttttaaatgtaggtcaaattcttgcctccttctcatgtttttccactgtttacccattttattttttatttacttaatttatattatatatttcacttactgtcatttatatttatataaatatatttatacataaatatatttatattgtacatgtatgtatcatttaagctatctcaatttctttttgtaacaaagagatatctatctgtctctactgtatatttgtctatctacccttccatgtaacaattcatctaaatttactatatgataccccaacatttcagatgcaatctgaaaatagcaaccttagatcctctataaactcatctatgtttttgtggtgactttagttttcttctaccttcgaagctattcaaatcagaatagcctcaaatctgccttaaacttgtctgagacaaagtaacatatttgtatcatcagagctcagtattaacttaaagcttaactaaccacctctttgctaagtcacctgaagatgattcttgcctttctgtgcacgaataaaataatttgggacctatggaacaacaccaaccattttcaaataactaataaggcatataacatagagcagacacaactgattatatagtttgtaccctgtccaaggcacctagtccaggagtgtgtttcactcaataacccacgttccctagcccaagctgcatctgcttgagcaaagggtttcttttaataatttgcacaaaggtgtccgaacaggcagcttttttctaagttgtattgaaactccatatgagataagaaaggccctctataacatgtttctatagtacttctaacagaatataattaattgtattaatattagctggctctctagctgttacatgtaacataaatattcaggtaacttcctagtaatgactaacctcatgagcttaggtctccatgacttgcactaaagaatgctttaaaaatagaatgttaacaagttcggagacatggattatttgtacaataaaatacttttcttttaaatttagcttctggctcccattccttcaggcagattttatatattagtagttaagtcttaatgaattatctacaggtaggctatacataacacatttttacattaacttttcgtgactatgacatgaatacatgcccattgcaaaaacaaaataaaacagtacactgaaaatatagaaaatatgaggaaagattacgagcatcaatagtctgatgacacagagacaataaaccactactggaccttcaggatttcattccaacgtgacacattttaatcccaatttggcttacccattttcccctgcacacaacgagtagcctcctatttttactatttggtattgtgcttaagcaacggaaatatttcaagtatttctatagcaattgttttctataaaattaatttagtaattgatcaagtactatcatatttaatagccctgcaattgatcattattcatgatactactcattgttattgcttattacttcatgaatttggttttattcaatcatgtcatatggagattttatacacacacacaaaacacgcacacgcacacacgaccggctactacataaatattaaaccatttctccgaaataatatggaggttagaagtagcttctagatgaacaaaatgaaatggcaaatttgatgcttaaaagtcaaaaatttcatatcaatgccaaagatacattattttagataacactctttttctttatttttatttttactatctttgctacaacactacaacattaatatgaagaactgagagtcagctacgcctataaaggtaaagtgccataaaagccccaatgcatctctctcaagagtctaatcttattctatctgaggagctatcctctttctgtgaactctgtcatgtagaattacatcatctcccatggctcagattatctccaatttataaaatgctttaacaaaaactgttacaaagtgggctctgttatatattcatataacttcctcttcactttggttaatacggaaatacacaatacatcaatatgtttcattaaaacgattgttttgatatagtaataagctgggcaaatagaggaagtatgctgggtgcaatttatttacattttaataagacctcaaacaaatgataccacacaggaagctcagaattaggttaaggagaaatggtggctaaaaaatgccttgaagtttggaagctgtaagtattatctaatcaatagtattacttttgaattaagatagaataaccattccacagggacaggtattgtggtctgtgacaaacattattcaatgcagacattaaaaatttaggggagatagaaattttcaaaatttgataaaattttaagactaaaccttagaatatatgccaaatgctaaagtttaaaatgaatgggcctatgaaataaaaatctcatgaaagcccaaagtatgggagttttcttccttaatataccaaagcttactgctaaaatccccatttaatagagatgataacttcgccattcacattttgggtttctcctactatgcatgttaactctttgtgaatagttctaaaaatcaagacaagtatgtactttaatcaaataggagattcagaaagcaatgatttcagtctacaattatagtagcctgcactattcctatttccaaactctgagcaggttcacctttgtttgagacaaattatcactgataatatcttacagattaatgtgcatgacatttgtctatccagtgtagtttccaagacaataaaaaaaattgcagaagtaaatatattatttaagctgcaagtgaagaaacaattataaaagtacaataatgataggaaaagcatgaagaggacagggtgaggtaaatatacaaaaggaatcttgtaagaactgacacatttgctaaaagaacaagaatatgactccgtgtgtgtgtgtataaatctctctctatattaagtctatatgaaatatatttatacaacttatacacacacacacacacacacacacacacacacacacacataataaattgggcgtggtggcttacgcctgtaatcccagcactttgggaggctgaggtgggtggatcacctgaggtcaggagtttaagaccagcctgaccaacatggagaaaccccgtctctactaaaaatacaaaattagccaggcatggtggcacatgcctgtaatccgagctactcaggaagctgaggcaggagaatcacttgaacctgggaggcggaggttgcggtgagctgagatcacactattgcactatagcctgggcaaaaagagagaaactctgtctcaaaaataaataaataaataaataaataaataaataaataaataaatatctctctatatatacacacatgcagaggcatacatatatgcctctataaaaataaatatttcattaggagttttgcaatttccttatttgtatctatccatgaactagaaagtaagttccttgaaagtatgacttatgttttctgtgttgtaattcataataactagcatgatactgagcagaaaattggttctcaataaatatttgtgtgaaatacaaaaaatctaatttcattcatgcacactatgtaaaagaacaaaattaaagaattcccaaaaataagacaaatgataccattacatggggaaagcaagttagattatgctacactacactaagccaataaaattaataccaaaaaaacccttcaagtgaaaataaatctatgtaaatacatgctgaaatcctcagatgattcagactccagagaaatgaaaccccaatgacagcatcatgaaaatgagttgccccaatatcacatatcgtttttgtcatactctacaagaagtggtcaggtgtgattagaaattccaatttcctaatcttacagaatataaacaatctatattacataagtctatgaattttctgaggcattataaacttttatggacattttttattagaatctgaacacaatggtgtttcaatataaaaactcataatttcaattgtgaatcaccattttacatttaaacaattttaaaaattcacattgtgacatgttataccattaggttattaaaaaaactctgaaagttttcttaataagatcataaagttttttctagttatgcaagagcaatttgatagtggaaaatcaattatgctaagtcctttgctgaactgtcacatttcaaattatcctataatgttttaaagggaaagggctatgcatcttaatcccaatgtctagtgaacaatttctggcatatagtaagtgctaaataaaatgtatgatgaattaatttgagttgaaaaatacatctcaagaaaagtctatgtccatgagttacaattggacaatatttaccagaaaaaaaagattaataaaagtcaacgtccattcctaataatcaaataaggattcagaaaatagtatgttaatccactttaccaatatatcaaataatatctgtcttaaatcaacaaccaatatctgccttaaatatgaaaaaaaactagagataataccacataataaaaaacaagaaatatgccctctaccacaacgattacttaactgttttggaaattatagtcaatgaaataggatattaaacaggaataagaaaggaaatagacagtcatctttgttaggagataatttaataactttgaaaccccaaaagaacttaaaagaaattattaaaactattaagagagttgaataaaataactagataataaatacagatagtccccaacttacagtggttcagcttaagattttccagttttacagtgggtttatcagaatggaaccccacataagttgaggatcatgtggattataaataggaagtggcttttctaccaaagaattataaatgaaatataggcaattaaggacactaacaagaacatagcatgcctatacctaaatatatgaaggaatttggggatctatatgaataaaaagatacaatctatttatgtatgaaaacatactatgcttctgaatgggaagactgaatattgcaaagatactaatactgatttataggtttaatacaattccaacaaatattccaatgaaacatttttatgaactcaacaaactaaacaaatcctgactagtaagtaggtgacaaaagccaaagcatttttgaaaaaagaaagataaggaaggattttacctaaaagatacacaaacttattttgaagctctaatggaagcaatatagaaccggtgaaagaactgaaaaagcagatagtccagaaatagatcctaatgttgataaaaattagtaggcaatcaagatgatgtcaaaatcagtggggaaatgattctggaacaattgattaaccattaagaacaaaagtaagtaagatgtttacatcataacatgctaaaataaattctgggagaaacacaattaaaaatataaaacagaaccatgatcatactagaaaaaatggtgaatatttactaaatttcaagctatttaaaaaagaagataaaagtaatgaacatagtcacagagaaaaaaatacacaagaaattgaccatacaaatatttaacattttctcacataaaatcttacaaatcagtaaaactacatgagtaaagaccacaagcaaacaatttataaaaataagaaaacaatgacaaacatgtaaaaaacattctagttccttattaaatcactgcaaattaaaactatgtaaactagttattttgcctgcaatttgtcatatatttatataatgctgctattcaaaacagttaagaatgtagttagaaaagcacttttacatacaattggagaagaattctcaaaggaaccttgagaattttacatcctctagcccagaaatcaactttctaaggatgtatgctaaaaacataatccaagatgcagataaaaatttatatataaaaatgatcctcagagtaggagaaataatagtggaaaatgacctaaatgtcaaacatgaaggagttaattaaaattttttggtacataattaagatataatattacacagctaatgaaaatgagtattttatgactcagaattaataaaattaatgctaagtgaagagatcactatacagactatacaatccaaaatgttgtttagaaatatgcaaacaaacacatatatataaacacctgtacactttagaaacacccatacacttggaaagaggcagagcaaatacttagaattgtttatccatgattggtggtgtcaagtgatttaaatttattcgttatatatattttctattttgacacatcctttcaacaagtgtacattaccttttaatctggaaaaaaaagttattttaagcctaaaatgaatttatgtgggttagaaattcacttaagggaaaaaaatcagataccgataaaaatcactttcatatacatgtagaattactgtgctctttaatctgtgaatctccatacttttgtgcataaagaacatctattgagatattgagatacttgacttttttttagtgctgaagaacacaataattttcctgaattaaaacccaaagaaaataaagtcactcataaataccatatttgactacagcattcacccaatgctctgatggcctttcccgttgttgacttattgataaaatttacctacattgctaatattaataattgttttggtaccaatttcaggaataatcaatctgagaatgtttacttggcccatttagacaataccaaggaaaacacccccaagtaactgtaaccagcatagtgaacagtgtatttgcgttttcacatttcttttccatggaataccaaccttgcctagtattttgcgaataacaatggatggaacttggattttcaacagtgcttaaaaaatagctgccaaagtcaagacatgtaataaccttctaagtaagtttgctggctccatattgtgtttgaaggcacaccccctccaaacgtctgcagtcaccatctgctactcaactgcagaataatgcactgaagtctggtgttgtttggcatgggcaaagacagccaatgtccaactccattcagacatgtgcaccatatcaggaaccttatgacacagtcctcaacatcaatgcagcactttcaagccctgctgcacatcaatcaagtatgtatgacagtcaagctgatagataaaatctaagccaactctaaatacctactgtgcatggatctctctagtttgcctgcagctcaccttctattaagatgatagctttggcctagtcttccatgccaaaataagtgcatggagtcactctggcaagaagaagcgtctacatcaatgtcaacaaacaagttccttgcgcccgaccctaccatctgtcctcctgcttcccacctaccgtactttatgtggaccttgatgaatgagattctaatagtccaagactctagtttagccagcctttgcagatggggtcaacatgactgccctctggccaaatacccagggtgacatagctgatgggttacctggaaagtgcctttttgcaaatttaatgtcagaaataaagcaaatgaaggcgttcctacaggttctgagtttcgggtttatggaaaaaagtgatgcattcaatgcttaaagtgaagataatttttcttttaaattatttgaaaatcttataatgctaaagcattgataaattccatttcaacactacgggtaagggaaataaaatgaatgaataaaagtaaaactggggctattctaatgtatttacaaagtaggtttgagagaaagacttgaaaaaaatctcagaaatatgtagaaataagacttgatagtgtaacattaatatagaagcagattatttcattctgcgttagatgcaacaatattagagcatattgcacatgctaaatggggaataatagatttcatacctattctacagaagttgtatggcacttgcagatttcaaggtagagcagtaaaatttaatataatcttaagtatgagatataaatagtttctggaaaaatctaattgtttttgccttaaaaagatattacatgaaatatgataaatcagtattgtcataaaagtagtaaataaaattattttgttttttgaacatgttgacaaaccatttcaattaggtcattaaaaaaacacttaaaatggagcctgagggcatatgaaacaaacagaaatttcaggaaatgccgctagttccaatccaactcaatttaataggatgatacaatgataagaccttatttttccttcaaggaaagctaaatgtatttctagaatggtctctggacacatcaaaaatagaacaagcaaaaacaaaacaaacattctacctaggaaacaacatcatctgaaactctagacaatttaagtaataataagaaagtgaatcttcaccaaatgagaaaatgaatgtgaaaatatgttacatactataaagcaccatacacagaattattcagagcatctattaaagtgctttgtacatagtaagcatttactaaatgtttgtagaattgactagaatttaattgaaaagagaagtataatgagacttctacaagtagaatcagatccttttaataccatgggaaaaagtttcagtcaaattatatgactaggtacatccgttgtctttgatgttatgaatcaagatgagatcctattatatcaaaagaaaaaatattgttgaatttctctttggagaaatcacagtaaaatgaaaaggatgattatttttaatttctaaatatctccaaattttatagcattcttcggtcaactaagataatgctatagaaatcctacataaaacttgaacttacaatgtcctggcctaatcatctggctaatctctttgagttttcctgaaatatgttcacatcccattttctatgggaattctcccactgattaacacagagaatgagaatttggcctgtgctctataggcaccattgaaatgtggccacctgaggcatgtagggagggcatccagctggcacaccacatgttgccctggagtagtgtacaatgagagggatattttggctaagaatacctggatgatctctataaaggtcctgattatgaaaaggacttcagcattatcattgtctcatgggcataatatgagccagggaaacttctgtttctaagttcatatattttccaaagaaaggacttataagaatataagaaaaaatcaaagaactctatgaaagagaaacactgggccattgatactagattttatgtactatccatatcactagaagaaacttttttgagagctccatgcattttaaaacttatgctaaagcacactatagacttgaccatcaaataaaacataatgaaatctgtaaaataaaggatgcaaaaacatagcgtgaaaatttatgcctgcagtgcagttgttgtactatattttataaaaatcaattaagttcacatactactcacttaagaaatatctgctgattttatttttattttacgcaacttgtgaggaagaaaatccatgcatttgaactgtagtgccaataaaacaattttgtcaattttgagtctatttttttcaaaacaccatacgtgattaaaacacataatgcactagtatttttgccaaattttgtttttaaaccaaagctgtttttgaattacataagcacaaaatcagaatttcaaaaccagcaaacatatttaggggtgaattttaaaataagcccacttgattcattgttagacaaactttgagtgccagggacatttttgtgaaattccactggggtaaatagggtagctaggaaacgctcctcaaagtgaaaaataagtatatgcattattttcaataagttttgtttagcattttcaccctcatactaagtggttctggtgatatttacaatacaacatgagcataaatcttaaggaatttatgatgtcatcaaatgctaagagacaattacagctgggttttacatttgtgtttatatgttattttgcatatagatcccaaaaaccaatgaagagaaactttgatacaaaacatatcctgaaactaaaagacagcttctatctatcaatataaccagttgatagtatttctaagacagagtttgacagtaagtgaaacaaacaaacataatgttttaaatatgccacttcagccactccagctgtcactcaagaggctttttttaatatcattaattcaatgccacacaaacaggaattcggtctttccaataaattttggtgacaacttgttggcagaaaggaaactaatatatatgtggaaacttttattttgtcatcatgtatgtttgtttgaacttgcttaaaatattgtaattgtgggcctaatttacaccttttttcctaaaagctcaaacaaatcacaatgatcacagtgtccctaagactaatgagtcccaatttataccacagaaaatagaagctcagagagctaaagagtactggcagaatattatactgcaagaatagcaatatagcaagtatactcacttgaaatcctaataaaaccataaaaactaccactttgtatttttcattagcttatatttttacttaatgcaaaatattttgcagaaaagttttctagctagctttattgctagtaagagaataacttttattaattgaattaatttttgtaatttgtgaccaatgaggtttgactcacatcgcacattttctttaggaactcagatacttcatagatcttaataccctgatgaaaatttaagtcctaaaaggccaggaaatactgagattcaagttggctcctctaccatctttactgacagaaattcagagtgccaaaagtcagcactgctggttgctgatcatcatatctaaacattgattcttctaattgtgtattttgagacttgcttgattttagaattacaggtggaaagtcacttctctttgatataaattgcatgcaataaagaaggaggcagtcctacacaataaatatgtaaggaatggttttccacctctgcatgctgcagaaaatcccactgagttaagtagggttctaccaaggccacttaaacatattagcctattatgctccacatttctttattgttctcaaaaagctaatgaaatgttccagtgtaatgttaatgctggagtacttttaaaggcattttagaagtgatgtttctctcataactccagaagggggttccacttcctaaaaacatttaggaggccatggggagaccatgcagcctctttactcagactgtttagactcatagctggagaagaaaatccttaaagataatcacttaagagtttcggtgtgagctatagcatcatcgcaaagcgacaggaattaaaaggcagtgtaccgtactactgaatagataggtttaaaatactgtgtactgtctattcacagataacattgatttacgttggtaaatctattggttcagcacatcagtgcagtattaaggaatcaattgtttctccagagtcaattatttttagaaaaataaggaaatgtgacctatcactgaaagtcagtatgtagaattaaacttggccagttttcttcctcgctggggtcttaattttttcaactgtaagataaatgaatcagacttgtcagtatctatgatcacttctagcattaaagttttctagttttaagattctaaataccaacactgtatgttgaggaatagcaaagtaggaaaagaactgggaataaaactatcactgaattattaactttccaacaatcaaaattctgtaattttgcctttagttgccataaacaaccacctcaccttctgaatatcaacaataatatgaatgaaggaaaggttgtatactaaggtcacaggtggtatggttgagattaaagccaagactgagagtatagtaatgaattgagaaatgaatcatacacttttgacctaatatgtaatatgtcttcccaaatcgtcatttttatacattcattttcaatggaaaacaacaacttgaatatcttagaggttttttcccccaagaaagacatcaggctgtaatctccccccacaaaatttaatacagttcatagctcatacccctaccggataatccccaaaatgtcttgttcctttttcaaattagacatcagcattcagtataacaattaatcaatgccaacaatgttccatatgctttattagcattcattcaccgaatccttccatgaacactaggaagtaggtactaataaaaacagaaacaattttgaagtacagaatctcagaggtggttatcagtaattctagaatatcagtctgacatatgggtccctccactttttttcagtgcacaacgtgaacactgtgtggcacagtgtttcaagaattaatgtttgatttatatcaaagcattatgttttttacttcatcttaatagtaatcacaagagtgacttaagcctcctacatgaaagcagagatagaaaaaagatgaccttggaagttacatattttcttttcctgtaagtatgaagacatgtctataagttattagaaccataaaaaaccaaaaaactaataagaataaaattgtgaaagaatattgaaacctccttaataagcaggttcttgtaggatattgaacaaggtatgtatgttgtagccctgatgctatatttgtgtcatgctgagcaagctacttaacatttaggtgcgtaagggtttttttccctaaagtgggaggatttagatctctaaattccttaccaatcataattttagagcaaattatctataaagtcaattaataatttgccttgcttcatgtattacataatagttgctaatcaaaatgaatagtattatactcacagctttaactaacttatagctaagatcaggcttgctttgtaaacatctctctaaaaactcagaagtccatgaatactaagactttttactcctcctgtaatttttgacctctactggaaatctcacctgctacccctgacctcgaatattgcaagtattaatacagtttctgtatatagtgtacttaagccaaaagtcagaggcatgagaaaggtaaaggccgggacaaaggtactacaattcagctacacacttgtaatgcttcccattagttcgttagttatattagttccagaaactattttaacacggtaggctgatactgcaagcaaaaacaaaaatcatgagaacaatgaaatagtaggtcttagcgcttaagcatatctactagtagtaatacttgacaagcagcccaccttctttgtgatctggaaatgatttgatgataaagccaaattctagaaatataactgctatcttttgggagatcaaaggtcatgtgagggggagagctaaggtcaagagcaagccccttaagcctactccagaaatttcactagagggtgctcttgggctttcatgacttctcagttcttcaataagaaccaagtattgcttagataatatattctgcctagtataacttggactccatcatggatcccatatccaatacttcaatatagaattaaaagatatctccagcagaccctgggcctggttttttattttcctgtgtaatttccttgtttctactgatagtacacttgtgagtttcacaaatttaagacaggtaagagatcttaagaggtctccaaaagtctacattctattaaacaaccacagaaacttcctaatacatcaaagtaagattaaatggggattaactgataaatctatttttgcaaatatatgttttacaaacatattttaatcttataataggttcataatttatatacctattggaagaattattattccataagatctgtagagaaagtctgattgtcaaatagaataaatttcaattatttatatatgtattattcatatgtctcatgacatcaaatattgagcaccaagtaagtactgaataaatatttcttgaccctttattgcacatacatatttttataacacgttccaacaggatgacatataattaaattttaatctctacaccatatgtttgaaattttttctataaatgcagtttcacctttctggaattcacgtttaatgacttattctgtttatttctaatgataatcgctttttatatactttccatttttgctacgtttttaagagaaaatgaaacatggaaattgttttgttatgtgattaactttttaatgtttctatttgtttattagaagattaagaaggttatttatttctacattaaaatattggcaatggcatatatcaatgcatagtgattttcttaagaattgcaatgagtgactcagtaaaattcttcttcactttcaggatgtaaagaattatggctactagccattatgcagggtgatgttcttatcacacataattgaaaactcaatagttttagcatctttagggttgacagtaaaattctgaggttgactatggaatgctaagtctttgaaggcacttccaatttggctaaacttacagtttcattattccttaattgaattaagtttaagtttctcttaaaatcagcttgaggcttttgacaaattagaaatttgggtcctgaatagtagccctttacaatatatgaatctgcataaagatgtgttttaaatgcctatttgataaaaagataagcctggtcacttatggattctagctcctttcaacatcctgcatggattgcaaccagtgtgaaaaattggggatctttaaagtggtctcagatctcttataaagcagtcacctgggctcttaaactgtatggtgcttctcaaaaagggctccttaagtatcctatctgatgtatgttattccccaattcaacttgcaaaggacagagtcaccagcatatattcaaactgtatttcatccaagtgggttgtcaataagcttaaatcactctatgaagaactggcaaaattcccatggatactgtgaaaataaagggaatcaatgaagagatataattattttagtctcagatttaattaatttgtgggagaggtcattttctctcaaatatattcaagtttcttcaaacacaggtcaatgtttgccagctgataggaaaaaagaaaacatttagtctgagtttcccacgtttatattaatctctgtatcacagctaaataaaatgtttcataaatcttcatataggcaaaagagagttcaagctaaggcagagtaacaagtattgccaatagaaaataacctcttaagtactgtttctactatttcctgttctaatttttctattggagagaatgaaacaaagtaatttcacacctggttttatgaatcagctcactaaagattctaggtagaagttacacgggagatgcaagtataacttcattattttacaattagaacactaagacaaagaaagaataaaagtggcgtgctatcccatgccatgcagttagcatatggcaggtcttactcagagtccccagttcctaatctagtgttctttctactgcaaaggtttccagtgctgcttggtttttcataaaggatctgtatatcatgtcaaaatttcatgttgactttccttgaaatttcagagaaaaagaaggcagtataagaaaaattactcttcattgtctaactcttcaagtcagacagcattcctatgtgcaatgatcctcgatacagtctaggtcaactgatctctatgagttttcatactcattaaaatgtatgcatcacaaagtacaattaatgttctcactgactttagggaccttgcatgtttcatccgttccctaacctatgccatcctgaatccaagaggcaccctgtatttctctgaaagtcagcccagcatgaaaatactgaaataagagtgcaggtgtactctttgctttaagaagacacaataagccaaattctgaacttaccaaacagacaaattatggggtgattattcacattttaaaaggattcaccacaggatgcttttaaatcataagctgctctattgcattttaaataagttgatttataaagcttcctttacaaggacttttcactatccagggttcatggttccttatccaaaggcaatgagagcttggtgagcataaagtcctattacctgctaagccaagcttcctttcccaaataagagaataattaggactgtagttcatttttgaaaaattaatgagtctctcactcctgaaaaatttaatataccctgagcacttattatgtgcctggcacagtgctaggcattttagataatgatcttatttactcctcctcaccacaactctaggagattagtacaattatcccaatcatggatgaggaaactgggactcagagaagttagagttaagtaacttgactaaattcttgcagcaaataagtgatcgtgccaggattcaaagtcagatctgtctggagctcttgcccttacatattttacaatataatttcagatgaaatttaatgacgtctcttacctctgacctaactgagcataattgcgctccaaatgtactattccagtgcagcaatcctgtctgtagcaatagggaccagtcacacagcctgaatacaaaaagatagggggctcactaacaaggttgcctattctggtcactgcactgccatattaagcccggatttatctcctgcaattcctacctattggatctaactttgctctacagtcattgagaacaattaaaatcccttccccccatacctatcatatttctcttatggtttctttcttctttttttttttttttttttttttttttagtatccagtgcctccaacctttttaaaatataatgggtttatccgctatttacatatattttattctttcttgaaactggttcttctggagcacagagaacttataaatgctatttctaagcgtttatgcaactaaaaattattggaacaatacacagtatagtggataagggcgcaagctcagaaacccagactgcctgggttcaaatccaggctttaccaattaatggctcgatttccttggtgaatatatttaaagtctctgtgcttcagtttcctccttcaactatgaaatgaggacaacagtacctagttaatgtggctcttgtgaagatttaaaagaggggcaatattaagcaaaaggcaatataaggaaaattactctacagtgtctaactcttcacgtcaggcaacattcatacagcaatattcatatagcgcttacagcctgctaggcagcaattagggtactgcctaggttgtaagctttatataaatgtttgtcattattattgatggtataggagtgaatgaatacttaactgccttggaaaaatatgacctatatcattgtatgagattgattttattatccagatataaagaagtcaagctcaactagaaaaggcacttgactggagaccagagatgtgcttctagtcccaactctttcaaacactccagatgaaagatcttggactttatctacctcatctttttaaacagaggaatgggactgtacctctgcctctaaaatgatatgtttttattctaggattctaggatcctattccacctggaccctgcttaaatttcattactcattatgtttgaaaactaccattacatactaacattttatctgcatgtttatatctgttgacatttcaatcagcttatctgcattgttttcacgaaacagaataagcctctgagagtctatagacaggtctgaaaaaacaaaaggtgttgtgatagcacagagaggaatttaatgtcactttggaggaaataacctaaagtcctactctgccaagccagtaaaatcctgtcctctgcctgcaacacctggcccagtccatgctatcttgctgaatttcagtgcagctctttggataaactcaaattcaggtttggatggaataccaggttgatacaacagtcattttttttcaacagaagtgcaggttggactaccttttacctaccaaaatcacctcattctttgatatatagaacatttagctaattttattatgacttagtatgccagtactcctcatatactttattgtccatccccagatctagtgaaggcatggtgactggtatcagtatcaaggcaattgtcttcaaagaatgtggcaatctattctaacaaagtaaattccacaagggaacaaggggacagccactctaaattcactaatgacaaaaactttgatattttgtaattaagcacaatgcattattctataaataaaaatgatgtccttgtaaatctaaaagctatgaaacgttatattttctatttctaaaattctctaggctcaaagtcaatatgtaagtctaatttttttaaatgcacaaaaagctatgatatttcaaatcttagatactaaatttgtgaattgagtgaacctggcttctcccgcttagacgtgaacattcctgttagtacataaatattaacgaatattttaggccaaaattttgtgtttggtgattgacttatggaatcagtctaagtaggtgtgaaggtgactagacttattttggaacatgtacaatttcataacagtaacacggccgttaaataattctctttaaatgatatttaactctcattttaactgttagcccttgcattatgaagcagcttgatgctgaagtaaagctaagatttcagtaaaaagaataagagctttatattctagaaggtagaaatcctagaaaaatcaaagaaattaaaattttggaagtttttgattcatttcttatattttaaataggattctaaaataacatatctcttctatacataagaaaatagtctggttcacatattttgatttattgaaaagttattacagtacaactcaggttgccgaatactaacattgctataccagcgttgttttggtaaatgtttgcattataactctggttgtattacagcaaaacactcagaagaaagagagtaacttttacacatattacatagcatctgtacagtcatcccttaaaatgcaacaatacaactgcaacactttaaatactttaaaatacaaatgcctttgaagaacataacttatatactatttattaataggattaaatcaacatttttatggctctctaagcttatcccagaaactcttccattatttcagtgagtaacaagagaattttttttattgtttatttttttttagatatggtttcactctatcacctaggctggagtgcaatggtgtgatcttggtacactacagtctctacctcctggactcaagtaatcctcctgccccagccttctgagtagctgggaccacagatgcataccactacacctagctaatttttttttttttttttttttgagatacaggttctcactatgttgtcagactggtcttaaacttctgagctcaagcaatcctctccttggtctcccaagtactgtgattacaggcataagccactgcacctggccgagggtcttatagataggtaatattaacaccattttgcaaaattttaaaaataaggcaaggaaaggttaaaataagttgtacaagttcaacaagtagtaagtgaaattcagccagactttgaacatagacatcctgttttagaatctcaatgttctttctatttttcccaaagcaatctcactaactaatgtacgtattagattgcactgatatagtaaggacaaagaaaacccattttctgtgtatattgctattgccttagaaaatacaaatagctactgaaaagaccaatgctatgaagcagtttggtaatacctattaaaaattttaaatctctgctacactgtattaatattttatatcttaaaaagttaaagaataatagagcctaacttagatccttccaaatttgtaactcttcaaaatctaaaatgaatttctaattcatggcttataactgctcaagtaggaaacttatgacaaaaccagagacaagcccttccaacagtgcctatgacatcacagatatacaaatctgccccattttacagtacccaaagaagaccggaattcagctgttatcagacaataataaacttcttctggtaagttcgtctcttagtcttagatttacattcccactgtcagcaagaatttttaagttaaacatttttgaaaagtaaaaattcaataaatagcatttacattatccacagaatgtattttcattgctttggtgctaaaatattttattttaggctgttcttttttctcttttccatccacctcttagctcctttgctccaatccttgcacctttccacccttgttctctctctccctgaagcctcagggaagagggctgcaaactgtctggatgcctggaccctcacgctcctgagattaaacccagacccgcccatggcaagagtcccgttctttgtctgaagcaagtgtctgattgagttagatatggagtcgttatcacattgaaaagaaagcctggattttttttatctttggtattaaaatatgttatatttgtattaaaatattcatctaataaactctcccaaagaaaacagtttcattatattttcaccgtattttctcattccattcttaaagccacagtgaaaggaaagttgttgtggtcaccccaaaatactctttcccacttctaatcaaggtctggttaggacaaagctaaacaataatttctactttgtatttaaggacaccagctactgtttacccactgatgttatttatactaatagggggtctctgaagtgacacctaaagcttgctaaaggtttcaggagggcttttgtaaagtcaattttctcccagtatcgctttatccccacagagtaagcagatgggagagttctttttccctcaaaataaggcttatagcattgactagggaatttaaatgtatctttacaattctcaacttgatctcccaggaagagcttttatagatttggatttttttttgtcataaagtattctatttatttcccagcagctggtgtcaaaaaagttgtttttttaatattccttttaaataaataaaatctgttttcatattgtgtaaaattagttttgcctgctgtgagtttgtggcattatgaagtgatcatttcttcccatgaattatttaaagtgaggatatcaaaatctgatggaacaatacaatgaactatacaatacaatttaattttataatacgccagttcataatagtatctcaaaatgcacagtagttgcaatacattggttcagaattagcagatcaagtataagcccctcagtttcatattttagtatttgagaatcagttctaaattttctagtggactagagaatcatgcatatttggtagtccatagatacctaaagacctttttgctaattcctcatgccaggcactgatgtttgcccagcctagatgacattttttttctttttttgtaaatctttaagacattgagtttgacagctgttaaccctttcattacaaaacaatattggtattaatagcatttcccctggagttctctgatcactttgtcttagggaacaaatgcacctatgtagccacaattattcttactacttattctcactgcagagtttctagaagaagggaaacaacgatccattcaaatgccccactgcacttataagacttacagcaaagctgctaaaacttaaattttaaggtgagtgaggtggcataagggaaatgaatgagctgctaatgaatagggcaagacatgattagaagctataacaaagtctgactcaaggaaaggccaaaggttatcttgtatttgatatgtgtgttttaataaattataatcaaaatactacactgactttttcctcagtggattttctagcattctataagagatattttgtctgattaacttgctatattgaaaagtgggagtcagtatatattacttacaaattctcaaatagcctctgaaaaaattccaccacaaagattttaaaaaatggaagtatatggaaacaagatgctacaagatgttggaaatggttttccaaagcaagaactggcttaaaacatagaatagcaataatgagcacttttcttgttagttctacatactgtaaactaatttatgccccaaacagaactctggtttccctattatccatgttgccacttcctcctctaatctaactgtacttctctcgtctcagtgaaaggtgccaccatctgccctgacagttgatcaggccaaacatcagcaactctttttgcctcacccaccacatctaatccatcaataagccgcattaacccaaacacaaaagtacatcccaaacccgaccattcctcactatctctgctatcacgaacaaaaatcacaattatctcttatctggtctcctaactgatttctctgcttccactgttgcaccttataatccattatctaaacagaagctagaattcttgaaatgcaggaaagatgatatcattcctttggtaaaattctacaagttatatatagtgcaataagaagaaattaaaattcaaaaccatgaccagtaagtctctccattatctgttcatgaccatctttctgttctcatcttctaacatttttcctttgttcaccgtgcttctttgcctattctgtctctaaaacaagccaatcttattcctattagccctggtctagctatattgcctctgcccagactgctctgttcctacatctctgcatgactgatttcttcactcgtagctcaaatattatctccacagaaaggtctttccttgtgtggccaagatagccaaagcatccccaattcattctaccctgctttacttttctcttagaactaattactagtatcttccttatttacatcctgtatgtatgtgagtatgcacatgtacctgtatgttcataatctctattacagtataaattccatgaggatgaggttcttggatgtgttagttatctattacagcataacaacttacccccaaacttagtaacttaaaaaagcaaacaccattccacagtttctgtgggtcaggaatctgggctcagtataggtaggtgcctatgggtcaaagtttctcatgaggttgtgatcaaactgtcagctagagctgtggtttcatctgaattctcgactgaagaggaggagacttgccatgtgggggtcttcacatgtgaaggtcttcacacaggggtcttcacacagggctacttcatgacttggactttgctttttctcagggagagcaatccgggagagagtgatagagggactcaagagaaaaaccacaagctttttaaaaacttaaccttggaagtgacatcctatcacttctgtcctttattaaaaatgagtcactaagtccagccaatactaaaggagaggaaattagacaagcaggtgaaaatagaggatgtggagatcaggtggggccatcttagaagctgcctattataattgcttaccagtacattcttagtgttcagaaaaatttcggactttcagtaaacaaattaatttaaaaaatgactctctcatgaattagttccattggacattttgccaatgatcaagaaaaagtagtgaataaaatctcactcaagtagtgacattcaaaccaaaagagatcaccccagtaggaaggtttcattaggatgtgtaagcagaaagtagcagtacagcctcagtttcttcatctgtaaaatataaagagtagttgtaccatactgtcggagacctaatgaggcaattcgtgagggcctcatgaatcaaaggcagtggatagatgttagctattatctattcttaataagtataaatgcaagggaagcatttttagggaaaataacacaaatcatgtttttataatgatggtatttgatacatcaggtttaactcaaaaaagaatttaagaaccactttcaattgtttcctaattatattagcttaaatatgagactgtaaccaaaaagactaataaaattttggaactcatcaagtgtactgaaaataggctagaaagctttccatatatttatgtaaagttttgacatcttcgaatggacataatgatgcatttgcaatctccacaatcatgagggcctaaagggagagagatgtgtagagccctggaattgaagatccatggtgtgactggggggggaaagtctctgaaaagttaaaagaagacagggcactgaaccctgatctaatatgtaatggggttatgaaatttaggcagagggtagtcatagaattattcatgaaatcctagaatagtaatactagaggtcaaacttcatattcagaaaagtacaaatagggtcaggtaataaagcactattccatatttttttttaatgcctgccttggaaggtagcaaaacttaagtaagaagttggagaaattcatagaagatataccaaaatagactgtagtggatgtatggattggagtttgccatcagagaggcaaacaaggatgtctttaaacttatttactgatgtttccatttacaaccaaatggggtagatgcatcccacatttaaagaagccattccaaaagcaggaacagcacccctataagatgttatcattcctgttctattaattacagtgtcactcactcttttactgatagccctgatggagaatcagcatgaaccagccattttcctccctgtatatacattagcaaaactttgaccattaaatagttcaaagataggcttgcctcgctgtctcatgcctataatcccagcactttgggaggccaaagtgggcagattgtttgagctcaagagttcaagaccagctttggcaatgtgccaaaaccccatttcgacaaaaaatacaaaactgtgcttggtgtgttggtgtgcgcctatggtcccagctacttgggaggctgaagtgggaggatcacttgcgtgcaggaggtcaaggctgcagcaagctgagatcacaccactgcactccaccctgcagcctgggtgacagagtgagagcctgtctgaaagaaagaaagaaagaaagaaagaaagaaagaaagaaagaaagaaagaaagaaagaaagagagagagaaagaaagagaaagaaagggagagagaaagaaaggaaatctcagatatatctataatagaggaatctctcaaaacaatttctgcaatatccagtgtggtggatctaatggtgaccttccaaaagaaacgcccacattctaacccctgaaacctgagaatgtgaccttatttggaaaaaggatctgtgcagatgtaatgaggttaaggatttctagatgaggtaatcctggattgcccagggaagccgtaaatccaataacattttcttataagagaaaaaagagaagacagagagagcagaaggccatgtgaagacagaggcacaaactggagttacatagccacaagccaaggaacctctggagccaccagaagctggaaaagcaaggaatgattccccctcacttagagtcttctgagaaagtgtagccctgccaacaccttgatttcagacttctggcttccaattctgggaaagactaaatttaagctgttttaggccatcaagtttgtgctaatttctaatggcaaccctagtaaattaatacacccagaacaagtaattatgttttccagagaggtaatgcaatgtagtaaaaaaaaacattttgagtgagacagatttaggtttagacctggggtttctctatactaattgtgtgtctttgaacaagttactttatatctctatcttcaggttcttctttagtaaaatgatggtaagtttcccttgcagggtcgctgtgtgatatgttatttctgctcaattcagtactcaattaacctgttaatgataaattcacgcatgtgcaacatgtctacagacgttaaaaactgttgttttccttgaaaatcaacatacattttagcaaggtattaattagaacatatgggattgattaatgtggaaactagttgtacaataccaaatgttttaacaaacctttattacaacctgactattcatgtcatttcaaataactttcctggttgtcagtggaaccatattcagtctgttcttttactgtctcatctgtaatatcttccatagtttctaatagagaaataatgaaaaagccagagtattagtagaaaatgtttgcgtctagcttgagcttaagtcagatatagagtcaaaattgtgatcacagaattctcctaaatgttagtctcagaaaattgacaagggcataataatttctaggacagagtagtcaaattcatacccaccattgataccttcctatccctgacattaaaacagacaaaaaaaagtagttctcacaataattttatagaggaagaatataggaatcatgcagtttaggtatctcttattctggaataactccttaatactaaattgaggctctagtgagagctattcaaaatgcataaatgaaagtaaaataaattttcaagaaccgatctttcttacttttctagcaacaaacttttgaaaaaaattaaaaattttaaaaagtaaaatatgtaataaattagctataatatcatttgtagctattgtaatttattttttattcattcactcaacaagcattattaaatgcctagtaaatgtcaggcattgtgttaggcactaaagacgcagccttgaataagacatactactccctaccttaaggataatttaggcaaaacaatcaatgataataaagtgcacattacaggaatgcaatgtaaggcaattataattagggaatcggggaaggcattccatagaaaataagctttaaattgagacttgcaagattggttttatgtcagtggaggtgagcacatgggggaagaaaagagtaatgaagagtattcaaaacaaagagtagaacatatgcaaagaccagaaatgagagtgagcatggtgcaccgaaggcatgaaaacacgtttagtatgactagagcatagaatgctagggggaaaggggcatgaatcagtctagaaaatgagacaggagccaggctggaagattaatattaaggaagtcagaatactgttgcaataacttaggtgagataagatggtaccctggatgagagtagtagttctgatatgaagaagattgaacagattaaggacattcttaggaggaagatcaaaagtaccaggtgattgactgcatgtggaacagtacaggatatggaaaaggtaatgtcaagtttctaatgtcggcaattatgtagcaatactggaggtgagagcatgtttggggcaaagaggtgagtttagaacatgttgagtatgaggtgtctgtgagtcatccaagagaagaggtctagaaggcagtgctcagagagaagcctgagctggagaaatatgtggtggtcattcagatgcagatgctaatgaaacctatgggagaaaatgagattgcctgggaggactgcccaatgtgaggagagagcctaagagagagttcagagaacatcaactttagtactgcaaaggttaagtaagactagcaaggctgcctctaatgagactttatacaacccccttcatagtaagttctcactttctacagcaattcagggctcacacttctcttctctcttttgactctcaaacaaaattataagataagcagggtgggcaacaggacttcttgaagataaaaataatctaggtttcaagaggttaggcttgaggtcatggatctctttatttccagattagttttctttccatgccattactctactcccaaggattagctccttatagcttcttctttgttgttagcctggactgttgcctaggtgtcattttagaggggtgaagtttttttgcattatattatattaaaaattttctccatctggaactgatgaaaggacagaagggctaacctgaggcaaaactcgagagtggcagaactgtttcttagagcttccaacctccctcatctctaccttaccccttctttaaaaacttttgttcatttactcaataattagttattaagataatttgtggatatggaaattaacaagccacaccaagtctctaccttcacggagcttacacagtagtaaaatggcagacataagaaccaatgcactaaaagttaagaaagaggagtgtagaaccaggagacaccaagggcatacctaacctacactgaagaggttaaggaacacttcttagaataagtaatatttcaactaagatctaaaaaatggttgaagttgactgtcttggccactgttgcaaggaggaaaactgattcaaccaacgaatttagaaaattgtaatggaaacgtataggttagtgtgccatcctcttgtatttttcaaaaaagaaatcccagaatttgcaacatttgatccaaaaagaatgaatctcctcaaactgtggaattcctgcactagtactgatatggtttggctctgtgtccccaaccaaatcttaccttgaattgtaatcccagggacctggtggaaggtgattggagcaaggggggcgattttccccatgctcttctgtgatagtaagtgaggtctcataagatttgatgcttttaaagttatttggcagtctctctcttctctctctttttctgtccttctgccgccatgtaagacgtgccttgcttccccttcaccttctgccatgattataagtttcctgaggcctccccagctgtgcagaactgtgagtcaattaagcctcttttctttataaattgcccagtctcaggtagttctttatagcagtgtcaaaatagactaatacaagtactatccaagtataagagaaaacattactctcacctatctcaactcataccatgtaggcaggcccttaatctatctccccctgagtccagatttgaaggcaaggaaagaactataagtaccttgtcttatttatttttcaggactctaagttatattatctccattatacagtagagaaaaatcatctgaaaaattacgcaaatctgcccaagatttcaagccagtaaatggggagctaggtcttcattctggtcagttggctccaaagcatctatttattctaccttgaatatatatacacgtatacatatattttacagatggtgtttcactatgttgcccaggttggcctcaaattcctggcctcaagtgatcctcccacctcagcctcctaaagctctgggattacaggcataagcccccatggccagccaagcatatatatatatatttttttttgagacggagtctcactctgtcgcccaggctggagtgtagtggcacaatcttggctcactgcaacctctgcctcccaggttcaagtgattctcctgcctcagcctcctgagtatctgggactacaggtgcctgccatcacacccggctaatttttttttttttttgtattttgagtagagacaaggtttcaccgtgttagccaggctggtcttgaactcctaacctcaggtgatccaccccccttggcctcccaaagtgctgggattacaggcgtgagccaccgcacatggccatatttttataaagacttgtgcacagatgctcattgctactttatttgtattgctaaaaattgtaaacagtctaaatgcccatccttaagtgaatggataaacaaattatagtatgtctatacagtggaatactatgcagcgaaaaaaatggtgaattattgatacatgctatgacataaatggatctcaaagtcaatatactgagtgaaagaaggacaaaacaagtacagaagattctatttttataatagaattcaaatttttataaaattctaggaaatgtaagctactgtgtagtgatggaaaatagatctatggttgcataagaaaattactggagtaaatatatatatatatatatatatatatatatatatatatatattagctgagagtggtggtgcatacctacagtcccagctactgggaaggctgaggcaggaggatcacttgagcccaggagtttgaggttacagtgagctatgatcatgccactgcactccaggctggttgacagagcaagtccctgtctcaaaaaaaaaaaaaaaaaaaaaaaaaaaaaaaactttcatttctcttgtgtaaacatgtaggcatgaaatggctggataacatggtaaacatacatttaactttttaaaaactgtcagactgtctctaaagtggctgtaccattttactttactgccagcaacttatgaggcttccagtttctccatatcctcaaaaatcttgctatgctcagtcttttaaatgtcagtcattctaaaggatgtgtaatagtgtctcatgattttaatttgccttcttctaacaatgattgatattgagcatcatttcatgtgctcatcatataccatctttttctttttcttttttttttttttttggtgaagtgcctgatcaaatctttgcccatttaaataatatgttgtatattattgagttttcgaagttctttgtattttctggatataagttctttatcagatatattctttgcaaatattttcttacagtctgtggcttaccttttcattttcttaataatgttttcaaagtgcagaattttttaattttcatgaaatctaatttatcaacttattcttttatgggtcattcataaatgaattgtgcactaatcatctcctaacatactacatgagttacttatcttttcactgatggatcccaagtggctagtaaagtactgaatacacattaggtatcaataaacatctgatggataaattaaaatttcaaatagtgaaagcaaaattatagaaacttagttcattggcagcacagaaaataaaatagcctctagtgcaaagccatattcaattttttgttatctgatctagtatgaagtttgatcgatacaaggacccaaatttattaaatcttgttaaagaacctgatgctctctctctagagacaatcctttcttccccaaaatagaaatgtgaaattccatagaacttaaatgtaaagcagtaagtcccctacccacctctgtgcctcacctcgcccgtgactcaagtgctatatgaacccctgcaaataaatcaaggctgctgaattctcaaaagctctaattgtgccaattgtaaataagcctcaggatgaatttcaaccagcagtgtccccaaaaccattatctgcaactataatccattacttttctttcataattaatttttctaataggtcagtactatttgttttgtttaagcgctattccagcaatcccattttaccaacaaccaatgtcaattgtaattatatacatattttctattatatacaacaaatacattcttatattatgcgaaacactaaattgggcagtgattttttaatgagtaataaggtaatatgctacattggtgctcaactgcacttgtcttgaccatatgaattaagagtctagtggaaatttataagcaccttgaggacttccaggtatgtgggtgcttaaataggtactcaaaagatgctgcttattttcatagattttaatgtctaaatcactgggaacaatgacaattaccagagatatagataggtggttagataaacacacaagagatatgtatgttagagacatacacattatagagagtataatagggttgtatacacacctacatatacctatataatgtgtgtgtctgtgtgtttgtatgcatgtgtatgaaatcaaaatgcaattcactggaacactgaagacaaagcggtcaagcagctgagagaattcaccatactgatgagctttcctcctcagagagcttgctcctcaggccctcactcaaaggctctttattctttttagatacaattctaaagagtttgatatctacttttccatccacaacagactaaatgctgaaaactcgagagcataggtgagcttgtgtttgatgctagctgcaagcagcctgacacagggagaaatgagagctctcctagagccaatctggggagtgtcctggtgagggcactgagacctgctagttaggaggaggcctagtgcaaacaggcaaaattgcttggatgaagggtaatcaatctgagcctagttcttttggatgaaacctttgagaactcaatgacaagaggatatggatccaacaggagactagtagagaatacaaattcattattttgctatacaatgctagttgcattttaaacaattgtttctctatgaattttactaccaggcttttctgaaccattctgtgtgaattcaatactgcctggatttttaaaaccacttctgacactataaaccagagaaatctttcttaaaagataataagaagatggggccttgcatttctcataaaaggaaaatgactccaccataagtgtattcattacacactgttgaggcatgaattcagggaaaattagactgaatatgagattaccatcctaactttctgaaacactcccagcgctgtcaccagagttcttacttcaaatatttactcttgatctaaaaatatcttagtccaagaaacggaatgattactccacagttaaagtatatttagtgatctgagagaggagaagtttcatttcactcaagcaaatggttttagtaccacaaccaattaatagcttcatcatgtgtgagccatgattataaaggaatcggactaattttttaaacaaatctataggcttctcacaagggctatttttcacaatggtcaccttggaagaaagtcactccagggataccgtcattacttcagatttgggaccttacctttagaattggttcatgagaaaaaaaaaaaaagaaacactacatgcttcatagttaccctccccacctaacactacatatccctgatcaccaactttgaatatgcctcatttacactgatcaaccaaaagcctcctggaaatggtaacacggcctatttatcctgggctttactgggagggtgggggatgaagagggtttataggaattaagagagtctatttttaattatttcatctgtgaaacatatgaaattcctttggccaaaaatgcaatataaaactcagattatcaagggccttttcgtgggaccagtgaaatggagaaaaaagtctccatgacaaaatagaggacttttgggaatccttttttttctgaggtttgcatgtgtgtgtttctagcttggctctcacctgaactgctctttcataatctactgtagtcattgggtacctggaatctgggaaaactccaaccttactccagcacttgtgcaataacacagtaaggcacatggagtcaagtttaagcacttagtccagggttctttgcaccctgtgggccttcagtaagcacttgttgattgactgaatgcgtggctcactatcaatgtgaattaactatatacatactgcattaaaatccaacaacccaaatactttctagctttcaggaagtaatgcatctaattgacagaaccactcttatgcctcctaatccccacttcctacaaaccagctcaaaggaagagagagaatttgaagaaacaaaaatgaacataagaaaaacaattagctgatgcactctgcaaagcctgtaatattatctagaatgacagcatagccattgttcgtgctgccagagccccgcgtgtttgctagctcacccgaggtcctgagagaataataaactaagcagattagatgtagactgatgcctccatgccaccaccaactcacacaacacacacactgttctgagtgtctgaacacatgcgggcaggtaaacccagaaaatgggcactccatgttggcaggaggggaagaggctgccaacaaacagggcctgtttattatttaacagttggtactgctagaggcctggcaccgctatagagcactctctgtttcagtgcaagtcagcctgattatgagagcgtgtgagccaaatcatgtttaccatagtctgtgagaacctctgtgcccccaacagacatggaaattcttacaatagctctcgtccaaacagagaaaaatcactcctgagatggaggtaaagggccccacgtgcttaaattttgtctgatcagctggctcagtgtctctacatgtagttgttttttccctgctcaagacaagtcattcctctctaatgatacagtttctaatcctctgcctttggttactttactttgggacctaaatcaaccaaatactatgtcaatcacccatctactaatattgcttatgctgtcctgcacgctttggcttttcagcaaaagaatctgctgcccagggcggctacctcctgcttctccttcgccagggctgcctctgcagtaagtctcctctctgccaatgtgggccacaggtggatgccttcctacaaatccaatcagcaggataatgtgctactatcacaagagtggaccttaatgacaaagagccctgcttagatggtcaccccattaactttgatttgattattctgccccagcagaacacttggcttcacaaccacagatggcaacagtccaacataaaacctgtagacagagtagtcatgttgggttcatacattttcaaaatattaaatttcatgtaaaaatataaacatggtaagtattgagagagtccctggttccctaggaaagcactgttttcttttcttttttcttttttttaacaaaccaaggtcagagcactgagacaattgtgctaactaggcaacagggataatctaatcatttcttttgaaattcaacataaatcaacatttcttttaagtgtaagaacctggcttttatcttccatatacaaccaaggcaatctttgatactttatgtgactctattctatacaactgtttttaaattcaagataaaattggctctatataagctagttcaatattttgaaatttaattgtaacttggatacacttcctctgtgaccatgagtaaatcattaaaatgctttctaccaatgagaataaaggcatagcaaactataagtcttacctgaaactgtatgcagtgattgttttgtgttttgttttctaattgacagttgatatttatacactaaattatcaaactactatttgtttttaattaattcctcaactttgccactcaaggaaaatgatatatgctttgtattgttaagtaaatacataattttatacttatcatgttattatggttttcaaagaaagtagttgtccctaggtcacagattatatacacatgcatagcaaaaagactttacaaaaacaaggaaaatatgaaaaaataattgcctagcttggatcaagttaacccctggtttaatttaatcatctcctctactgaggatctgataagagattcttaataacagccccaaattaaggcaatagaatcaggaaatctttttttttttttttttttgagatggagtcttgctctgctgcccaggttggagtgcaatggcgcaatctcggctcactgcaacctccacctcctggattcaagctgttttcctgcctcagcctcctgagtagctgggactacaggtgcccgccaccacgcctggctaatttttgtatttttagtagagacgaggtttcaccatgttggccaggctggtgttgaattcctgacctcgagtgatccgcctgcctcagcctcccaaagtgctgggattacaggtgtgagccactgcgcccggccaaaatcaggaaatctttcccaaaacatcctgtatatagcaacactcataactactactttatggcagaataatggacccgattacaggttcacatggaaaaagttgatatttcagccacgaccaaaatataaacaggatttttcatagggagtagatggtgtgttcatagcgagataggtggtgtgttcatctctgtgctgagatacttcatcttaactagtaagaaacatagtaatccctcacattcattaagaggtatgctgtaagagcttaatatgtatacacccatttaaccttcataacaacctttattttttagtgactactatttacagtgattactattattttctccattttacagacgaggaaactaaagcacagagtggttaagtaacttacccaaggccctgcattatgtaaataaaggggctaaaatttgaactaaggtggtctggctccagagtcaaagtgtaatcactgtgttctgcttctcataataacgatcactctttctgaagcttgtgttcaatttaaaactgtatattccctgaggctgtagaatgttagagctgaagtaatttaaaatgatctaacccatggcctaaagctccaggtggagagaggatgtttgggaagactgtgtagcctcaaaattttgtggataggcacacttttctgggaaaagaaatgagccactcatctagtctaaatgtctcagttgagggattaaaaaaaataaagccacaaagcaatggctgtaaatgctgcatattttaaggaagcaatataaaaagaaccaagcccagaaaccagggctgttttcattatcctgtctacccaaactctcttaggtggctcccttaaagccagaagaaatctgtgtgagggatgccgagtcagcctgtttctctacttggctccacatgactcagtaaagcaaatcaatgagacaagatatctactcatgcaagaaaaaacagaaatctagtgtgatgttttcttgactattcaatgctaatggaaaaaagttggtaacacatttaagaggtaagaagaaataaaattgtctctttacaaagttgactgatttattcatttagtagatacacacacaggtatacacacatacacacaatttatttattttagtggtagcccagaaactttctgaatttcttttgtatttctcttgagtcttttcctgtaatttatatttacttaaaatttatcccttatgttcaaatttttcacatatatatataaagtattcattataatcattttaatttcctccatttctctggttatttccccattgtatttccaattttgtgcatttgtgggatttctcatttagtaattaaatcatgtgatattggtttgtttattgttctgttattctctttgaaaaaaccaactctttgatttattagtgtgtctcttttttattttctaattccttaacttctgactttatttttttaatcaattccttgtttctactttgcagatttgttttttgttcttttaaccaacttcatgagatgaatggtaatacgtttataattattttctttcctgtaatagtcatgtttaaagatatggatattcctccgaacactgttttatctatatctatacatacttattttctgtaaattctgtaatgcctcttaagcaaaaaattaattttaaaaagttattggtcttttttcttatcaattcgcaggagctcttattttttggagatactatttttgtctgagatacgagttgccaatcaaaatgatcactttttcatatcatgtaaaaactgttttttaaatttttatttgcttgatttttcttattcacaattgtggtaatatcagtagaagttcttctccttcctctcccagctttttgcttcctatatggtttttggtcccattagagttttattttcttcttctacttccttcttgttctctcacagacaattttatttctccttatttgtcttatcacttattcaatcctgtttatctagtttttgaactttcattttattttattttattttatttattttattttttgagacagagtcttgctctgttgccctagctggagtgcagtggtacaatctcggctcactgcaacctccacctcccagcttcaagtgattctcctgcctcagtctaccgagtggctgggattacaggcgcccaccaccatgcccggctaatttttgtatttttagtagagagggggtttcaccatgctggccaggctggtctcaaactcccgacctcagctgatccacccgccgcagcctcccaaactgctgagattacaggtgtgagccacaccgtacctggccttgaccttttattttaaggaggccacaatgtcttctatttatttgctagtatggaaaatagatattattttcttgtataattcttcttgtggtatatgttttgatctggtttctttgtattgcttttgtttttgtttaaagctattagctttgcttagctgatagctaaatctgggtccaatgcaggttcctttctgattagttttcatttttcactgagttaattctatcagctgtttgctgcaggaaagaggctggcacagtaaactgaggacttcagggagtttctttttggtaccatatttcctgttatgttttacctttctcaccaactcgaccgtgcacattgttcaagagatatggatctgcttagtgttctcagtgtcttgtcttccccatttagattagcgggagttccaaagggcttgcacaaagtcctgcctgatacattttccaagtcatgatctaatatttccttatttctcttctcctgaaggtgatcaacagtggcaaaggctggtgtggtttatcttctccaccttgccacccatgcatcctgcttttggcacatgtggcaggctggtgtcattcctcattcactgccacctcctctgttatcatctgttgtagaacaagccttagcaacccttctgcagaccacctatagcctcacactttcctgttgcatgtaagtaactggagcatgtgtccatcaacttttggatgttctacctgctgcctatatttaaaatactctcgacattgtccctgttctaaatttcgaaatatcccatggtttctgatttgagagtgtacctgccttctgtaagaaaaggcttttttatatgcatctcattttctatttaattgtttgttgcacagcaacatatgcgacagtgttgcatttagtttttcatctgtggcctcctaaatggcaaaaacaaaacttcacttattagctcctctccaatccttctctcaatcaagtgcttgcccgtccttgtccttaaacccctggactaatcccttgtaaggtgtcctgttgtaaggtgtcaactacagcattcacattcattgaccatttatatttcccctcataagcatatttgcatttaaataggagattttaaaaatctaaactaaactttagactaccagatgaagttataaattaaaactttgattgtagaatgacaaataacatggtatatgtggaaaagaagttagaggaccccaattagtatctgtaaaatgacctcatgtgagtagcaaagttatgtgtgagttgctttaatctttaaaattagcttctgcaatgcttcattgttttctataatagaagagtaataggaaaatgaggcatttgttgtaagtaaattttctagttacctgtttaagcagttttcttttaaactttaagatgaaaatctttacaatgagttcctattttctgaaacaaataagtgacttgatatggtagaaatgtactggagtgagtagttccagattcttaagttctttctgttacttattattaataaagttttgacacatcatttagcccacccaagcctcagttctcccatctgtaaaacaggaatagcaatacttcctttcttgcaatataagttttctgtgagtggaaaatgacataatatgtgtcaaaatactttgtatactaacaactagaaaatgataagagccttaataataaaagataatccaaataaaatattacactactatcaaagataatagaggctaacagggaagttatataaatactttcatgattcttttgtgtgttttttcctagttgtttagccaaggtactcacttctatttcagttctcattgccatcagtgagtctgcctctagaaaaaacactttctgttttcccgcctcctcttctccagtacatttgtatagtttttgtctttgtttctttggtatgttttctgtggctttaaattggctgcaaaagattgcatagggtaatgaaaagagaaagcagctttggagtcagacagacctggtttgaatcctgactgtgtttttgtgctcatcacttaacgtccctgaatctgtttccttatccataaaatgaatttaatcactgataccctgcagggctatctaatatgtgaagttcttggatttcatcaaatctcatttgccttcttaaaagtatattttgcttatttctgtgtttttaattgaagctttatgacatttgacaatggatacattgctgcactctgatcagtaattattttattcaatgaatcatttcactttttttctaaatgtcaccaaagactctagcttccttaaaatctactttttgttaatttccttgactaatcttatagttccaatagtttctctgcttcaatcagctttcttttgtctaaacttcttctgttttctcttgtaaaataatttatcctaatcttaaatctttacgacagagaccatatcttctttggccataatgcatcgaatattctgtaaaaaccacatcactatcaatcaataattatgtgtgtgttataagtatgtaaatgttatagatctcatagaacttatccactctgccttagcttattcctagaagatcacagattactattatatagcatttgtataactctttatcatttgtgaacctttcgtaattatttaatggaggtcttcaaactactagtatagattgattttgttatttctattgttgggaagggaaaacaaagacagaatgatgaaaacttgtcagatatatcccatgttaccaggaaaaacaggattagcacacagtctcttattctctgatctgctgatagtctgttgagctagtgttttcctagcatgaaaggaagaaacatctattcatttccaattattattttctggaaaaggtattatggagatggttctctttatgttcaaaataaataaaatgtccgagtgattcctggaacttgggagaaaggggaaggtaaaccaaaaactagggccagagagcaagaaggaggtaaaggagataaaattcgtggtgggtgaatcctcatccgtcattacatgacagaagtatttaaaaaggaaagctactacctctcctcatctgaggcttcctccagaaccctgtaggagaggaagatacactgctgagtcttcatttggggagcagcaggagaaggcagtgcctccttagccaaatgaacctttcctgacagctgtggggatatgtgtttgtgccaccaggccccttagaaaattatccctaaaataactaatgtttagtcagtcaaaacaacaacaacaacagaaaaatagcagcttcaaagcgaaagttatgtggcgagagtaaataacccaaacttaacgtgaccttcctagcattattttagggaggcgttagggtatagagagtgaaaaacaccctgaggtgggatttacaagtcttaatttcagtttcagcagtttcactttctggctgtgtggtattagacaagtggcttaacctctctggacctctctgatccttcagatttaaaatgagggggttgattactaagtgacgtctaagagcccttctagagataaaaaattccccaatctatgataataataattaacatttgatggtcctttaccacctacaaatgatttccacatacattatctaatttgatcttcatgccagttctgaggtagtattattatgattatgcccatttttggaagagagattcagaaaccacaaaatggcagagttggcattgaacagatgttcccaagaggcaaataccccttcagtaaaagaagcagctgatgctaacaaggataaataagagcagacaattcagcctgtgagctcttgtttaggggtacaacagaatttctggaagctgcattggggtaatgataatccaccatgtggaatgttatctgatgatgtatttatcaaaaaaaactaataaaaagaaaattaaaaaaagatacaataattgttactgcactacaccctaatgaattattgtgttcaaggttcttacaaaaaaaaagtaatattatactcggcttatgttttaattgatttattaatattttatcacaggaatgtaatttaagctcctcatgatttagatctcataaacctttagcattttgcaaattcaaattccaatttaaagccagggcgagcaattaacttttctatcatcttgtcaggggagaaggttcgtgtttaatttgagacaaagtgacagaaatatatatacactgtatgtattactccaatttaatttatgagtcagcaccatccaccttcaaaatgtagatttaatagaagaggaggaagaaaaggccgtgctgtcatgatagggctgtaatatctgccctgaatttcttacatattaaaaaaaagtcactggtttgttgagataccaagctagattgattgcaggcctatttccagttcttttgtttcacattccacttcctgattcttttctcatacagcacataatctcatggatatcacagggagttcttacccccacttctacctctactcctaccccatcctccattttcatgcatagctgcttctacaggtttatcctaaatcttgacaagtgagataaatggtaaatattgctttgagatcacgtcttcatcacctttctcatctttccaaagccaccttctaagtgctctctacctaaaacaaacaaacattaaaactcctcgcaattttatattttaatgtgcagggtgtatctggcacggtaaaacactggcactttcccgtgatcctttacaaaatatttaaggacaggatatgaataaataagctaaaaccacagaaggtagtcaggtgaactgtagggaagtacttccccttggtggttattaagcactggaacagggctgcggagagaggttaaggaattcttactagcgccgttatcctataattcaccaaaggcacacaatgctctatgctgatgagatgagttacatgacatctcctccctggttcaatcaaaggaaagcaatttacatctcaaaccagttctctcatcagtgggacataaaaactgcagaacagagatgcagcaaatgtgcttatttatacagaatcaactcagttgccactgttctttattattttccttctctcccacctcccctgtatggtggccattttgaataggatgcttaaaattctaaaagtgagaaaaagaaccaagaacaattcagtaacaaaattaactaaagataacttgtgcttctgacaatcagtgtcccttgtggtgctaggccaatccctttgttccacttaaaaataaaatcggattcctcttgctggccacaggaaaagaattagaagacgattaatggaaaattctggaaggtagccttgtaaatgtttattcacttttcaggcatacaatgttgtgctacataagtgaatacagtgcatttgtcaaagaaaggccatgttgaattagtgtgaggtcttcattcataaaacaagcttatttttactaataatctctattaatctcagcttaattatattaggcatttttcacttgcatacaacagtaaaaatggccaaaactgcatttactgcacctgcttaaacgcagttatatccctaaaaacgattgcagggaacaagctcccacagacatggcttttaggcagaatatgggattatggcagaggggtttaaatacaggaggtaaaaatggtaatcatattcatcaactacacaaagaagtaaaaacaagaagctctagataattctttttagtggactcactaaaataacaataacagcttgatgaagagaacatgattgtcgaaagcttgtccattttacattttctctttacatagtgcaataaaaaggaagcacctgcagtttctacttgtgcgtgtattcgtgtgtgtgtgtgtgtgtgtgtgtgtgatgttgaaagaaatcatggacatcatatttgctttaggagctactagtctaatcttaagtgcacattccctaccataaagttgtatttgagctccgtgcagtgcagaaacattcttcagcttagaaagtgcagtctttgcttcacacccttttccttcattcagacacatcagcatcttatcactttggacattaaagtaaaagagacttctttgtcatgaatatttttagacaaattacaccaaaatatcttgtattttccattttttagtggaatctactttactgacatataccagcccaccataacatcactgttgtgatgtcctactacttatctaaaaaaagtactattaactacatattgcaggtatttgaagtatataagaaaaccataaactgaattacattgtatggctggtatgatctcacatgaagtttgagctatcattattaaaaacagaaattgcatttagttaatgcatctgacagtaagccagtcaactttcaaggttgtatgatgagaaaaaaaatattttttaaaaaaacagaaaatgcctgaaaaatttcacaagagcatttcacatgacaagagaattcttcctctcccttctgctgcctgcctgcccacctttcttccttccttccttcgttccttcctttcctccttccttccttctttccttcctttcttctttcttttcctccttccttccattcttccttccttcctttcttccttccttctttccttccttccttcttgccttccttcctttcttctttcctttttcctctctccctctcttctccttcctttcttccttccttccttccttcttccttttcttttctcgtgcttctctcccttagtttctctcttctttccttccttccttcaatttggtggaggaggtgcaaaaatttgagtaagaaaataatatttttgtttcagaatccacatgcttttactattcatcatgctaacttagggggaaatttagataacttcttatggcgttttttttttttttttttgagtttatagatatctttcaggggtcaagctatttccaaacattcttataatggcctccaatattccacactgcaatatatagcatgctctaagcaaaggcagtcttttataaaagactgcaatagctagtgaagaaatacttttttttgattacttttataaaggcacagagcaaacgacagtacagtatgtacataaataaagcaaaggttcaaactgcacttttacaactacaatgtcactaatagacctcatcccctctctgctattctatatatataggttgaaatctgaggcttaaaacaatgtttgaacaacaaaacagaataaatgactaacccaatctttcaggttccaaaaacagtactggagagttttctatttttataggtgtttgtcactatggacattcaatatctataattctgaaattacagccgggcgcggtggctcacacctgtaatcctagcactttgggaggccaagatgggtggatcacgacgtcaggagatcaagaccatcctggccaacagggtgaaaccccatctctactaaaatacaaaaaattagccgggcttgttggcgtgtgactgtagtcccagctactcgggaggctgaggcaggggaatcgcttgaaaccgggaggtggaggttgcagtgagccgagatcgtgccactgcactccagcctgacaacagagcaagactccgtctcaaaaaaaaaaaaaattctgaaattacaacaaaattaggatctgaatatgtgttttacaaaatgatttgctataggccttcatgggggagatggcaatccctagtatatcaaacactgtggcttaattttttttaatcttcacaaaactcttcaagaatggttgtcataatgtaagaagtgtcagcattaccagaacaatcagagatttccataggcagaataacattagagattacgtcattacaacagatagccctcatactcaatgcatcttacatggtcagttaaaccaaagggtaggaggcactataggataattgtgagaagagttgctttctaagtggaagaaaggtgaaaataaagcacctgcagtgctgtgctttcactttacttcctgccctcacagtcatcctggagatcttactggtgtgctttaactgtcttgtggcattctctttcaaaagcatcttcagggactaaagttcaggttttatcagaatagacatagtcctgtgctacttgacagaaggcattttactcttttttatggtttcactaaaatcaagagtatcacaaaaacatcttaagatctgaaactgggaatcgcctcataagcatgtcttccaaccctacaggttgtataaggcaagtatgtgtagattgaatggaaccctctatgtctggcttttcagtattgtaaagactttcaaagctcattaagtacttctttgctgatacacaccaagctaagtcccacctcagggcctttagaccttttgttacccatgactggaatgctcttcctctagggtttagcatgcttctctctttattctggtttctcctcaaatgtcacctcttcaggagacttacactgaccatcacatctgaaatagcttgccaactttactctacctatctcactttattatttttcatagtatttatttttttccggaaattatgtactgcttattatctgtctcccctaataaaatttaacttctttgaaccaaatactttgtcttattccttagtttattgctagtgtccagtactgtgcctaatatatggtaggtgctcactatatatttgtcaaataaataatacttaaaatttaaaaatttattctcctttaagttgtacagtttaagcctcaccttattttctgctgataagagaaggtatcacctacaatgacccttcacattctagacaattaacaaagtctatgtggaagaataactattccaggaagaatgtgttcagacctggtttgaaatcacagcctgttgctgtggggcatttattacccaccatttagctagattactgaatagatggagttaaccaaaatgctgacaagacacacaccacacacacacacacacacacaaacacacacacacacacaccccccaaaaacgaaacctcagccctccaaaactctccttactcttgtaattggagtgcattgccactttgctccaagccaaagaacagataagaaagagaagcaaaaatcagaagaactttggaagccatttcactagagctgccacctgtcacttacgtaagaagatgcaatcatccatctgtccaaactggtgaatcataaggtcttaaatactatttactttccccaaaatagtgaatcccttgcaattttatatcacataataacaaagggacatgattcttatttgtttttcctttagatacacatagaacattttctttaatgtggcatacaactttaaaaatataaacaccaattcactgaggtatttttttggtagaaaaaagtgtctatcataattttagtagcaataatagttctgtacatttcttttagcaattacaacctcagatttctaagcactgtgcaaacattaatttactaagttctgctgtgttctctttgtgaattagaatattatcatatcttcattatttttaggtgagagtcacatggctatgacttgccagggccacacggtaaataattttttttaaagtggtaagatgcctctgttttgaaagtggatgcccagggaagattaataaaataggataagaacatacctaaaatggcatctgtttttttttttttaacctagtgcttccattcaaattttgttttgggatatgaagtcacctgatagctcagttcaaaactcgaataaacatccttgaaaatagtagggttattctttaaaaatagtagttatcaattattgagtgtgcaccttgtgccaggcacagttctaagagatctagttctaggagggaaagtgtacgagtccatgtgaacaaggacttggtgtcttattcactattgtatgctccgagcctataacatacctggatggtagtgagggttcagttggtatttgttgcaataagtgtataaataagggaagctttcttggttccagaaaactaaactgtctgaattttgaaacacaacctgtttgtaagttgggggcatcatattaaacattttcttttggaagcagaggagaagggaagagattttatttgacccaatatataaccaaatctaggataatagtgatcctctttacaataaagttcatttattcaacaattatttattgaatacatactatgtgccaggtattggaagaggttctaggaataaagacaaggtccttatttcagaacttaaattactgtttatgggcataagaggaaaatatcttcatatacaatgcaattatgaggcaagatttttctatgaaccagtgacttctgtttgtttttaccatgttaccctcctaatttactaaggcttcaattacttggttttcttctgagtagccaggaggacattatagcaaaaagtaagtatactgattaattacaacatatatccataaagtggaggggatatctgaaaatcacctagagaatctgaccaatatctaagaaattaatttaggtcaaatgattagttctgaaatgtctgagttatctatattagttattcatattgccagttcttaacttgttctatacaaacacaatctgaagcttcatctgggcttcttcaaattggaacctagttacaactcttaatggataagttcaagaataatgccactacaataaaaaagaaataaagaagggcacaaagtattagaagataaattatctagagattaataaagtctttggtaagagtttgcaactctatcacatatgggctaattggaaatcactgcttccagggctaatgacctcatttgaggttaccctgtgggacaataacatggcctacctctgtccactaaacaaattctgtcaaaacataacttaccaaagtatagcttgttgaggggtatacatatctgaatttattttactctgataatctgcccgagaggttctgttacttgaaggcaatatcacttcctttgggttcacttgtaggacacaaaatgcagcttttacaagtatttctgcttgtaaactaattcttcagctatagtatataaacttcactctataagaaaaccaaagaggccaagggacattaagtttggtgtttaattgctatcagcaattaaaaattgctagcagcccacttaacattttcttcttcctctaaaaatgaaactgaaacgtatcttttagctgagagttctgtaatgctgagaaaacatcctaaatacatcttggcaaaggaagaaaagaaaaaaatgtgatattgatgtatttgctttcctagtatattgaaatcaagaactagatacaggtgacagatctgcttccacctgctggctcagtgaatttgtaaaactgaaatctgttatctaaaaatcactagtacattcagaattacttagcattccctttctgtttgtacatgttcatgacaatgataaaacagccccaggaattctgctaccaatcttcatatatatgtccattgacattgtctccatcaaattcaatccaataaaattaaatggagttaaataaagcagtctgcttgaacctcagtatctctcatttcttattgtattgtacctcttatcatttcttatttatttagccaaggttaaaaaaaatggtttccagattcaattataatttccctcctggtctcctatttcttaagtattttttcctttttattttcatataattacaaggatttttttttttggcaattgacatgaacaacattattcaaaggaaaaaatacttaaagtagctactatcttatagcaaagaggacatttccatctatgtttaccataaaaattttcactggattccaacattttcatataatactatctacaaatattgcctgctttgagaagactccaaattttaggaggtagatgggcgataggtaatgcatggaggaagttggtaaagaagacaaatttctaactatgacttccggagttaaattttaaaagaaattgagaagtatacaaaagtgttaagactgaaatatatgcaattggcttacaatttctccaaccacttgaggcaagagggtaactccaacttttgccccttcattgccacacttcttcaatctgcatatggattttatgtttcccctttacggctgcccttaatattaattttaacctcaaataaaatttttttggaaggaagagtaatatacacattataattttctctggagttttcctcccataagcaacagccagatgacaaccaacttctcattagtctcttgaaaaacgaatcagaaattttcttatgtccttcacacaggattgccatctattataaatagtgctgaaagaccccacacacagcaaactgaagcatgtggcatttaatacatcacacagaaggatcaagaattgagtcaacacttctagggcttctacccctcaactatgcatttccatggtacccatttccatggtttttagacttttaaacaaacacatttgtctaaaaacaaatacatatgtaggaaacatttctccagggctctcgccttttcagctgcttttggttgacagatgagaacccacatacagtattctgaaattctgcgtcttcttgtcttaagtactagagaaagaaatatttggtcctaggtggcagatcttacttatatcacttctattaaacgggcaagatagagtcacaaaaagaggacttatgattttcaccttataatggattccttcttggcttccttccacctcctatacatggatttgaacttcattttgaagacacttacaattattctgaatgaaaactatcattttcattctccctctcaaaaaagtttctgaagaaatttgttgcaaagccatgctatctgtaacattacgaatatgttagcatatttttagtgcttcactagatttcataaatcttacttacccatatcaataacaaccagtataatttgaaggaaaaaggagaaatcttgtgtcttaaattatatcatttaaaattcatggatgaaggtagtatccctagaaatgatctgattctatgtgactccgggaaagatactatttcatttctgttttagagattaagaaactaaagtacagataagttaactaacttgcctaaagccttctggtgaatgagatagccaagatttgaaccgtggagtccaacgccagaggcttaaccattacattattctacttctgtgttaagattaatagagaggaattaaatgcataattttggaggcaaacagcttaagttcaaatcccaatttcaccagttactagctacatgaccttgggcaaagatcttaaccactatgaaactttatttcctcatgtatttaaataatagctgttcttcactgagtactaagctatgttccagttatcgatgctaagtgttttacatgcattattccatttaattatcataataactcaaccaagtatgtagtgttatcatcccagatttagagatgaagaaactaaggttgagtaatttgcctattgttatacagtaaggggcgaagacagaattctagtaagggcaatctcactctagacaccttactcttagtcattaaatttggtgataataaccaatagtgtctacttcatggggtttggggttgtgttttggtcaggattaaattaggtaatggaggtgtaatggctaattttataggtcaacttgactgagccacagggtgctcagacatttggtcaaacattatttggtgtacttcagtgagaatgtttctggatgagattaacatttgaatcagtaactgagtaaagcagattggcctccctcatctccaaacagttggaggctggaacagaacaaaaaggctgactctctcacaggtaatagggaatttctcctgcttgacagcctttgagctggaacattcctttttttttcctgtcttcagactcaaactggaaacatcagctctctgcaggtctctggcctaaggaagttcagactaggactataccattagctttcccaggtctcaagcctttggactaatacgttggactaacgcaattggctctctggggtctctagctttctgactatagatcttgggacttgtgagcttccacagtcatgtgagtcaattccttataaaacatctcttctatacaggtatacattttattagttccaattctctggaaacatagtacatagtttctgacacccagaaatagttaatgaatgtttcttaaactgctttcccaagaaaagccaacagaaaaggaattataggatgaaaaagcccccttcagtaagagcaaagataggtccagatgaggaggataatgttctgtgggcactcggctcttaagagaggagcaggggtaggggcaaattttaaaacacgatctgcagctaggtcagatgataagcttgtttatgaaataagagatggcaggaaaaccaggttgatccagatatcaagaagaaaagccactttcatcttccactaccctaactggaagggaatcttggttccttaccatgatagcaagctgactagaaatatagatgtgatctttccctttgaaaagtaacaggttacagggaaagtgaaggaatttatagaaaaggtcaagtttgtttagtgccttactgtgtactacttcaaccaattcagctctatcacccaggttggagtgcactggcacaatctcgtctcattgcaacctccacctcccagattccagcgattctcatgactcagcctcctgagtagccagggttacagacgcaccccaccacgcccggctaacttggtattttcagtagagatgggatctcaccatgttggccaggctggtctcaaactcctggcctcaagtgatccacctgcctccacctctcaaagtgctgagattacaggagtgagccaccgcacctgccccaatccaactcttacatacatactttgtttccagctataaaccataggggcataaaaagacttctctatggaacaggttaggtccctgaagttttcaggtctaaacatgctggagatggcaattaaagctttctaatatatgcgagttacattaatatctttgaaatacccattcaattaccccagctcaacacctgttagacaccctctctgtcaaatctcttctgaataactttgtttagttagatttggggccagtatcgtaacttcacgtagtctgtacaggaagaaaataagtaagctttactctggatctcagggaacatgtgtttctcccatcatctaagctaaaaaacaaggaagctgcaacagctgggacaagaaggaaaagccaatttgatttttaaagaaaatagaaaataaaagcaatttgtccaattccaatgtgtggtatctatgctgatttttctcaaggaaaagtgcttatcattgccaaaatccccaaagtaaccacagctgacaaacttctcagcatcagagcacttggcaactgacaataagacctgctccttccccaagcggataaaaagccaggaactccccaaacaaaaccaacagcttttctgtactcttagtctgccttcatgtcttttgagcacagtatattgtcctgtgtaactggaggttcatgtagcacactgattttacccaaagcatcaaaactaatataattaatttatataatcttctagttacactgactatagaacttaccttcactacctacccaaatgtctgctgctgatatatacatatgattgcacaaattctaaagagtactctcaataaacagaaatgtaagtctgctaaaaatgcttaaatatacaaagaaatgcaaatataagctctctaccatacataggatctttgtttataccagttgcacatgatcaatggaaaaggacattcaaaacacttttgaataaacaaattattatcttgcattagcttgtatcaatagaatccttccaagtattttttgttcataataaaaatgtgtataggttggtttgattattttttactcttatcatggcaactcaatataacaatactgtgcaggtggaagagggaagaggggaaaggagagaagctgcaaataaccaatttaattaccctaacagtcatttttttttgcaggaaaaaggttccatatgataagaatgtttgttctgatcaaatatctttgctccataaagaccttatgaatcttccttcaatgtgaagctaagctatttctgaggagctactggaacctcctcattttttctagaggtatccatgttctaaaaatctcaaatgatctcaacttaggaggttactgaagctacataaatgtcaaaagaaatgatagatttacacttctccaatttctgcatttgttatgtagcataaattcatgacagaaaaaaaatgatcctcaaaactccttagaagctcgctcaaaatcttgttttaagtctactcaaaccaaaccaagttctgctaatgtaaacccttaagatttgtggtagtttttcattcccaatattaaaatagtcttttattaattctccatcacatcatattttcccttgactactaaatcaggtccacatttgttgcttctatgtttttgacatcatggaagaatctggagcagtggtacattttgctcttcagagatattttattggtttaaaatgtttgattactaaggggtttaatctagtaatactagattaagtactgtctaccataggaaaaaattcatcagacttaaggtgtttcctcttaagtggaagtagaaagccaaatttcaaagcctaccgtgttaataacaaatgcttccttttatattttcatcaaaaaacaagcctatttccttatctaagttctgtgcaagtctttctgattttctcacaataaactatatgtgtgaaatcccatcagtgttatcaccaatatttattcctgatggccacagcttttctaatctttgtgtagccatatgcttaatgttacataacccacttggaattcctttcttacaaacaaatagcaaaaatgtaagtttatgaagtatgcattccttttttaatgccaaaaataaaaacaaaggaaaatttctaaattggacatgtgataatacataaaatctatctgataaaaagtgtgtaattactgtcacaaaatcttcacacaatccttgaaatctcagcagtagggtggcaccaagttcccacacatcaattaaagcatgtacatatacgtcattggcaataggtcagtctcacagagaataatctcatgatgccaaagctatcctacctgaactttaattcctgaataacaatgttggctaatagtgttttactggatattgtcttacttgctaacatttcttatggggatcttgattaattggctacctaatccccaaagattattccagaaaataataatgtctgaaaagtagaggtcttttctttcacctatgcacaaatttgtcatagttaatatgaaattactttgttcatctgacccctatcaagtaaaaacacatgaattaagatcagcatgtaggtgaaatgcacaagaaattagggccatcttgagaggactgtcatctagtatgaatcacatactggttgaccattctccctccaatcccatatttttatggggttatacttaatacgaagaacaagtgattaatggagcattaatcacagaagtctactgactaaaaaggactgaaaattctgagccttgcttcagtggtgatggtggtgggaatgtgggaacaaagttgctgcacaggtaatccctagttttgatccaaagaaatagcagccaagcagaaacagacagacagacacacgcacacacccctcaatatatattaaaaagtcaaatttcattcagtttctcaagaaaataccaagaagaataagacagaaaatctctgttcttagtcttggccactttattctccacatggacaaccactttgcatcaaaagtctctctctacccttactttcacctctaagtcttttctccatcccttctatcccttatgggtacttttctttcctccctcctcatttttcctgtctctagccccttccttttacccaagtgaaattttgtcacttttgagttcccctcccctatgatcacttttccagttctatttttcattcccccaattccacactacccaagttttgacacctagctggcatgaagagagttcttagaagaaatggaagagaatgagaagaagaagtcttttctgtgatacaagaaaggagaaggccatgactactgacatgaaattaaccttgtcccaaccacatacacgtacacctcaaagctttgtaaaccactggcaaataccctcttattatctcccctgccccatctcccctttcttttaattttttggttagttaccaatcacaggagttaacttcctacatagagggtagacaaatcagggcaatctatgatctctttaggtccatggatagatgttcacccccaaatgcagagctctgctaaatacatctttcagtatctctgccttcttagatactctaagctataactctactttagttttagggtcctttttgcctttttctggccagaacatattgcttttatatgtcttccttttcatcttcccaaatgccctaataccagcttaggctaaatgtgctactggtataaaatgtatctttctccttaaaaaacaccaattattctcaacctctgggatccaaagcatccggaataggggccctcttcaataataatcagtgagtgagtgatcttaaaagatatgtggtttaggaagatgaagttaagtatttaaggtcacaaatcaagtgtggagtggggctgcaacccagatccagatgttctttctgacatgatctctcattgtcttttttcttgtattaatcagttgctaagtcttattatttcttcttcataaaaaagctaatgatcatcttattgcaacaccacactctctataccacaactatatatacttattttggaaagctaagattattcaagtaagactaaacaacacataggaccttcaaaatatgctcctaatcttcccttcttgtcttcgtttctgtctcctggtcccagttcctcccaactttatgtatgcatgagtcttttcatgatcttctctctgcctagagtttactttcacttcccgccaggaaaaaaagaataagtaccctttttaaataagcaaactcaaatattatttgctccataaagccttcccaatatctattccatgagcctttcccaacatctccactttcctactaacagatcatatatcctgttgctttaaaattcctactgctttcaaattctttcttcttgctagattgtgacatgcttactggcagaatccatgctagatactgggaacacaaggattaaaaccacaacccttgtactcaagaggtttccagtacactagtaagtcaaaaatataaacaactacggcacaggtctgatgtagaaaacatatttctatttaattgacttgaattatagttgcacacattttgtgttgtaaccaagattatgttacatatgataatttaagtagccaaaagttgactcaggttgagtagagaagtaaaagcacataagaaagagaacaggaagaaataaaactgtaaagatgtaatgggagagaaaatactgagttaactgaagtaatggcttaatgcagaaataagacgtttggggaaaggaagttgaattagttgaagacatttttggtaacaagagtcatgaagcctacagttgccagaaataaaaaaaaaaaaggactgactatggagtatttattaaatactcatactcactgtttgaagtacaaactaagaggaatcagaggatcaaagtggttggttatgacttgctcagctagtaactgcaagtgccaaaattcaaactgtggaatatttcaaagtccgccctttctaaattcaattttggcctaaatccaaggaggtagtgtccacagaattagctagaaattacttatttcctaaaagatcaaagtcccaaagaactctgtatgatttcaaggctgctcatatggtaataatggatacatttcacttcatagtctaatcaactaatagactttaggacagtgaatatgaatgacatgaaggtgccttgagaaccatcaagtcctacctcttattttgagactaattgaagatactgaggcccagtaattgaatcatatagattgctaaaagaagttctgagaagaaatgaaatacaaaagcttggtttctaaggctgaatatcatgagaaactatcatgttatcctgtgtgagtgagctccacgaggccaggtatcttgtctcttttatggtcaactgtatctccagtatctaggagagtttatggtactataactagcacatagtgagcacttaaaaaaaatcaggtgctcaaataacacggtttagtgaaggaattaacgggttcatatatgtgaatgtgtgtaaagtgggtgcaagcatgtaattaaatggaaaactggtcatatttagttagatgttactaaatttatttttatttgccatttggatcacatgattttctcctttaaacatcccagtgacattataaatgtcttatgtagcaaggtctttggcttcaaatgccttcaccaggaattaagagtttagtacaccatcaatgaatagaatttacaaagtaccctttgggcagaatcattaaggaattaaggaaagttttttaacatattgagaaataacacaaaaggttctgaaaataaaggataatatgaatatttcatctttgtcttagttttggggggtggggaacacagaagcaatatttcatttctaaaaccatgttcccatgaagctgagcagaaggactgcttataacataattttccagccaaattcccaaagggcccccaacaggctttctcaatttgtgggcgctgtcctctaacaatctatttctttccagactctccttggaaaccaaagatttatgtcattctcttcatattttaaaatgaaattgttccaggttaaagaaattatgaaaactgaaagcctgtctttatccaagaaccaacactgcctggacaaataacttatgaatacatcctattctggaggtatcatcaatgactttgcctctgtagcactcttaccattatttggacatttccagaaatcaagatccacttcagtttgtgaagatgagctgtgcttagacataggcttaaaaagaaaaggtaaataaatattctgtcaggttatatagagggaagcagaccctcccttttataaataacgtatacatttgcttaaactccagagtaaaggaaaaatctcatggactgaaaacattttttaaaaaaatgaatattcactaaacaatcctgaaatgctttttgctctctgaatacattcaaacaagtagatatcacagcatttcattgatagcttatcaaaccacagaatagaacaggaggacagaatacaaagggcattcttaagggagcaccatcatgattgttctgtaaaaacatatgaacatattgctataaactcatcttcacaggaagtcacacagcttaataagcacagacctgcaagttaatattaaaattcactttgatttcagcagcagcaaagctgatccaactaggagctattacataaaacccttattgtcatattcgtcatcaccactctcaatagagaccactgccagcaccaagaagccagccctcagttcacctcaggaaacaggctacacagacggccgtcccagtaacaatgcagcagtgagatggccctgtttattttatcagaatggcactcccttaatttttcagttctctttattgatgtcctttttcatgtacaggtctattagattctacttcctttactgtcctcccaggaattggtgcttgccaactacaataagttgttttgacaacttgtctagctatacaatactctgtttccttccctctacagtctttttggcttcaaatgagtgccttcaaaatatagcagagactatccaaccaaactatgctacaggggggaggagctttctatgtgtaagcaatgtcctgcccaaactacaatctttcatgtgctcatagtcctctttcttttcctatttatttttatggataaatcccccttgctatcttgtctactcctatcttaataaggaatgactgccgtgactacccccatctagctatgccattcaccgccagcacctctgctctcctcgtgtgcttcaagaagaactgattagcactttgcataattaacctgattagcactgtgcataatcaaactgattagcactttgcataattaaaaagaaataataataataacaataataagcactaagtaatatcaaaagctgttagtcccacagccctttggttacctccaagattagttcagtgcagcatattttgcaccttcacattgaaatcttttctttaactcaaaagtcaagaaaataaattaaaatgcttgcaatccacagactcgttatggttttcatatccataccagttaccaaaataatcagtttcttacccatacacatctccctcagtttgggtcttacatattttacccatgttaaaatggagaaaatggggatataaaaccaagtgaatgaaaaatatttagaataacattagaaaacaagatatatgatgcgtatagaagcatagagagagttatatagaactatataaccctcccttgtgttgcttctgggtgacaatgaggcatgtggaaagaactggacaacctatcagaaaaacctggctatgacatttcctggctaagtgatttaactttttggaacctcagttccctcatctgcaaaattaaaataataacaccagttctgctacctcaataactgtaattaaaataataatttaggaaggtgctttgtgaactgcaagacactttacgtacatgaggtattccattctaggtccctaaatctcctatcccccaaattttatttcacaccatggacaatattatacattatgaataataaattttaggctcagtgcagtggctcacacctgtaaccccagcactttgggaggccaaggcaggaagatcacttgaggccaggagttcaagaccagcctgggcaaaacagcaagatccccatctctacaaaattttttttaaaattagcggggtatggtggcatgcacctgtagtttgttttttttttttttaattttttattctcataggttattggggaacaggtggtgtttggttacatgagtaagttctttagtggtgatttgtgagattttggtgcactcatcacttgagcagtatacactgcacacaatttgtagtcttttatccctcacaccctttccccctggtccctaaagtccattgtgtcattcttatgcctttgcatcctcatactcagcaggctgaggcagaaggatcgcttgagcccaacagttcaaggctgcagtaagctaagaaggtgccactacactcctgtctgggcaacagagcaagaccccatctctaaaaaaataagataaaataaaaatttatatttataatgccttaaaattaaaaagttataaagtcctgttgcatgctttgccttatttcttattcagggctgaatgtgactaaaattttgacttggagttaaaactggactctagtaattattgtttccatcacagctctcatttgtgtttctgtggaggttaaaatcaagctgttgctggaaattcacaagagaggagaagaaaatctagtacattactattaatttgggactacaacataagagaattctgcaactctgcttttctccaccctaccatagccaaccatctgttccttaccaacttcgaggcttagttcagttccactttcctccaagaaaccacctatgatacccatagattggaaattctctctttctctctaatgcttccataatattttatctcatgcttccatagtacagtgtactatttattaaatatgtgtatatctatctgatacctttagtagattagctgctcctaaacagaactatgctgcctattcatttttgccccagaaatagctgccacaataaataatgtagtggtgaacactcaacacctttgttacagttggcttaaggaaactggatggtaaactatttttttcactaggcatttactatataattgctaaatgcaagcctgagaaattgtttcaataactatatgctagagaatacaaaggtgtttgacatacccataactacttaatcaaccattaaaaccaaccattcatttattaaaaaatagatagaagtgctagtaaatactaggcattgtgctaaacactgaatacagcattgataaagtttaaaaggaactgttggttcctctcaaggagcttatagtctaggtctctattaagaagttcatattagagaggctggagtggagtagtgtggaaaggaaaccttaaaatagcaagatacacatcatggagccactaagcctctatcaacctacgggaaaggaacccaaataagcagtcagtgttcttgggcaaatcattcattttacaattcatttaattcaagaaggaaaatgctgctgtggagattattcaagtccaaatgttcctggtgaaggtgcttccagtaattctgggaaagaagccaatcccttagttttatatgtaaatatttttaaaacacacacatatatataagcacaaaagaaaggtcaggaagacgtaagtcttttaaaaatctattttaataattttttctataactgtccacaaaagtttgggctttttttgtagccttacattttcttttacacaatacacctgcttttttttctaaactaaatatttcttccatctaatgactctctttattagacagcatctaatttgcatacatttacatacaatttaactgctagcttgtgagaacaaagaaatggctctgtattgtactgaaggacaatactcagtaaaggaaggtataaaaaccaaccagcttggtgactgtgtaagctctttgtttcagatataccaggctccctctttctcttttaacataccatttaaaaggggcaaaaattatttcatcaaacaatgaaaaaaagaaacagccctactttgtttaactgtccatttcctctccagtttggttactacaattcaggggtccaagttccctgaatctactacaatttcctctattatatttgatagatttaatccctttatctatttttgtttcgtgtctcattcctaaaacaacctgggattccactgcgataaagctctgttctgatgctaatttgtgctgccatcggccttgttcccaagcagacagggtagaatatggcatcatgctctccagtgaacaatgcatacacttacccttaacaggttaatagattttattgagactttgggtctttatcatatgaaccagctcttcaaaaagaaatggttttcagcatctactggagagatgatggaaaagaagacttgaatatagggagggaaatggtaaaatagatgttaggggtaaaagagtacttgagtcaaatgtttctccactcagcaatgctatccctttgtaagtctccaaacctgcatgactcttggagaattaaaaaaaaaaaaaaaaaaaagaactgaaaaccagggacccttgactctcctttgaaagtaaattcacatactctgtgatacggggtgagtcactatgactcttctctctgtagctctcatccttgacacatggaaaaggagattatgtaaagcaatcttgaagaggtttgttcagtgttttgtaaatattaacaattattgaaaacacacaaaataactaataaagctgcggtcacaaccaactgaaaataaacactaggctcattcaagtttctgaaatgccatgtctaaaataacacacaaaaaagaaatatggtacacaaaaatgcttcaagattataacaagctatacaaatgtaaagcaggacataagggcaaactgaaaattataaagccaggtacgaattggcaccaaagcctcgatggaattatcatccgtatctgggtgctgcaaatggtcatgggagatgcatttccttggacatatatttaacattattaatttggcctgttttctgcatctgataatgcaaatttacaattttagtgacccaaagaagtgtgaacttgtcagtgataagtgaagaaattctaccactctgtggggctgcagaatgcccacataatttggaacctttagcagccaaacagattgcacaatctcaactagcgatcttgaagcatgtctgattttccacctggtgagaagaagcctgagttatggggactgtatgagtgctggagtgctggcataaaccaactctgccaacttcttaacccataaacaattatgaataatgatccaaacagcatttaaaagaaataattagacactgcactttaaaaaaaaaccctcagtagtgactaaaatctagtcactggaatgagtagtcaggaagttgttgatcctccgaaaaccacggcttagttctaaaaacagccttaaattgcagagaacctgaccctgaccttcaaatcccttgctccatgaggaaatgagactaccgcctcctgagtgctatagtgtctgttctttcagagattgtcagtaagttttacaatacaattcctgtttctgaggctcattagatcttccttatttatacggatttgaggcagtacttgcttttgtgtgatagaattatctgttggtatccgacgtcagacctattttctacactctaacatattaaattctgccttgtttgtttctaaagcacctcttaataccaactcagccaacatcacctgtgctggaggtggttaagatccacctccccaatgcatgttaccacggtgacaaagtagtgacctaatttacacacacctgctgggttaattgggccaaaatgaaagatgatatatatgctcaaaatccaaaactgatttttttcctcaaaattaaatatttgattttttaaaaattagcagtttctaaagctaagtaacatactccaggtgtgcatttgccagttaatgtaccctgaatgtttcatgacacttgaggagcaaaatatattgagtgatgaatacaaatcttttatgtattttctgtgtgcaatgattagtatgagtaagtggtctcgatcactgaatacatggggtgtgcttgaagggtcaggccactgccttaaagcaaacagagacatctcaactgtgccaagttagcacgcagagtccgggccgcctttgaaagtgcaagtttgctttggagaaagctgttctccatagcctgaggctgcctgcaacatctcttagacaaaaacatcacttacctctgcttgacctcttcccacctctttgtattcattcttcccagaccactgagagtttttctttgaaccatattaagttttatgccaagaactgatgaggatatgaacaaatagatactttcagagactgctgggacagacacagcaatgtgtaaatggtatagctaaatgtatcaaaacccttaaaatacatatatctttgattcaattattacacttaagtatttacctgatgacataatcagggatgtttataaaaaagattgtcacaataatattcattgtaattcatgtttactggagaaaaattggaagcaacttacatgtccaaaaattagagatcagctaggtaaattataacacatccattgtatggaatactatataatcaattaaaaaaatcatgtcacaaaaaatattgacagaaacaaatattcataatatattgctagttgaaaaatcagaatcataaccttgcataatcctatgttgttgcatgcacacatacatatacacaccaaaatattaagaataactttttctttaagtggtaatagtaatatcaatggtgattttcttgtcttctttctgtctttttgtgttttccaaatagttttacactgatagcgtactacttttagaaaggaaatataaatatgatattaaaaataaaatgaagagtaggaaaaaagttaaatgacatttcctaatccctctctcctacttagatttcacatttcacctatatttacttctctccttgtcaactacagatgtaaatataatagatgttaaactggtcaatgttcttttattactgaatattcaacttttctagctgaatggatctttcacttatttacaaatcttacaaagatgtcagtcagcacaactcttagaaagagtctccaatctgctttttatgcttacaaaaaccatgtgaaataattgccttttaataacaatgattacttgaagtgaacttttcaaggtacaaataaatctatttatcaccaagctattgtgtcccgcttaaattacaactttcacattttgatttcatttgtacagatatagggtcttactgataagtaagtgcttttgttaagtaaataaaattagtattaccatatgaactggatttgctgttaaaagtatctcactaggggtttgatttattctatgatggtttcactgatttaatcattgcttaaattagcaaaatataattatatatttttataaagaagatgttttcttgggattttcctatgtcaccaagaatagacatcagggattgataagtaataagaaatgtcaattttaaaattacatttcttggtctaatatgctttctttttaccttagtgatgatcgctgccttcctaaaaagttcataaagcttcagaaaaatctaaaattcatgaaatttcaaagaattaaaaaaattggtgcttttatttcaagtgataaaattaaactttattttcattctcaaaaataagttttggttgaatcaaagatgtaaatattaagagactaaatcataaatgtgctagaagaaaatctgagtaatttttctggtgtaagaagttttctaagccataaaggaaattattgaaaaaatgaaactacataaaaaatttttctacatatacaaaactcaaaaagcaaattaataaccaagaaatatgtctaacacatactacagaaaatttattttccataatatacaaagaggctatacaaaccaataaaatatttttaaaaactcaatagaaaaatacagaaaagtattatagccaattcacaaaaaagtaaacaaaaatgtaaatggccagtgaaattttaatatgttgtttaatctaactcctgagtaaagaaatgtaaatcaaaacaatggtgaaatatcattttcacttttctgattaggaaaaatttgctaaagcccagtactgatgaggctgtgagaaagcaggaattctcatataatgttgttacatgtgtgtgtcagaaaaatgtttttgaaggaaaatttttaacaggcatcaaaattttaattatataaacatatctaagaaagtatgctatgtggatattaaaataaaaacaaggatatatttagaaagctgttttgtaatatttttaaacagcgaagaaactgtaaataaccaaatttccataaataggcagtggttaaatacattttgtgacatccataaaatggaaatattaagtagctgtttaaaaagaggaaaaggtaaaatataatataccaaaatataaacactataaaatttctagaatatataaaatctctaagacatggcattaagaaaaaagtacaaatgtatttgaacagtatgattccctttctgtttttaaattaaaggtatatagacacatttctctacgcaagtacagttgaaactttttatctctggtgaatagtgctatcagtcggtaaagacatacttttcactttatatccttgtgtaccattcaaattttttaaccctgtgagcacattttaaaaatacaaatagcagaaagattgttcagtgtaatggtaaatggtgaaaggtatatacatggaagtaaagagtactgcactgttaaatttctcattctagacttctctagtcccacagtaaatcattcaacttcactgggatttcatttcctcatttgtaaaataataattaaattagctcaaagaataatctgtaagttaccttatagttctaacagtacatattttcatgtgttaataatccaatacagaatggtggaaaaatatgtttgagacttaaatatcaattttgagcacctgtacctactacaataaacaaatctctacttggtattttgtatgtagactgtagccatgtctttatgacaaaaacaaacaataaatgtactgaaaattttggctcattgaataaactaaatattatcttaaagaccatccccatgcacaagtacctctgggtctcaatggtttagttctgccaaggtgttgaaacaagactatcaaacaaaactgatcagaaatgtattacttacatacttcactgccaacttaaagccacaaccacgaagctgacttgttgaatctaaccttgattaatgctctcatatatacaaaataatgtcaaaatatcaacattcatttataattcaggtatatattgccacaagcactcttaatatgtttttgatattggataacctgatagtgcatgctcacaagttaaaatagtaatatccatcttgtttttaatttgtggtacttgaggcttcagtataataatggccttcttccattgtgacttaatattcctatcatttggttatatatttttaaagcaaaaatctctcgatcgttattcagatgacaaattatatggtcatatctgttagatacagcaaagtctgcactgtggtatttctaagaaagcaagtagttcattccttcatttctgggttccattgtgataaggacagaaccatgggaatttccttggtaagattcaaggggtataactggtaagaatggtgtgttctttttttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtgtcgatctcctgacctcgtgatccgcccgcctcggcctcccaaagtgctgggattacaggcgtgagccaccgcgcccggccggtgtgttcttaatcacacaccataggtacatttgtaaattaggatgtggctaaagcctactaaaaagtatattgatagatttttagtatctgtagtgaaaaaagttagattctcacatctaaaaacctcacaatttctgaaactgtcatctgactgtgtttttcaaatgttcacagtagacggcctacttccttgtgcattttttcacatagtatcagcctgggtcatggtaatactgttatctggtataacatcgagcaatgggaaaataatgtggtgaatgaacagttgattagacacattaaactaaggaaaattcaatcaaagatcatcagtttcaatgatttactaccatacatctttgcttagctatgaataaaacattttgaatgaagcttttggtgaaatttctgtttcaagatgaaagtagaaatgagaaaaatagacatcctgtgctcacctcaaatggagagataactatatattccgaaaaagttctatgttaaatcttgggctcctatgagactaataaaaaaaaataagtttaacccttcattttcagtttcagtcttgatatacagaaaaggaggaaaagggctgatactactacttgaagaagtgatttgcgaaagggagaaatgatggctcaaaaacccctgtagctcctctaacaaaccctggtaccagagcagacaatgaaattgctagggagagctaagagtagcaatgaattcaatccctccctttgtggccaaacttagttctgctttcagaaataacaaaatttcaggagatatggttaaaatttataggatatggcaaagtttaaggagatttggttaagcatttttaatccattcccaaatgcttactatggctatatttagtaccaggataaagaggaggataaactggttgcccctgaagaagcagacctcccaactgtacattgttaatagttgacagaacactcctcccttgccacagctactctaatacacacaaaccttggatgcacaactctgtgtaacctgtaatgatttagagattgcatttcttgtacacaagatcttcccttgaatggctccttcacgtcattcaagtcttataattcaaactttatttcctcagaaaggacacctacaccctgcctccggattaccagccattcttcatcctttttgttgtagttgtatgttaatttgtttagtgtctctctctcggtcttctagttcagagctctgtctctagtgcctgagatcaactgaattgtaattatttactcatgatagaagagtaatcaacaccagaaagaaatctgctatctaacaaaataatagtttcttcttttttttttttcggcaacagatacaagacaaactaaaacaggttaattcaattaatgtgttttgggtgcaaatcccagtttggtattatcaaaggcatattttcacatttaactatattatcatttcagggattacttaattttcattttcatttctatttcatcctttcttttctggcagggaagcctaagctcatttgtaaaatttttctgtcctctgagcatacaattatattttatccagaacagaagtgcaccaaaagagctgaaagttaaaagaaatgttcagtagatgagacctataatactggttctgattaattaatataatcactctattaattatctatgtttaaaattcaaatttatctatgttggcttattgagcattcttaaagaaaacatacttgtaatatcctacaaccatgaggtggaaagggtcagcaaatgcttccaattatatcccaattattttaggaatggtttacttcaccttctgctccctctacccactcaccctaatagtggtctgctccttacttaaaaggggaaaacacaaagatttcctgcagtttgagaatcaacttgggagaaatagaaaaacaggtgtctgagttgagcagagctgagtttagtcctgtgtcagccatttactagctatttaaagttagaaattaactttctgagccttgggcttgctcttttaatctagacctggatattcatgattccagtgttcatttaatggatgtgtatttgtacgtatggccatatccatagttctctaataaagacctggccgatgctaagcagagaaattagacggattgtgatctcaacatgcagtcatccagcacaatacttttgtccatctacgacactaaatttcaattgtatacttggcttatattatctggagatcattacgaaaaacattttctgcaactcttgatttacttaggtcacaagtaaagttatgtgaaagtaccatggactataagagtatatttggcatctcaacacacatggattgacagaaaagttggatgataccaatgtcagtttttagttctgcagtccatctgcagagttagtgactgttggttacctattctatgcctcaaccttgtcatctataatgagaagtttcagtagtttaaaaaagtatgacagaaaatgattcataattccatgaaattcataaaaaataccaaggtgctaaggctacaagtattctaaaaacagaggacaggataaactttgtcaaataccgaggggaaaaataattaacatgttagcatatgtcttagtctgtttcctgtcgcctataacggaatacttgtaactcagcaatttataagaaaggaaatttatctcttatagttggaggctgggaagtccaaggttgagggagcaaaactggtgaaagccttcttgccgtgacaacactctagaatcctgagacaacgtaggacatcacatggcaagggggcagactgtgctagcgcaggtctctctttatgtttctataaagctaccagtcccattcccatgataacccagtaattcattaacccaagaaaagactcatccattcatgggccctcatgacccacctcttaaaggccccagctctcaatactgccacactggggcttaactttcaacatgagttttggaggggacaaaaattcaaaccatagcagtgtgtaaataagtcttccatagatatttactaccaaaaaataacattactctctatagtaggttgaatgttgactagagtccccaaaatttcatgttcacctggaacctcagaatgtaacattcctgggagatacggtccttgcagatgcaactaattaagaaccatgagataaaatcatcctggatttaaggtgggccctaaatccaataactgatatgcttttaataggaggagaggacacagagggacacatacagaggggaaggtgctgtaaagatgaaggcagagtttgacgtcatagtgccaaaagccaaagaataaatgggaccatcagaagctggaagagccagggaaagattttcactgtgagccttcagagggaatgtggccctgctgcattttgatttctgatttctagcctccagaactgtgagagaataaatttctgtcgtttttaagtcacccagtttatcataatttactacagcagccataggtaactagtacactttccctgtactctctaggactaaaacagaggaagacatacagaagttttataagtgtaaatagtgatctcaaagcccccaattgataggagcacataaggacaaataaaaatcaatgagaaaacttaagaggttgcagtgatggtttctggtagtagtaagcctcaaacgaaatgtactgccctctatttggagctgttccctcttaaatcaaatgcagatgccctccaaaagtgatgcaacatcttctgatccaatcctttcaagcaagccagaaactgatcttaacgtggaattggtcattaaaaaaaaaaaaagaaagaaagaaagaaaagaaaattaataggctgggtgcagtggctcacgcctgtaaatccagcactttgggaggctgaggcaggaggactgctggagcccaggagtttgagaccagcatgggcaacatagtgagacccccatttctacaaaaaaaaaatttaaacatctgctgagcatggtggtgcacacctgtagtcccagctactgggaagctgagatgggaggactgcctgggaggttgagactgcagtgagccatgatcatgccactgcactccagcctgggtgacaaagtgaggcctttatatttttaaaaatccaagtggtatattgatgtaaataattaatatcttacaatgatatatgatcaatagcaaaagtatactggaaattacttaattggacataaatcagttctcaaataaaaaattatttatgttcctgaagaacttgattcagagagtaaatatacctatttttcatcaatggaaatttaaatataatatcagtaacaaatttacatagaggaaaatcaattttattttggtctagagtatatactatcatgagacttggcaaagaccctaataagtatacagatcacggcttgaggcatcagatcagcatgattaaagattatgtttgaattgtctcctgatatacaaaattaaccatttcttaagtaatactaaactcagctatcctatttgctacacaaatttaagccattatagaagcaacattttagttaattttcaatatctctatttactttctgtgcatatttttatgtacttacacttaaatcttaactttcagatagtcctaccttatttaatttttttacctttaaaaagtcataacctgtggtataatcttcttttgatatgcttaacaaaatataacaatgaaatgtagtgtaaaaagtttaaatacttttaaaaatatatttttaaatagcttaagaaatatattttgaaaatatattttacacaaatatgaatgtgtgaaatatctattcacacatttttaccctaatgcacagaaatcctttcgtttagaaaaatagaaattgtattcataatttcccttaaagactctcaaaaccataaggatgatacatgcagatattaactattagatattacatgtttaaagcaggaaagaatgaaaacgttaacttcctagaaaactgcaaatatcaaattctttttcttttggttttttaacttaagagttgtgcattaattactattagtaattaattagtcaccaaatattctaaaggtgggaacaaaaggttcttacaactcagagatgaatctatttatatttgactttttttctcagacactggtctcctaacactttataagttcaataagatgtgaatatagataattagggtattcctatataatcaggtagaaagtgaatacatttgtgtcagtagctacaataatttgcattaaatgaatgagtgaataaaaaataaatcataaaaaggcactgtttgggattggtataaaacatttacttttaatacataaattattaatattaagcagttatattacaaatgacagagaactgttattgaggtgcaaataactcaacagtaaatattagccatgactaggttatagggtgtttctggaattcttgcttctttttagattagtataatgctctactcaaggtgtagagtaaatctgcaataactagagcaaataataagtggtagaaaaaaaaggatctatacagaagaccatattttattacatggtttcagaatagcattatgattatgatgactaatgagaggaggaagaagaagagatgtttttaattttaaagtgctttggtatgttgtcatctctaatttacagatgaggaaactgagcgtaaaagcacacgaagagctgcctatatctcatagccaataagtgataacagagaaacttaaatccctctcttctatttctaaaccctgtactctttctactctattatattgtctctttattccctgaaaccagagatatgtattaacagtaaaattcttaaatactgcagttaaaatagaaattcctccaagccagtgttgaaagcaccacagtatttataaaaataaaaatcagcttcttaaaaaattattgttcttaaataaatttaaaaagaacaaaatcttctttgagttcccctatattcctcatacagaatcttggcagtgataatctgcaccgtaaactgtgaagtaaattgtgtatgtgaatgaaaacaataagaacctacagaaacacatgggagatctaactcggataggatggtctgagtagcgtagggacatggatgaagctagaaaccatcattctgagcaaactgtcacaaggacagaaaaccaaataccgcatgttctcactcataggtgggaattgaacaatgagaacacttggacacagggtggggaacatcacacaccgggcctgtcctggggtggggagacgggggagggattgcattaggagatgtacctaatgtaaatgacaagttaaggggtgcagcacaccaacatggcacatgtatacatatgtaacaaacctgcacattgtgcacatgtaccctagaacttaaagtataataaaaaaggaagaaaaataataataatattatcacatttcacagagtttacagtctggcggaggagaaaaacattaaactaataattatataaccacttatttatttacacctgaggtctattcgttatctttgactatgccacataattccaatctgaactcacttgtatgcattacttagcttggcgatgcttgatgttctcctttctatttccttatgtcctatgcttcatgtttttttcaaggcccagcttaagttcagcctcttcccagcagttcacagagatctctgcctccactaaatatctttagcacttaatgattctttttcaacaatggcaaatgggtttcctattacatgaaacttccaacaattggtatggctgtcaaagtactgtcttcagagggactctgaggtcaagttttggtgtagtgacagagacagccataatggattagtgttgtttcatggacagtgaaggggagacaggggatgctgaatttagaacattgacttcacaaatagactgcctaacttaaaaaaaatgtttgtagcatttattttacaccaaatccaggtctaagcatgcaatttgacactgagagtgccttgttttattttttaaaaaacctgtatcatgtctcctcaagtatcataagattcttgcatgtaatacttctctatgctcacagcatgtagtcatgccttgaaacataggcatttgctgatgacaataaattaccattttagaattcactcttattactattgtgaactccatttatgtcatagcttctctcaaaatattatcaatattgaacccattttagaaaaactttgtaacataagctataaaatgtaagtaaatatattgtctttaccatgaccagattcaaattcaacattaggatattgataacacttaacgattaaatatatacctgccaaataataaaatgaaacaaagagaagataactacttcttaaatgagtttaaacattttttaaaaatccagccaggcgtggtggctcatgcctgtaatcctagcactttgggaggcccaggcaggtggattgcctgagctcaggagtttgagaccagcccgggcaacatggtgaaaccccgtctctactaaaatacaaaaaactagacgggtgtggtggcgggcacctgtagtcccagctactcggaaggctgaggcaggagaattgtttgaacccaggaagtggaggttgcagtgagccgtgatcgcgcctctgcactccagcctgggcgacagagcgagactccatctccaaaaaaaaaaaatatccaaatctgtgtatttcaaaatatattttacatacttattatgtcctaaaatttgtatctctcttttagtatacttcattttcctgcacatagtaagtgttgaagaaatccacagtggttagtttagaccttattttagagagatagctccattttacattccgtcttgctaaggaagtgtattcatcatattccataacagctcacagtttgttatacattaactgcttattctctgtgccaataagactgtgctggaacagcaaataaatttggtgcattcatttaaatgattctgcaaaccacaggctacccagttgtctaatgataagagagccccaaagccacctgatcaccattatactcccttatttttttggatttgcatggtcagtactgtcaggatctgaatacagagaagaatgagaagtaaaagtatacctcagacctaatcatgaaaagggattttattaatttcggcaccagtgatgatgtggctaggttggaaggggaatgggatataagatctggagtgctttatctgctccaagaccaatgctggttttggcacttctctcactctagtgagttgcaaaaaaacaagcaggtgctagcaatctgagagaccacatgccagctacagctgcttcaaactgattcaattacatctgcctgaatagtcccaggacatcaaactagttgaagagatccataggttgcaaggagactttgtctatcctgatggacaactgtctctgagataatgacctgcaaatttccaggttgtgatataaagtgatcattccatcaccaggcataagagaaaagatgggggaatgcgatgttttattcactttaaaattaaaaattggttgtagaaagcacaaaggcctctttgaatttaaatctgaaagtcactgaggccttatggataccttgaaacagcccaattttgtgagaacatttcccaaatcattgggtacagcacatttacagaacatgctcttgggatccggacttcgctccaaaccttgtttgtacaaaaaggggccaagcagctgggaaattctggagtggagtgtgtcctcattagttcccatctgccaccagaactcagctcatggcaagtttggctaagtcctggtgtactcaggtccaaatgtgggtcagttttaattacactatacagaattcagtgtgcagttttaaaatccttattatacagcacagaggaatgggcagctctccagctaatcaattttttaaaagtacatatataaaaattttaaaccaggctagacagacagtgggtggaaaaaaatctttaaatgagtacaagggttacttaagagaattattagtgaaattgggtcatgaacaagttctgctttaaagcttcaaagtgagaaacaaactgttttcattggtaagttggaaaacttatgtaaggtacacaatgtgccttgctctttagtgtgaataacaataagcctgtggccagggtacacaacacacctacaagtgaactggctttcatgtaagcagaaatgttcccaattttgtgactcttcactccatccccttttgatgtttatcacttatggcaaagactggataaaagaaaaaaatcacaagctacctggtaaatagtgaaaaaaaaaagatgaggaaggggagggagtgagagaaaaggagagtagaaagcacaagtgctgagtagcagactctgggcatgacttgtctctcagtgccatccatacaaatgggggccagaatcaacgcttgcagtctatgttcagattccatcctgtccaaaagctttatcaggttcaggagcgctaaaacactaagccttcgaagacaattgtcagtaaaaaattcaggagtaaacacgtcggcagtcagtgattaggcatttatgcaccatttttgatagataaaatgtcccttgacacaagtcctaatgacaacaacaacaacaacaacaaaacacaaaaaccttaaatgttcaaagtatctttgggcttttgactgagtttttatcaggtttatccatttaaaagcagcacgggatgctaggttcaaataccagcattgaatatttacaagctatatgactttggacaaattgcttatcctctctgacattttgttttctcacctgcaaaatgggagaaataacatcttcctcacagggctgttgcaaggatcataaaacatatatgcatacatatattggatattacatatctatatatacatacatgcatatatatacatatacactcacataaatgtgcatatgtatatatatagcatctggaacatgaaagtcactcaataaatgttaactatcattaacccagttatgatgaactaaattttgttccccaacccctccaaaaaaaaacatgtgttggagttctaaccccaagtacttccaaatgtgatcttacttggacataggtctctaaagaggtaatcgagttaaaataatgcaattagggtgggcctgaattcaatatgactgatgtccttataaaagcagagaaatctggggacagagacagatacttacagagggaagacagaggaagacatatggagagacataggaaggagatggccatctatatgtcaaggagaaaggctggaacagatccttccctcacagccctgagaagaaccaacctggctaataaaccttgatttcagacttctgaactgtgagaaaacaaatgtctgtttaagccaccaagtttgtggtcctttgtaatattcccaactaaataaaaattccattaatcatcaatatttaccttgattcatcatggtcgaaactatacatttgatattaggcaggtctgtattacctctggtgagtaataatcaattctatatatattatctagtgatgttttcattattttaaaagaatccttttctgattgctgtacaagaagatactgctgcaatataaacagcctggcagaggaaaatggtttactataattaagatcatctagttattattaaagataattaagggaaaatcatacatataaattcataaatccacttttctactgttgagtttgcatagaaggaaatcagaaaatcttaccacactaatttccttctcaagaaaaaataaaaccttacacagcgatttatgcactgacaactatgctcactaaacctgaggctgcttagattaccaacaggaccacttttaagtcattttgatgcatatgaaagtaactcatcaagcatgggttcttcatcctttgcaagagactgcttttaaaggtatctgactttcagaagagggatgagagttgtctgggttgtgtcaacacgctttctattgcaagacatacctccataatcaacagacattgaagtgaatgtgagcatccccatcttaagtttttctttaaacagccctagccttctatagaaatgtggcatgtatagttagaaattatgagtctaattatgttgaactgagataagcaacagatatcacaagagccataattggaccaaagttaactttcttaatgtatgtgtcccacacttccttgaaattcctatactactgattataaaaatttttatattttgtcaagagaagagaggaaaaaataatacacagagactactatgcaataatacataggtggtagtggtgcacaaaataaagtattttgtatacctaatttactttaatccacatatccaccattaaaaaggtaggtgttgttaccaccatactatacataggaaagcttgaggcttagtaagctctgccaacctcgatgaggtcgcacagctactgaataatggagctagacttttggtaaaggtcagtgggagggaatccaaagctcctaaattcaaactcaagcatgagatttacaatccagatatcctaagtgcatcactgggttccaagatggtgatttatttaaggaattcacaggcgtgttgaaagcatttgaactcacataagcagtagatgtgttcttgctaaacctaactcaacttattctccttatgaggaaatcaatgctattcacaaacacaacctaaaaggctttattcaatttaaatgaaattaatcttattataagaacacatgaaaatggaattaccatacaatctagcaattccacttctgggtatatactcaaaagcattgaaagcaggttctcagagagatagttgtacacctatattcatagccaaattgttcataataattaaaacatggaagcaatccaagtgtccactgatgagtgaatggacaggcaaaatgtggtatatacatgcaattaattattattcagccataaaaacaaggaaatcctgacatgtactaccacatggatgaatgctgaggacattacgctaagtgaaataagccaaacacgagaagagaaatactatatgattccacttatataactacatagagaagtcaaaatgacagagacagacactaaaatggtggctgccagaggctgggggtgggagtgcagagggaaatgggaagttatattttaatgggtatagtattttagttttacaacatgaaagtgttatatagagatgtattgtggtgatggctgtgcaagcatcataaatgtatttaataccattgaactgtataccaaaaaatagttaagatagtaaacttcatgttgtgtgtatttttcccaaatacaaaaatttggggaaaataataaaaatatcacatgaaggtcttttagattcagtacattgcttcatgatttttataatatcttctaaggccagggaagcagaggtaactttgtatagaacctctgagtacaatctatgtgataatgcccaaccaggatccctgctcccaggcaattagatgttcttttttcagagtctaaactgcagtagtggtgatggcgagggaactggtagtgatagaaatgacagtagcatagctaagatttcttcagtacttgctatgtgccaaccagtggaccaagaatcttacatgtagtgtgttattaactctcagacaacagatactattattttcccagttttacaaatgagtaaacaagggaacagaaacattaggtaacttgattgagaccatactaataataagtggtgaagtcaaaaagaactctattgatatatctttgtctctcactagcctgtatcctcttgagaacaaagattttgttgtattcatctagcctagcacaatttctagcaaacagcagacatccattcaccatgcagaataaaaggaaatgaggaaaggagagagggaaagaagggggaaaaaagaaattatatctagtcatgctatgttcttaataaatgtggattttctttctttatttccttaaccctgaaatcgcaggggaacctgcaataatgctcaggaatcctagggcataggaattcctccctctttgagattccaggctaattcctgacacaggaccctcaaaaagctgctaatatctgtctagtttaatgattaatattctagcaaatatatattcttggctcatctcctaatttctaatattgagactaacagagagatagagttcaatctaccacactaagattcactggaaaaaaccgatgtctttgatattggcctcttgcacactggtgtgaactgaggtaaaagaaaaactgttcccagaggaaaggtagttccatgcctaaaagtacatgtgtcataaaccagtggtactaaaatttgagaagcctaaacaaaaggttttaatgcaatagataactggcttattatgtaaactgtgccaatcttatgtgacgggcttatgccacacaaaacggaacattagaatgatctatctaaagcaagtcttaactgttctattttgactctactcttgcttggctttacctctatttataattaaaatttagtgagtcatagagaccataattataaacatgtatacagtaaacacagggtccattacttttgcttagaaaaataattacagattttttaatattctgatcttaactgacccaaaggaattaaacacacattttatttttgtgttttagtgagatagagatagggagggagaagcataagccagtgctcaggaaagacgaggcattaaccatataacatagatttgtttatttatgggctgcaaagtatttccaaggtgacaagtaacttagccattaatgcctcagccttatgtgtataatgggaataacatacagacttcttgtaataagtaaaagttagtttaaagcacattgcaaatagtgttatttcaattattcattaaaatagtcaaaaaggatcagttcttatacattaatttctcattttaaggacagaatttatcagtattctcatatctatgtaactggcagtatgagaactaaaggccatcaagacttatctaaactgtataacaagtaataagattttaggacacaatccctctatttctaatacaactccagaaatgttttattcataaatgcattcattcaacatttactgatcaactactatgtacaaggcattgtataagaggctgtggcaatcctctacttacctttgtactgtgtttcctacttccaaagaggttaaattaataccaaagtgatttgttaaaaatacaaaaaaggattccaaatgggccaataaaaggaaaagacacaccaactctaagaccagatttatgttactaaataccgacggaaactcctcagcatttaaaagaatacattaaggagagtaatgcaagtcatttggatgttttcaatatgagaaatttgagcctactgaataaattaattaaatatctttaatattgagttgcagctttttattgcatttatagaactttacctattagtaaaatatacaatctataatagcttgtctatatcaaaaatatagatatctgtcagaaaacatacaaagccacaactaaaatacatttaatatcattaccagtaacatttgtgaaaaaataccaagcatctagcatttgttaaattaaagaataatattccataaaatctacatctggattttagcccctcttttagaattactatttaatcttcactttttttctctctcacttctaccccaacagcaacagaaacacatgcacaaattaaggaattatcttacaatatacccttaaattttctgaatatgccccatgtgtccactaatagccaaatgctttcaaatctgttcagctaaatggatcaataactacatccagcctcacatagtggggctgccaacacggtgaaattgagccaaacacaaaatgtctctaccaggacaaaaattattatcaacccagttatctgaagagatctactctcccagatattctttcgagaagttggcatacacattatctagggcagtcaacagctactaaaaaaaaaatatttgagtcataaaacagaggatttaaagaaaatattcagaagctaaaaccagtgagttttagaataaaccaatgtaacagttcaaggtctacatcaagtaagaatctttcagagtcagagtacacaaaacacgtaagagcacaagcacactgctaacaagcttctctgtgctctcactcatatgacacagctgcaagcaacaattgagcaggtgcaaccaagcttttgagaattcctgcctgttgcccaggaaccacaacactgcatggttgagattttaaacaggtgcaaacatttttttttcccattcgtctagtgcttgagacagtggagcagacagtacatctgcaaccactccatacctaaagcaaccatcacagaaaataaactcaaaagcagcaaaataaaaaaaagtttaaataaaacaataatggcaaaactgtggttttgcaatggtctgaccccacatcaccgttcactttaatagtacaattccataaaataatctcttcaccagatgaatgctttgtaattaaaattatttgccttatcaaatcttagaaatgtttacttgattcttacaatagaataaaataaaatatatgtataaaatgtactatcctttgaagctgtcattatctgtaagtaatcaagaattaacatttttacattatgaaatctataagcaattttaatacataaaaatattataacttgttagttaatatatagatttacatagttataggtaattcatatacatacctgtgcagctatggggcacaaacttgcaattcatcaattctgaaatgtaaaagaaatatataagtaaaaattaatttactaagttggaaccagtatttatgttgcaacaattcctgcagagaagtaggaaaagtttcagtgcataaagaggtaaattattttttatcaatattttccctataggatatttcatatatctgaaaatatatacacacacacacacacacacacacacacacacacacagagtcccttagcagtgtatcataagcactagcaagggactctgactcaccatggcctctgaaactcaaatgctttcactagaggacgaggcaaacactttaaaatgatttttttttttggtattcttccaagactattgccttcctaatacaaatatgactgctgctctctaaaatgaaactactcagattcatctgcactcagtttggatagaatgttgttaaggaagaaaggtgcttttgtagagcagtccacaaaaaaatgcatgaataaatgaaagtaaactttgaatgttcgttaactttgagttacaacagcaaatagaaatgaaattgattgctacaagaaggaatgctaacaccacgtcggatataatgcaaaatgcctcaactcaacacactttgacaaaactgccagcgaagtaggtattgatacagaagactatgtaagtccacattaaacaaaagtagcagtttacaattagacctgaaaaacatttggatttaggtggaaactgtattgcaacatacagcctgggaactactggtactcttaaaaatatttcctagttctagccaggagtggtggctcacgcctgtaatcccagcactatgggaggctgaggtgggctgatcacctgaggtcaggagttcgagactagcccgagattacgctattgcactccagcctgggtgacaagagagaggctccatctcaaaaaaaaaaaaaattctttttgaaagcaaacggacatgtttaatttatatagttcttctgagcacagtcgattacagcaacacattatagtcagtaagtccactttataatactgcttaaaagtatatagaggtaataattttgatgatggctcaataaaacaacatcttcgtatattctgatgggaatgtggattacaaaagactttctagaaacccactgagtactatgtatcaagaacccaaagttcaatatttttactcagtaattttagtcccaggaatcaaatgtaatagaaaaccaacagaaatttatgtaaaaaagataatttttatgacagtaaaaaactataagcaacctaaatatctaatagaaaaataattaaataaagcatagcacatctatataaaggaatatttggcaaaatttaacaaggtactttaaagaatattttaaattttacggaaaaatgcaaatttatagtattatgatgctaaaatattatataaacatgtagactaccaattacatggacagtatgaaattatgtgaataagaaaaaacaaagaacaaaacaaagaattaagagtgattatatctggataataagactttggatgattttaattttttctttttactttcatatatagttaattatctacaataagcatgacttttataataggaaaaaataatagtaggtagggtaggggtaaaaggaaaaagttataaaatgctatattgaattcataaatgtaaccttcctaagagaaataaattaattcagtcacaaataaaacccagtaactgtgcctacagtgagaaacaccctcactgcttcctcaaaggggcatagccagggtcttttttatcccagtgctttggaatctacacaagtaattcaataacacatttttaaatcatcttagtaaaacttctttacttattatgcagagtgaaatgatggcaagaataatttaggacttcaaatctcttcaacctagcacagcctaacttattcactaattcaatcacattcagtgagcatctactgcctgcatggtgctgtgtttggcactgcaacgtgctaacagataaattaggacacaccttaccctcattgagctaacaatttaaaaacactaaaaaatgtttagacacagctcacatgaagaagtaaacacaatacagttcaaagcatttgtgacagatttggtacattttaaagcaagaaaacatacactaggtttattttttatatttctgagcaaacacctatctttaggtaacaataaaaagtcatgtgtattagtatcacttattaatgcactagcaaattaagtatttaagttttttccttatgtgatctattttttgttaatggacagttacataataggagattaagtatgaaggaatagtgacccaatctggaatgcagatgtgtaagattgtctcagtttatctgaggccacataaaacacatgcacaattattaacaggctgcagttatttattggaaaccaaagcaaataagttagttactggttaatcctgctaaaagacactgttatgacaacaccaccagggaaagaaaagaagatagagcaaaccacttttgttatgcagataaaatgattcagcatagagattctctcaatagcagttcagtttcctgctggcctgtaaacataatcagcaatgcccttctgaggccagtgctgcaggattattccaatgtgaggtcaatggggtcaatctgtgtgaagtggtgacaaacactaagagaaggtaagaagctatttgtgtgatcagtgatccatagactggggctcagagttctgggaagcagtagagttatgaggtagggtggtagttaagcacttagcttttgccatcaaacaaacctggaatcaaattccagctccccatctttagttctgtgatcctaagcaatttaaattttctgtctgtaaaatggtgatcatgttactcaccctacgaggttgtctatgcaggttatatgttatagccatataaaggaactagcacagtgccagccatgaggtaagcatttgataaaagggaactgttagtactatcatagttgtatgaaaagggaaagcatgtctgtccctttaagctaaggaactaagctaggcaaggagtaaggagataaagaaggcttgttgaagacatcaccctacagtccagcagctcatccaaaagccagtcatgtgcttgatgttcacagaacatttctgaatcaggcaacactgcaacaatagtaatagccacaataacaattctaaccagcacttttaagctccattcctatgactgaaaagaaaggcagtaaagtctaaataatacgtgcagcaacactgccgaacttctctgggtgaaaaatgaaggatcactttccacatttaactgaaacaatcaggaaaaggaaaataaggacaaaatgaatataattactcaactggaattggaccaaggtgccgtgtaatggtcttagcaatcacatgtaggcacttatcacctttttatgtattctaaggagatcctgcagatgaccagagccttatatatgaggtttgcaactctaagtaaaaaaaaacgttagagtcagtttttttcttatggctgggaagacagaaatggatgcatactgatgttgttctagtccttatttgtgttttgatttaaaggacagcacagatcctgagttgttaagtggcgtgtcttcagattcccacacagttcatgtaattgctagagttgtttcactcgcattgggtgaagttactattagcaccattccagatgcagatatactatagagtgtttgtttgtttgtttgtttgtttgaagttctttttacttctaggttggcatagctgtgttctccagtgggataggtccaattctatgttacagaatacagaaatagttcatcttcccttcatactagttgggcctggctagagatgccccttaagccattaataaatctacttgctaattcacttagagtactaacaaggatctcacctgggcctgtgggtacaaccactccatagaagagctctaaacctaaatttaaacaaaaagaatttcacccatgactgaggaagcatccacaggactattttacatgctttacatttaaatttgatattttgagagaagactatgtaattcaaaataattttattttatttaatatgtatttagtccttctggacccactacagagctggatgttgtatcattattatatggttattataaaatgtacactttactcatcaataaagccaattttacttttgaaaattgaggtacctggcttctgtggtttctctcaacagaaagtcctatgaagagtaagaactataaattgtcaagtagacttgaaaaacttatgcttattttgtaaattactgagctaggtctggcccttcattttgaaaagctatctgcctataagaaagaggaagtatgaggagcacagttatctattaatcaacactgtgaactggaaacagataaagtgcaataaagaaggaaaaggaaatcatatggtaaacaccgttaacccaacggcacagttgatctgtctagaccttaggtcagataagctgtaataaagctataaaatccacgaaaaactaaagcttatttacaaaaactgcaaaatttgaattttctataattaatgccacttaaaatgaaagaatttaatatcaaatttcatgtataaacatgataaatttgaactctcaagtagaaacctcatctacaatacactaagtgttaataattctaattgtcctataatccacacttcacagcatattctagagaaaatagctgttgggtttttatgacttaacttaaacttcacaacttttaaaataaaagtttaagagctaatttaaaaatgtatttaagaacctaaaatttagaaaatattaaaaattatattttcaaaatatcctcaacttgaagttatggctattgaaatcaatgatttattctcagaaaatgtgaaaattttactggcctgcttgtatacatccctggggtcttagtttagatattatctcctccagaatctgatatcctgtgtctaatcctgtcataataatcattttattgcactggaattgtcttttacataagactgtaaacttggggaccagcatttgtatcttattcaccattacatctgtagtttttacttagcacagtacataatgtgtggtaggtaggtcttaaatattggctaaaggaatgttgcatgaattgtgttagcttgtattcttgatgattaagaaaattcacactgcataaaaaattaaggaatcacattcgtaaacaagttattcccaatctttaaaggactaatcttccaatctattttcttgtgctttttctacctatttttcctcttaatcagtacaaacttaaaatatgagaatttgagtctcaaatgttaacaccaggttagaaagcctcgttagtttggccccacattggacaagaatgagttgtccaaatcctacctgttaacagatactcggtatggaagaaactgttacacagagttcactgaaagagttctgcagttcctaaccaattatgtggttcttatactttctctaaaaaacttcttctagctatagttcctgagacagatacctccactattttattcttttgtggcatatatgacagtttaaattattggggtgattattggcttatgtgtttattatctctttctttcccactagattgtatactccatagaggccacactactttattcactactctatacccagggtctagtttagtgcctgacacacagtcaacacttaataagtatttgtcagatgtataagacaaacatgagttcaaaaatatgagcagtaaatttagagcagtagctttcaatcaagagactataaaagtaggcagttaacagctacccctaaaaagtgttttcatttgaactctgtggaagccttgatgatgtagaaaatcttttattgtaaattctgttcaatcaaaggcaaggcagaaaaacttcaaaagcaattctaggtaggatgaaggtatagtacctagaaaaagcaatggaatcacaacaacagcaaccactttcaattagaagttttgagtttgaattaaagcttactaggtatgtgtcctaggtaaacttacataaccatctctaatattcagattaatcatatttaaaatgagggggattttatataatataaaatttttatattatataaaattttatgtttttatgatgacttaatgagattatatgtatacaagtagctattagcattatctatggcatttaggagaaggggctcactattgattagttcctttaccttggccagccagcgtctgcaacaagattgagctaaaacttcatcaagtaaccaggataatacattttaggtaggaaaacatagatgaaataagggcttaaatgcagagaaaagtaagttggtgttagggttaatacataaaaaaaaatgtgtaagacagagtagcgagaatttcacagcagttagaaatggaaaaagatttcaacatgatacaaaaactgccaagaaatctattagcttttcccttaggtgacgcagtcttcccctcatataaataaaataattgctactattatagttggagaaaaatcaactgaaatgtacattaaacacgtattagagatttaacattcttcacatcatttcacatgctgaaaactcaacctttgtaaatatagccatgaaccttattatttactataataaagtaacagcatatccttttctatgtactacttgcagaagtataaaaggcaaatgtgttcttgctctttaggtgcaattacaaggcagcagaatgtagttaggctaattttttgcattttgtgctcatcagacagtggctaccaaccctgcaagaaaaaactggtaccaaaaatacttcatcggaaattctattttcatacttagttgctttcagtattcttactaatttggtcaaacttatgtcagctccctcattaaaattgttttctgtctaaatcgttatcttttctgtgtacgtatatgtgtgtatgtgtattatttggtcaatattcagacagaacaagtctgagatgcaccgcataacaaaagtaatcaccccatccccatacttctcagggaatatctacctggtaccaataagctcatcaagagttcatctgaattcatagcctttgtcaatcagaggtgataaactgtgattttagtagtctatgttccctgcaagaccatcgtcttcatgagggctagaatctggtttattttctttcttttttgtcatcaccacctagttcaggacaaagcacacaatatacaaccattggatatttcattcatttattctaaaatgtttattgagtacttactatgtgacaggcattgttccaagtggtggtgatttaggagtgaacaaaatagatggaaatttctgatctcatggagattatatatatttgttgtggatgtctgataataaatatatagaatgacagacaattatctgcgctaaggaattaaaataaagcagggaaagggaaaagtaaatgatgggattgggagttggggttgaaattttagatagggggaccagcaaagaaattatggaaagatcacattcaagtgaagacccaaaagaaatgaaggagggagttagccagaaatgccttggagaaaaggcaaaggaataggaaagagtttcctttaaaatgccaggctatattcagatagaaatgtttctattaaaatataaaggtatacgaaaggcattcaagccaaagaaataggaaagacttttctttaaaatgtcaggctatattcacacagaaatgtttctattaaaatataaaggtcctatagaaacatttctgtacgaatatataaacatcaaatacataaaagttttaaaatgtttcataagaaaggaacttagaaatcaagaagatagagctagggtatttggcattactatgattctaccacaaccctcccaggggaattatccagctcagtaataacctgagaaatttaggggtacaaataaagtttgcaataactgtaatcactgagaatggcaacctcctaatagatctggaatacctagaagaaacaaatccacttttgcaggataccttcaacaactcaggtcatgtgggagtctcacagaaaaagcaaacaccaatgaaaaagagctcatatatcaaaaatatcaaatccgaagaaaggttcatccataaatgagtcagcagatgaaaaactttaaatgaaatgtacgcattaagttcaaaatagggcacaatcttagggaactaatctgagggccaaaataaaaaaagaaagaaactatgaaaaaggcagatttgataaatatacagagatttatagaaataaaattgtcattaaaattaatatctgaagtgagaatttatcatattaaatggagctaaagggaggattactgaactgaaaaataattccaaggaatttacctaccataaaacagagatagaagatattttttaaaaagattaggagatataaatgacaaaataaaaaactctaacatatctaataagtatttaagaatgaaaaaaaataaagacaaaaatgcaatatctgaaatgatgatgaatcttttccaaaactgataaaacctcagaaaactgtaaaacagcatcaggtaggtccttcagggaatatttcagaaaaaggaatttttatcacaggagatgacagctccatgcatgttattacgccagaagaccttccagtgggacaagatgtagaggtggaggacagtgatatggatgatcccgaccctgtgtagacctggctaatgtgtgcatttttgttagtttttagcaaagtttaaaaagttaaaaaaaattaaatggaaaaaatacagaataaagatgtaaagaaaaaatattttgtacagctatacaatttatgtgagctttaaactaagtgttattacaaaaaattcaaaaagttaaaaaatatgtttataaagtaaaacacttaacagtaagctagggttaatttattattgaagaaatatgaaacttttataaatttagtgtagcctaagtgtacagtgtttataaagtctacagtagcatacagtaatgtcctaggccttcacattcattaaccactcactcactaactttctcagagcaacttccagtcttgcaagctccattcacggtattaattataacttataagcaaaagactataccatacagcatacgtgtacaataggccataccatctacgtttatctaagtacactctatgatgctcacacaatgatgaaatcacctaacaatgcatttctcagaatgtatccctgtcattacgagatgcatgactatatatcaaaactcatgcaatgcagctaaacagtcttagggagcaaagtacaactttaagttaatatgctaaaaagaaaagacaagactaaaattatcaagacattagaaaagttacaaaaaagtaaaaccaaaaaatgtaaaagctgaaacgtaacaataatactgagcataagggaaatgaaaaacaaaaatgtaaagacagtcaacaaaattaagtgttgctttttttaaatgactaataaagtagaaaaatctctgggaatttttattataaaaaagaagatagaaataaaattaaaaagaaaaaacaaatctatttggacatttaagtgattactgaatactatgaaatactttatgctaatttgacttaaatgttcaagttattttacaagtgaaataatatgaacaattttgtagaaaaatataacttgcctaagaagaactagaaactctgattcgacaattataaagatatcacatatgtggttagaaatttatataaacatacacacacacatgcacgcgtgcacacacacacacacacacacacacattaccaggcccaaatatatttaaatataaaatttaataaacctttaaaaatctgttgaggtctatgtgataaaaattggaccatagaaaacaggaaagcacctcaactcttgtataaggcccttgaacactgatatcaaacccagataaaggtattatgagaaagaaaaattatttacaatggtgaggatttagaagaggtacaagctagccaaaagacactcagaaaaagaaaagtaacaatagctattatttatttagctactactaagtgtttgataagagttttgcatatattatttaatctgtatatcagccatataagtggttttattttcattattatcacaattgtataaataaaatgatgctcaaaaaaaataaatgggctcaaagtcataaaattaataagtagcagcagttgatagagggagactctaaagaccatgtacttaaacactgccttgtactatttactcatctttcttaattatgttcacagaggacattatgctgtctccctaacacttcacccaattttaaataaagcataatttttggtttttagcagctttactatgatgttcccaagtgttgttttcttcacgtttattgtgtttagagttcactaagcttcatgtctttcacaaaatttgggaatttttaacctttcttcttaaagtctttaaatattttctctgtcctattcttgttcttcaataccctacatgagagaacaggaggtccctcagacatatacccccacagcaataaaaattttctagttatcccaaaaaaaaaagtgccctagttgaaactttggggctcaagtagggggttgtgaacactagtgacacccaagacctaagaaggccattttgagagggtagaatcaagcccacatgacagacttgccaatgatggtcccagcttcagacatggaaatagctccaacatcctgtatcaaaaacatcgacaaaggggcctggaagaagtcatgcacactaatgcctcaggtgacagtcatttgtcttggctgaggatcctaaaagggagctcccacttagctccagttcctcttggctgctctctcagagcagtcctgccagcacagggaaaaagaactcaaaataatgattttcaataagtccaatgagatgtagaaaacacaaataaaccacaaaatataattaggaaaataattcattaaaaaattagtttagtttaaatattatattccataaaaaaaggaccaaacagataccctatagctgaaaagtatgaagacagaagtgaaaaattcaatacagggcttcaacagcagactcaatcatacagaaaaagaattgatgaacatgatgacaggtaatttgaaattacccacctagaggaacaacaagaaaaagactgaaaaagcatgatgaaagtatgaggaacctatgggacaataccaagtgtacaaaaatatgaattaggaattcccagagaagacagacagagtaagaggacaaaaactaatataaagaaatactagcagaaaagttcccaaatcctgggaggcatatggacattcagattcaagcagcataaaggcttccaagagagatcccaaacaggaatgctctaagacatattataaccaaattgtcaaaagtgaaagacaaagagagatcttgaaagtagtgaaagaaaagagccttgttccatataagtgaacatccaaaagacaatcagtagatttctcaagaaaaaccttgtaaaccaggagggaatggaataatagattcaaagtgctaaaagaaaaaaaaaaaaaaacctgccaaataaaacagtatatccacaaaagctgtccttcaaaaatgaaggagggataataacataaccagacaaaggaaaactgagggaggtcatcacaagacttagaagaaatgctaaagaaagctcttggagtggaaataaaaggatactagatgataaaataaaattatatgaaagaataaaacttactggtaaaaataaacatatagtcaaaatcagaatactctaatactgaaatggtaatacgcacatcactttttaatagggttatttgtctccttattatttgttattaggtatacttttaaactttttattttaatatttttggaacacagtaagtatatatatttatggggtacatgagatattttgatataggcacataatgcctaataatcacataaaggcaaatggagtatccatcacctcaagcatttatgctttgtgttacaaagaatccaactacactcttttagttattttaaaatatacaattaaattatttttgactagtcaccctgttgggtgatcaaatactagatcttactccttctttctagctatcgttttgtactcattaaccatccccacttccccggctcctactccccagttacccttcccaacctctggtaactgtcattctactctctatctccgtgagctcaattgttttaatttttagctcccagaaatatgtgacaacatgttaagtttgtctttctgtgcctcactgacacacaaaaaagaatgacagaacctcattcttttttaaggctgaatactactccattgcatatatgggccatattttctttatccattcttttgttaatggacacttaggttgctaccaaatcttagctattttaactagtgctgcaataaacatgaaagtgcatatatatcttcaatatactgatttcctttgttttgggtatatacctagcagtcagattgctggaccatatggtagatctgtttttagttttctgaagaacctccaggctgttctccatagtacttatacttatttacatttccgccaacagtgtacaaagattctcttttctccatatcctcaccaccacccattattgcttgtcttttggatgtaagtcattttaacgggagttagatgatatctcattgtagttttgatttgcatttctctgatgatcaatgatgttgagcactttttcatataccagtttgcgatttgtatgtcttcttgtgagaaaagtctattcaaatcttttccccattttttatttggattattggattattttgtatatagttgtctgaactccttatatattctggttgttaatcactgtcagatggacattttgcaaacactttctctcattctgtgggttgtctcttcactttgttgatggtttcctttgctgtgcagaagctttttagtttgatgtgatcccatatgtccatttttgctttggttgcttgtgcttatggggtattaagaaatatttgcccagtcaaatgtcctggaaagtttcctcagtgttttttttttcagtagtgtcatagtttgaggtattagacttaagtctttaattcatgttgatttcatttttgtatataatgagagagaagggtctagtttcagtcttctgcatgtgggtattcagttttcccagcaccatttattgaagagactgccctttccccaatgtatgttcttgccacctgtgttgaaaatgagttcactgtaaacgtatgaatttgcttctgggttctctattctgttccattgctatatacactgttggtatgccagtaccatgctcttttggttactatagccctgtagtataatttgaactcaggtgatattcctagttttgttctttttgctcaggatatctttggctattgtgggtcttttgtggtttcctataaattttataattgtgttttctatttctgtgaagaatgtaattggtattttgatagagattacattgaatctgtagactgccttgggtagtatgggcattttaacaatgttgatccttccaattcatgaacatggaatatctttccatttttttgtgtgtccctttcaatatcttgcaacaatcttttatagtttttattgtagagatctttctcttcttcagttatttcctaggtatttaattttatctgtagctattataaattgaattactttttaaatttctttttcagattattcaccattgacacataaaaatgtcactgacttttgtatgttgactttgtatcctgcaaatttactgaatttattgatcagttctaatagttttctggtgaagtcttcaaatataagatcatctcatctcccaacaaggaaaatttgacttattgctttccagtttggatgagcattatttctttctcttctctaattgtactactatgacttctagttttatgttgaataacagtgatgaaagtgagcatccttgtcatgttccagatcttagggtaaaggctttcagtttttccccactcagcatgatactagctgtgggtctgttgtatgtggcttttattatgttgagatatgttacttcgatatccagttttttgagggttttttttttatcatgaggggatactgaatcttaacaaatgtttttttccagcatcaactgaaataatcatatggttcttgtccttcattctgttgatatgtggtattatattgattgatttgcatgtgttgaataatcattgaggcctgggataaattccacttggtcatgatgatcctaatgtgttgttgaatttgggttactagtatttgcttatggatttttacatcaatgttcatcagggatattggcctgtggttttctttgttttcttttctttttttttttaaatgtgtctttggttttggtattaggatgatactggcctcacagaagatggacacattccctcctcttctatttttcagaatagtttgagtagaattggcattagttctttaaatgtttggtaaaattcagcagtaaagcgatcaggtcccagggtttcctttgctgaaggactttttattacagctaccatctcattacttattactggtctgttcaggtattggaattcatggttcaatcctggtaggttgtatatgtctaggaatttactcatttcttctaggttttccaatttatttacatgtattaatagttgcttatagtagcttctaatggtcttttgaatttctgtagtatcaattgtaaggtaacctttttcaattttgattttatttatttgggtcttctatctttttttctgtcaattttgtttatcttttcaaaatgtctgtcaattttgtttatcttttcaaaaaaccaacttttcatttcactgatcttttgtattattttcttcatttcaactgcatttatttctgcactgatctttattatttatttaattctaccgattttgggtttggtttactcttgcttctctagttctctaagatgcattgttggtttttttattgaaagtttttctactttcttgatgtaggcacttgtcactacaaatttccctcttagttttgatatgttctgtttccattatcatttatttcaaaaaacttttaaaatttccttcataatttcttcattgaccaactgatcactcaggagtacactgtttaatttccatgtgtctgtatagtttccacaattcttcattattaatttctagttttattccatggtgatcagagaagatatttgatattatttcaaatttttgaatattttaaagcttgttttgtagtcttaggtatccttgagaatgatccatatgctgatgacaaaaatgcgtattttgcagccgttggatgaaatgttatgtaaatatgtattaggttcattcagtctatggtgcagattaagtccaatgtttctttgctgattttctgtatggatgatctgttcattgctgaaagtgggatgttgatgtcttcagctattactgtactggggtctatctctctgttaagctctgataatatttgctttatatatctgggtgctccagtgttgggtgtatatttatttacagttgttatatcctcttgctaaactgacccctttataattacatagtgaccttctttatctcttcttgtagtttttgtcttgaaatctgtattgtatgatatcagtatatttcaagtatacttccaaatatgattacagtattataatgttgtttttctatgtacatattacgtacataccagtagtattatgtactatgtaatagtaataatatttttactgttactgcaagttttgtaccttcagatgatttcttattgctcattaacatccctttctttctaattgaagtactccatttagcatttcctgtagaacaggtctgatattgatgaaatccctcagcttttatttgtctgggaaagtctttatttctccctcatgtttgaaggacatttcaccaggtatactattatagggtaagagtttattccttcagcactttaaatatgtcatgctactttttcctgggctgtaaggtttccactgaagagtctgatgccagatgctctgttgtatgttatttgtttcttttctctttctacttttagaatccttttccttatatttgaccttttgggaatttgactattaaatgctttgagatagtcttctttaggttaaatctgcttggtgttctttaaccttcttgtgcttgaataattatatctttctctaggcttgtgaagttctctaataccgtcctcagaacaaactttctacctctacctctctctttacctcacttttaagaccaataactgttgccctgttgagtatcttgtaggcatgcttcattcttttttattctgtccttttgtctcctaaatatgttttcaaacagtccttcttcaagctcactaattctttcttctgtttgatcaattctcccgttaagaggctgctgcattcttcagggtgtcaactgcatttttcacctccagaatttctgtttgattcttaaaaattgtgtcaatctatttgttaaatttgtctgataggattctgaattccttctctatgctatcttgaattttattgagtttcctcaataattctgtctaaaaggtcacgttatctctgtgtttctgagattgatccttggtgccttatttagattgcttgatgaggtcatgtcttcctggatggtcttgatgcttgtggatgtctgttaatgtctacacagtgaagaagtaggtatttattgtagtcttggcagtctggacttgtttgtacccacccttcttggggaagcattctaggtattcaaagggacttgtttattgtgactaaatttttggtcaatgcagctgtgtctacattgggggcactccagggtcagttacactgaggctcttacagactcatagaattaccatattggtggtcttgtacaagatctggaagaattctctggattactaggcagagacttttgttctcttccattactttctcccaaacagagtctctctgtgtgagtgtgcttagctgcctggtgctgggctgggagagacataatacaagttcccctgtggccatcaccactgagactgtgctgggtctgacctgaggccagcacagcactgggtcttgcagaaggcccactataaccactatttggctgctgcctacattcactcaaggccctggggttctacaattatcagttaccaacaccagccacatctgtgtcctttttttcatggcaccgaatgcccccggccccagatggttccagagaggccctctaagatccagggcctggagtaagaaaccttaagaatctacctggtgctccattctactgcagctgagctggcacgcaagccacaagacaagtcttttccacaagcacagaagtctcttctcttggacaccactgccacaggcccatggggagtactaacaagctactgtcaatgttcattcaagacccaaaggttcttcagtcagcttgtggtgaatgctgccaggcctgggactcatccttccatgtggtgagctcccctctagcctagggaaactccccaaatgccattcaagaaccaagtcctggattcaggaaccccaagagcccacttcctgctctacaacactatggccaagctagcatctaagctgcaagacaaagtccccttttctctcccatctgtttttctcaagcagaagtagtctctccctgtagccaccacagctgggaatgttctggatcacacctgaagccagcatgtttcagagtctcactcaatgcccatgacatgtactgcctggatattgctgctgattaggaaaggcccaaaggctctttagtcagcaggtgatgaatcctgccagggctgggtccttctcttcaaggcagcacattcccttctagcccagagtatatctagaaatgttatctggaagctagtgcctaaagtgggtgcttcaagactctacttggtgccctatcctactgtggctgagtgggatccaagttgcaagacaaagtcctgtttactcttcactcctctcctcaagtggaataaaggagtctctttcagagctaccaattgcattgcttggtgtcagaggaggggtggcagaagccctcccttggccaccctgtctggtgtctcactaggtcatatgacccctgcatccactggctccaagcctagcagagcactaggacttgcctaggagttgcagtccttgtggctcagactgccttaaagtttatttaggaccccagagaattttagcccatagtggtgaagtttgttgatacttgagttccaaccactgggatggacaatttctctcttgtaaatcccttttaagcctaatataaaagataaaagacaaaaaatatcaaaaacaactatagctagaatatttgttaatggatacacaatataaaaaggtataaaatgttatatcaataaagtgggggcctgggggaaaagcaagatacagagtttttatatgcaatggaaattaagttgttatcagtttaaatttgatggttgtcattacaaggtgtgttatatatgcctcaaggtgaccacaggaaaaaacctctagtagacacaaaaaatagagacatgaatcaaagcaaaaattgaataaaatacaaaagaagacagcaagattggaagaaagaaacaaaagaactacaaaacaggccaggcatggtggctcatgcctgtaatcccagcactttgggaggccaaggggagtgaatcatgaggtcaggagttcgagaccatcctggccaagttcgtgaaaccccgtctctactaaaaatacaaaattagccgggtgcggtggcaggtacctgcaatcccagctactcgggaggctgaggcaggagaatcacttgaacccgggaggcagagtttgcagtgagccaagattgtaccactgcactctagcctgggtgacagagcaagactccatctcaaaaaaaaaaaagaactacaaaacagtcagtaaacaattaacaaatggcaatagtaagtccttatttgtcaataattactttaaatgtaaatggattaaattctccaatcaaaatacaaagagtggctcaacagaaaacaaatatgtaaaatccaacaatatgctgcctataagaggctcactttagctgaaaggatacagagccaaaaagtgaagacatgagaaaagatattccattcaaatgataaccaaaagagaataggagtggttatagttatatcagacaaaatagactatcagtcaaaatctatcagaagacacaaagaaggtcattaaatgataataaagtggtcaattcattaagaggatataaaaaattgcacatatacatgcactcaacattagagaatctaaatatataaattaaatgttaacagaacagaagggaaaaatagacaccagtataataatagtaaaagatttcaatattccactttcaaaaatggatagatcatatagacagcaaatcaccagggaaacagtggtctttaaaagtactacagaccaaatagacctacagacatatatagaacattctatccaacagcagtagaatatacatttttctcaagtgcacatggaacagtctccaaatagatcagatgttgggccacagaacaaatcttaacaaatttagaaaaaactaaaattatctcaagtatcttttctgactacattataaaattagaaatcaatcaaaggagaaattaaaaatgaaaaaataaaagtggaaaaatcacaaacatgtggcaattaaataatacacttcttaacagccaatgtgtaaaagaagaaatcaaaaccaaaatcttgcatatctttaaacaaatgaaaatgggcacacaacaagagggaaggacataacaatgaatgcctacattaataaaagaagaaaaatctcaaacaacttaacttcacacctcaaaaaattaaaaaaagaacaaagtgcacaaagtcagcagtaataaggatatattaaaaattagaccagaaataaatgaaatagaaaatagaaaaataatagaaaagatcagtaaacctaagagttcgttttttgaagacagataaatctttagctagattacccaaggaaaaaaagaaagaagactcgaatttaaaattttgtaatggaaaatggacaattaaaatgatagaacagaaacacacaggattataaaaagactacattaaacaattacattccaacagattagataacttagtaaaaaataagttcctagaaacatataagatgcaaagactgcatcataaataataaaattcggaacagattaatagcaagtaaggagattgaatcagtaataaaaaattctcccatcaaagaaaagcccaggactagatgtcttttattttttgagacaaagtcttgctctgtcacccaggctgcagtgcaatggtgtgaccttggctcactgcaacctccatctcctgagttcaagtgattctcctgcttcagcttcccaagtagctgggattacaggcacccaccactacacccagctagtttttgtatttttagtagagatggggtttcactgtgttggccaggctggtctcaacctccagaattcaagtgatctgcatgtctcagcctcccaaattgctgggattacaggtgtgagccaccgtgcctggcaaaagaactagatgtcttgatgagcggattctaccaagctttaaaaaattaatgcccatccctctcaaacagttccaaaatgtttacaagaatgacacacttcctaactcatttcaaggccagcattgccctcataccaaagctggataagagtgctttatggatatacaccatcagcaagctatcgcaaggacaaaaaaccaaacaccgcatgtcctcactcataggtgggaattgaacaatgagaacacttggacacaggaaggggaacatcacacaccagagcctgttttggggtggggggaggggggagggatagcattaggagatatacctaatgtaaatgatgagttaatgggtgcagcacaccaacatggcacatgcatgcatatgtaacaaacctgcacgttgtgcacatgtaccctagaacttaaagtataataaatatacacatatatatatataaagagtgctacaagaaaagaaaattacagagcaatatcttagatgaatatagatacaaaagtcttcaacaaagtaccaccaaaccaaattcaacagcacattaaaaggatcatacaccatgatcaggtgggatttatctctgggatgcaaggatggttcaacatacacaaatcaataaatgtgatacatcacattaacacaatgaaggataacagtgcgggaaaagcacctgacaaaaatcaatgctttcttgataaaaagcctcaacaaatttggtacagaaggaacgtacctcaacataataaagatcaaatatggcaatcccatagaaaacatcatactcagtggtgaaaagctgaaagcatttcctctaagattaggaatgaaaaagcatactcactctcactatttctattaaacatagtattggaattcttagccagagcaattaggcaagaaaaaaattggaaaggaagaagttaaatggtctctgtttatagatgacataatcttatatgtagaaaaaccctgaagactgcagcaaaaaaagaaaaaaaaacctgttgaaacgatatatgaacccaatagtttcaggatacaatgtaacatacaaaaattagttgcagttccctacattaataaagaactctctaagaaattaagaaaaagatccatcttagtctgtgggcattgcttattacctaaggctgggtaatttataaagagaaaaagtttttttggctcatggcttttccggatgtacaagaagcatggcaccagctcctggtgagagctcaggctgcttccactcatggcagaaggtaaagtgaagccagtgtgtggagattacaaggcaagagagaaagaagagagagctgccaggctctttataacaatcggctctcatgggaaccaatagagaaagaaatcactcaatacatcaagacatcaagaaggacatcaaaccacttatgaggaaactacccccacgatcaaacacctctcattaggcctgatagctaacattgggatcaaatttcaacatgaggtttgtggggacagatatccaaattataaaacgattccacttacaatagtatcaaatacaataacatactaagaaataaatttaaccaagttgatgaagaattggtacactgaaaactcttagacactgatgaaagaaactgaagacaaaaacaagtgtaaaaatattgcacgttcgtgaattgaaagaattgctatttttaaaatgcccatgctacctaaagcattttcagattcaatgcaatctatcaatattataatgatattttttacagaaatagacaaaacaatcctgaaatttgtttggaaccacaaaagatcacagatagccatagcaatcttgaaaaggaacaaagctggaggcatcacactctgtgatttcaatttgtcttacgaagctacagtaatcaaaatagtttggtaccagcataaaaacagacacttaggtcaatggaatagaattgagagcccagaaataaatgcacacttgtatggttaactaatctttggcaagggcaccaactatacacaataaggaaaggaaattctcttcaataagtggttttggggaaactggatactcaaatgcaaaagaataagactggatccttgtcttgcactgtacacaaaaattaactcaaaatgaattaaagatttaaatttttaatttaaaaatgtaagatccaaaactgtaaaacaaagctccttgacattggtcttggcaaagagtttttggatattgacacgaaaagcacaggtaacaaaagcaaaaataaaaaaaagtagaactacaccaaactaaaaacctttttcacagcaaaggaaacaaaaactgagaaggcaacctactgaatgggagaaaacatttgcaactatatatctgatgaagggttgatattcagaatgtatgtagaactcacacaactcaatggcaaaaaaaaataataacaataactcaatttaaaaataggaaaaaggcctgaatagacatttttccaaagaaggcatacaaatgggcaagaagtatattaaaaagtgctcaacatcaataatcatcagggaaatgcacatcaaaactacagtgagatatcacctcatgcctgtcagaagggctaagagataaatatctgcaagaatgtggagaaacgaaaacacttgtccactgtaggtgggaatgtaaattggtatagccattatggaaaacagtatggagtttcctaaaaaaatttaaaatagaataattatatgatccagcaagcccacttctgggtttatatccaaaggaaatgaaatcagtatctttaagagatatctgtaccctcataattattgcagcattattcataatacccaaaagatggaaactacctaagtatccatcaatgggtaaagcggataaatgaataaagaaaatgtggtacatatacacaatgaaatattattttgccataaaaataatcaaacctgtcattttcaacaacatgaatgaatctgtaagacattatactaagtaaaataagcaagatatagaaagacaaatagtctgtgatctcacttacatgaaatcttataaaaaggtgaatctcattgcaacagaaagactgatgattgccaggggatggtggtggagaaaataaggagatgttgattaaagggtacaacatttcagttataagttgaacaagttccagggatctaatgtacagaatgggtggtgaagaatgtgtgaattaacttgattgtgataatcactgagaaatgtatgcataaaacaatcacaatgcacactttcactatatacaatctttgtcaattaaatatttttaaataaaaaataaataaaattgtacttccggtttttgagatactgcttattttttatccactcttttttctcactcctttttagattagataatttctattgatctatctttaagttcaatgacttttccttcaacccctcctccattatactgttaatcctactaatttatttatttaatataatacatttctctgttttaaaattcccatttggttcttctttttttttttttttttttttttagatgaagtcttgctctgtcgccaggatggagtgcagtggcgcaatctcggctcactgcaacctctgcctcctgggttcaagcaattctcctgcctcagcctccctagtagctggaattacaggcacatgccaccacacccagctaatttttgtatttttagtagagatggggtttcaccacgttagccaggatggtctcgatctcttgaccctgtgatccgccccctcagcctcccaaagtgctgagattacaggtgtgagccaccgcacctggccaatttggttcttttaataatttcttatttctctgctgagatttcctatctttttgttcatttcaaccatattccctttcatctcttaaagcgcagttttaatacctgctttaatttttttgcctagtaattccaacatgtgggtgattttaagattgtcatctgttgattttctttatccttaagaaagggtaacattttactgggttgaagtaattatggggtttttatttgtttggttgtttgtttttgttttgttttgtcttgagacggagtcttgctctgttgccaggctggagtgcagtggcacgatcttggttcactgcaacctctgcctcctgggttcacacaattctcctgcctcagcctcccgagcagctgggactacaggcgcccgccaccacacctggctaaatttttgtatttttagtagagacggggtttcaccatgttagccaggatgatctcaatctcccgacctcgtgatctgcccaccttggcctcccaaagtgctgggattacaggtgtgagccactgtgcctggccaattatgggttttaacttagacatcgtcaatgttaattgtggatactccagacttggagtccttaacttggacaatgtgttacattgagccaaagagtgctaatatctttgttctcatgggacattaatttggctaatctcatattgaaaaatttgtgctttttggatctcagtgtggactgatttcagtctgccctgtgcatgtgcagttcaggggtcagacaaagacttaagacagaatttatacacacaatatcccatctctgtctctttactttcctatgtttttcctcattctctgacatccccgttccttcccagagttcctacagcctacagagaaagcaagggctttctcttggagttaaattgtcccatgttgccactgcaattggagatgccctcagaaaaagcctcagaaatgtgaaactcacttcatctcatgacatttgcttaatacaaagtttgaacctcctctaatatttctctagtcttatccattctccaaaacctttacagagttgtattgtgttttgttatgctttgcttttatttttggtttttgtccagagtttatagctactatctgcaggctggttgtttttttggaagtttatttctccacacaagaagcaaaactcttgtattattactaatcctgagaacagaaggttacagagaaacagaaaacagaaggctttaaaaaagtaccaagagatacaaataaaaattgaataaaaaacaaacaaacaaaaaactagaaaaatgtctcctgcttctaggagagggctgaacaaaggcagatgaagaggcaataaagtaggtaataagtacatttacagaaatatatgccatcaaataggtaagaatgcaagtaaaatttatatataacaaatacccaaaagttttggaagcagaaaaaatgttagtcaatagttcatattgtctaacaatcaatctgtcacccaggctttgtcacccaggctggaatgcagtgacgtgatcatagctcactgaaatttcaaacactatcctcctgagtagctgggactacaggcatacaccaccacatctggctaattttctattttattttttgtagacatacggtctcactatgttgcccagactggtcttgaacttctgggggctcaatcaatcctccctgcttggcctcccaaagtgctgggattatagtgtgaaaggaaaataaatcttggggcccaaaatcactaagctaaagggaaaagtcaagctggggactgcttagggcaaacctgcttcccattctattcaaagtcatccctctgctcactaagataaatgcatatctcattgcctctttgtcaaggctaatcagaaactcaagaatgcaaccatttgtttctaatctaccaatggcctggaagccccctcccactttgagttgtcctgcttttgcttcaagttgtcctgcccttacgaaccgaaccaatgttcatcttacatatgttgattgatgtctcatgcctccctaaaatgtataaaaccaagttatgctccgactgtcttgggcacatgttatcaaaacctcctgagactgtgtcatgggcatgtgtccttaacgttgacaaaataaacttcctaaattgactgagacctgtctcagattttttagtttcacaacaggcatgagccaccatacctggcctcaaaagtttcaaaaccaacactcttcatcagatcccagaaccaaagaaggaaaaaacaattgaagaatttatgtccacagttatgccaagatttacactaatgcataccacatctcaaagattgaagaactctctcaagaactggcaataattaagtttccaaccaaattatattttctaaattaaaaataagcacacatccaagtgtaaaatttaaaaaaacctgaagctaaagcacattcaccttatagataaaaatatagtccatacctctctattttataaatgcattttcagacttgatgcattataggacatggtaacttcaaacagcaaggaaaaaactcttatttaaaactcagtaagaatataatctctgtaagaaaattatcattttaaataatttcattaaactgttttctcctttgatatacccctggatgtaacactattaggttatagtgaaaaacaccctcaattaactctcaaaaagtatggttccaccattaagctactatgagactttggacaggtcccttcacctatctaggcttcagtttactcatgtgaaatgtgaggctagaacatatggtttctgctttccaggtgtaaaattctataactacataactttatcccttcgtttcatgcagttttatctccgtcttccacttctgtgtcttcctggctggagtagctttatctgtcgtctgaggcatccggggcacaccccatcatttcaggcttagccgtttctaagtcgaaggctgcagtcactgagggcagcctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggaaagattcttgtttaatttctaaaaaataaatttggcaaattcctcagatctcaggcccaaagaaaatatttcaggagagatacattatgcctttcacgcaagtgcaaaaaaattaaaaatgtagactcccacacacaatctcaagcaaatcatcaactgacatctgatgttgtcttacctacagagttaagaagcttgtttacatctgtacttcaggtgagtgagataattttgtgaatggtaggttaaaagtaatttcaaatttgagaattaagcaatgagaaatgtgctgtaaatttcaagaaaaagatgctgcaatactgtttaggattctgagaactttagatctatcttcttataaaaacttccacttagaaacaaagaaataaacaaaaaccaggataaacaatacaatgctctttccaacttgctggaattacattcactcagataaacatttattaagcacttagttggtacaaggtgtactgtcctctgtgagacacacactcatagaaaagaattttgtatctgctttagtgagtttataatatgccagaataaatacatactaaaaggcatatatacataaataatataatgcattgcaggaagaggtaagtactatgatagagggacacagaaagtcctgtgcctcaggccttgctccctgcagggcactaagctatttcgaatcacactgcaggaggtggccaactacacagtatgcagtgcatcagtgctatccagggaagaaaagactactacatggttaagagagcctgaaaaaacagaagcagagaggtggacctagaaaactagcagtcggttgaaggtcaatatgttcctacctggaaaatagggtccaactactgggcagaaggccaggacccaagggtgattctgtgcaactgggggaggtgagaaaggagagaaaggaagtgagtattctgctgtgggaagaagggaattccaagatgacaacacagcaagagcttaactatagatgaaggaattctgaatttcttctagtttcccatctcatgatcatgtcaatataaaaggaaattactataaaatgtaataatttctaccagtctacagattctggcaggctaaattaaacctgaagataaggacaaaattacattccagttcctacttacaacttctatcacataaagaggtacttacatagttcatatgtgcaaactgagttgcatgctttctaaatcgttttatttaattgtgaaatgtttggaattgggtgtcactggtcttcattttgttttgaaaaggcaatataagtgaattaatctatcatcaggctaataacaagaataagtattttaactccttcctttgaaatgaaaagacaaattctttagccaagagcttccaagtttaatttacgattcacaaaattctacaaacataaattatatagtagaagtttcccttattcttacttgaatataactctaatcatttgaatatcagttttaacaaaatgaataagagtacaacagagttcagatgaagctcgtttcttgccaaaatccatatgaatgccaaataccttccaagcacaaataaatcctgccttccatttaaacaaacaaacaaacaaacaacaaacaaaacaccacattgcctaagattgggcaatcactactaagtgactactaagtagtgagtaagagctaagggaaacggagcgaactttaggtcaccagggcacggtacactgaaaaacatgtgctgcgcttcttcagaaacaagctacaacagcagaaagacgaggtaccttatatcttgtttataaatcttactttataaaggagaaaaaaatgaaaaaagggaaataatattcccttatatcctattttgtgctaggcacttagacaatgttttattatttaattgaaacttgagttcaatcggtagcaggagcggcgagcggaacccagagagccctgagcagccccaccaccgcccccggcctagttacagtcaccccagaaggagccacaaccctgcagccagcaggtcaccatcacagcaaccacaaccctgagcaaagacgccaaggcagccaaccccaagccggcaccacctgcagcggcgcagggagcagtggcaagggcgacctcacaggcggcgcctgctgatggggataagatcaccgcaaggaagattttgggaacagtaaaatggttcaatgtaagaaataaatggtttcatctatgcgaatggcaccaaggaagatgcagttgtacagcagaataccatacagaagagtaaccccaggaagtaccttagcagtgtaggacacggagagactgtggagtttgatgatgttgcagcagaaaagggtggggaggcagtaaatgttacaggcccctgtagagtccagttgatagcagtaagtatgcagctgaccttaaccatcattgacgctatccatgtggtcctcaggcaattaccagtagaattaccagaatagtgagagtggagaaaagaacgaaggacgggagagtgctcccttaggctcggcccaacaatgccggccctgctgcaggcgaaggttcctgccttactacaggcagagaccctacggaaattgaccaccatattctaaccctccttgcagggagcagcgacggagggtgctaacaactggggtgcaggagcacaaggtaggccagtgaggcaggatatttgtatggtttatagaccacgattcctcagggaacctcatcgccaaagccagcctagagaggacggcagtgaagagagtaaagaaaatcaagatgagacccaatatcagcagcgacctcaacatcggtgctgctaaaaccccaattatctatgtagactcccagaaaaccctaaaccacaacatggcaaagagacaacagcagccagtccaccagtcaagaattctgcacccgaggcagaagaaggttgagtaaatgccggtttaccatctccaccatcatccagtttaatcatccaacaagaagaaatgaatatgaaattacagcaatgagaaatgcaggaaagaaatgctgaagaccttaagtgcttgctttttgcccattgatcagaaaccagaactacctgcattatctacgaagcatggggtttttaaaattatttttacctacagacatgtctttttggtaataacaaaggtttttattgttgttgtttttgtgtgttttttttttagtttggtttttctcaacatgcctttaaaagcttttaaattggttcatatgtcaagttgagatttttaagcacttcacttttaatttgtaataaaagtttacaacttgattttttcaaaaatgtcaaccaactgcaagcacccattgaaagtcttaaataatacaaaaactttaaattaaatcaaatgggtattaacaccatataatacaaaaaagaagtgaggttcgaaaatccttatgcttttgtgatgccacacgtcacctaactggtagcacaacttgattgcaatctgactctgaagcttttcttcattcctagacatcctatttttgttgaagtcctagattttaaaagtataatttttttaggaataaagatctggtaggcaggaaattctgctgaagctgtttctgggcaacttgactttgccagggcctttgcactgattgtgttaatggccacctcctcttcagatgtagggttatggatcacctgtaaccacctgtaacctgtacagcaagctgaaggagtgtttgcctaatatccaatccacagaatttatttcaaaaatggtgagcctcactaaggtgatagcagtagcctgtccacaggctgatcaacaaaatcttgtctttgatccatggtttctgcttcttggagtctcccaaggtacattctgccactgctggacctagaatcatagtctcctttcctaccagccttctcaccctgccaaacttatcatatacaattgtttgacatcacagatattatcaatccctaggcctctctagctttctgctcttgcaatttcttttacattgtctttgtcacccagcacagagcccatacataagtcatcactctattttcttagaaatactttcagttcacttcttggttttcctatctcacttaccaagctgtcttagtacagatctaagatgagaattttagtacaaataatttattttggaaacaaccccatgaaacactggtaagggagaaaggatggaaggcagaaaagggaaataagatagaatgtttgcaaagataaccatcaatagttcctcaaagccttgctctagcatgctgctcttcccatcaagaggcagagtttgtttcccccactcttgaatctgcactgaccttgcaccctttttttgaacaatagattgcagcagaagtgatgctatgctagttctaagccaaggctgcaagagtcctggcagcctcttcttttgctttccttagatgcagataccatgtaaagacgctcagactagattagtgaatgatgagaagcaatggggagagacaggcccagacagaccccagccattctatacattgcactgaggcctaaaacccataagtaaagccatcatagtcattcctgacccagacaggcttccagtcaagtgcaactacatgagtgacccaagctattactaatctaagcctgggcaccccaaagatttgtaaaaaataacaaatctttgttgttttaagtccctgtatttgggggtagtttgttacacagccataaatgaaacagggacaaagccaaaaaagggtacaattattaaacaagttactgctatgggaaatgagtttagtccttctgggatactctggaaaacagtaaagaacatgcctcacagttatcccatgtgaagggtaaggatgatagtgtaatccacccacttgctaacagttatttgcttaagtctttttctagtgacagtaactatttggtactttaagcctgcccaacactgtgagccaaatctgctcagcagccacacacaaaaaatgccttcaggcagacagtcacagtatcaggaataagcagtcttctgtgacaagaggtgagtggtggaaggaaacaggaagagcgtcaacataggtgaaaacccaggcctagagcagtccagctatctgctttctccactcctagaactgcaacagctaaagtgggtcacatacactcacagattataaccactacacatctacagctcccaaacttagctgggtcccaaatgttacttaataatccttccaagtttccctaatcatctgtttactttagtatattttacatctatttcaaaacttcccacttttattaaatcttctattccacctacccctcccccttcggtatcagcaaagcaatatgctctctatcccaatgagaaaataaaggtcatcagatcaattttttgctacctccattgcactgcattcagaatcatccttccttccttccctactaataccacaggaaagggtcaaggtaaatgcagcattaatccagcacctctccatctctggaataccccaccttagaatacaagaacccattatgtacttgcccttttctgtctctcttaggtccctaatgcatgaatctcatcgagttatagatctgttgaaaccctacacctatggatctttgcaccaagcattgttcctactgcctaaaatgtaccttccccaactttccccatttctagactctgccctggcagagtcctcttcatcttttagacctccacttacctgcgacctcttcaggaaagccttctttactttgctgcccacgattcctcaaatctatgcttacctctgccacagcactttgctcttttctgaaatcgctcattcctttttctgatatccttttcctcctcctttacctcccactgaaaataagctcctccaaatcaggtatttgccttatatatttttgaaccatagtatctgtgcctagaacatagctgtggattaacaaatagcaccaaatttaaataaattaattaatcatctcttttccttaagttactttccagagtaactttagtggaagctgcaggcaagatttatgtgtactgtggcccttcctctttctatctttttttttctttttaacattctaagaggtatcatacaggtcatgataaactgagtctcttctaaatttgcatatagtgaaaaataacacgtcaaaatgcatttgcttagaagctcaggaatccattgttcagttaaaacttgttgccttgttataatgttatgacaaaataggcttccatactggcttttaacatataattgttaattatcatcacaaaagtttcaaaatttcttcagttttaaaaagattttcataagtaaaaatgcatacagtacttgtatactcacagtgagcttatttaataatatgtttgtagaatgtaaaatagctttctgttttatggtcagatttgataggcctatcaaaattggtttttatagatatgattgctactttcatcaaaaaatgaaccatcaactttaagagaaatgaaaaaatcaatttgggtcatggtaacttctaagccctactacctagtcctagaatttgttcttaatagaccagactgtctgcaaaatactttgaaacaaagaatgtgtactttgcctcctccctaccatgttcttggcaactagggaatatgggacattttaagtctttaagataaaattaatcacactgatttagaacaactaaaatcttgtcagagtaattcctaccttctcccttccccaccatgttacctttaggaagaggagacacacttgaggaagctcttcaaggctggtcttcagggaaataaagacattgaaattccactccaattattttttattacctgccaccttgaatccagaatatatgttacattatgaagtgtcgtattcttgactcaaaacatccttccaattaagattttcttttttaaaaaaaattaggttaaagcaaaaatgcagaaaagaagggtaaataagattagtaaaccatctgaaaattactgcattttgtaaactttggtaaaatgtatgaagaagcatgttttccagtctgctttctcggcctgtggatacctgggacataattcagtttgccatcccctgttcccagatcagctcagtctttgttcagctccatcttcaatctggcatataattacttcttcagctcctgtgctatttggttttaagcacctcttacccccaaggcctcatggctctaagggcttgttgaatttaaacaagcacatttaaatctttgtctttaaatgagtaaaataaaagtcttaacacctaacacagagtactcttctacactctaaatgtgcatgttataattgcctaccagatcataatgagcatctatccatcctcaaaatcagagaaaggggggctcattctagaggtaaatttacaataaatggctttattcttgattagctatgtgtgtttggggacacagagactggcacctgcataatttaaatacctgataggaatcagatgatcaggacaccttggaaataaaggtggaaaaacaatagtggaggaaacacaataatggaggaaatacagaagaaaaaaaacaagattgttaaaagaaattaataaaatacaacttaaggaattttaagcttcacctctcattggaaaaacactgcaaactcatacacacactgatgcatgcacacatgcatgcacgcacacatgcatgcgcacacacacgtatgcaatataattacagaaatgttaaaactgtctgtctttcctgagagtcaggagatgtggattctgccactactgctgctggcaaatcataaataccatccagggttttagtttagcctgagtaaatgagtaatcattacatttgttccacatacatactttactccaaacactggtagataagtattgaatgagaccctcattcaaatacacggtcaaaaatgccacaaaaagaagtattataattataactattaattataagtaaagttttttaatgaatggataaattagtaaaacaaattttaatagatataaatggaaaacaaagcatgtgcaatctcactagtgatgaaggtaatagaaattttaaaagtgagatactagtctttcacctatcagatcagttaaagtcaataaaagaaaaattcagtgttggaagaggcactgcagtgggagtgtacattagtaccattaagcactatgtatcaagggcctgaatcatgattatgtactgtgccagtttgggtcctcttgtgccaaggtgaattgggtatgtgagataattatttggggtagaatctatacatgataaaggggaagaggtgtaggtaaggagagcactcagactatgatgcaattctgacatctctgaaaggagaaaggcaaggaagcatttggtaggaagagatctgcatgcaggaaagtcctgagaaagtctcagccagggttggttccaagtctttgttattgtgaatagcgctgcaataaacgtatgtgtgcatgtgtctttatagcagaaggatttataatcctttgggtatatagccagtaatgggattgctgggtcaaatggtagttctggttctagatccttgaggaatcgccacactgtcttctacaatggttgaactaatttacactcccactaacagtgtaaaagcgttcttatttctccacatcctctccagcatctgttgttttctgactttttaatggtcgccattctaactggcttgagatggtttctcactgtggttttggtttgcatttctctaataaccagtgatgacgagctttttttcatatgtttgttggtgacataaatgtcttcttcttcttcttcttttttttttttagatggagtctcgctctgttgcccatgctggagtgccggggcgcaatctcggctcactgcaacctccggctcccgcgttcaagtgattctcctccctcagcttcccaagtagctgggactacaggcgcatcctaccacatcctgttaattttttgtatttttattagagacagagtttcaccatgttagccaggatggtctggacctcctgacctcgtgatcagcctgcgttggcctcccaaagtgctggaattacaggagtgagccactgcggccagccgtaaatgtcttcctttgagcagtgtctgttcatatccttcagccacgttttgatagggttgtttgttttcttcttgtaaatttgtttaagttcctggccgggcacggtggctcacgcctgtaatcccagaactttgggaggctgaggcgggtggatcacaaggtcaggagatcaagaccagcctggctaacacggtgaagccccatgtctactaaaaacacaaaaaaattggccggccgtggtggtgggcgcctgtagtctgggactacttgggaggctgaggcaggagaatggcgtggaggcaggagaatggcgtgaacccaggaggcggagcttgcagtgagccgagaacgtgccactacactccagcctgggcaacagagtgagactccatctcaaaaaaaataaaaataaaataaaatatttaagttccttatagattctggatattagccctttgtcagatggatagatggcaaaaattttctcccattctgtaagtcgcctgttcactctgatgataatttcttttgctgtgcagaaactctttagtttaattagatcccatttgtcattttggcttttgttgccattgcttttggtgttttagtcatgaagtctttgcccatgcctatgtcctgaatggtatcacctaggttttcttctagggtttttatggttttaggtcttacgtctaagtctttaatgcccatcaatgatagactggataaagaaaatgtgccacatatacaccatggaatactatgcagccataaaaaggatgagttcatctcctttgcagggacatggatgaagctggaaaccatcattctcagtgaactaacacaggaacagaaaaccaaacaccgcatgttcgcactcataagtgggagctgaacaatgagaacacatggacacagggaggggaacatcacacattggggcctgtcgggtggtggggaagtaggggagggatagcattaggagaaatacctaatgtagatgacaggttgatgggtgcagcaaaccaccatggcacatgtatacctatgtaacaaacctgcaaattctgcacacatatcccagaacttaaaagtataataaaaaaaaaattctagaaaaagaagttgcatctgtactgaacatgtacagagttttttccttctcattattccttaaaccatacaaaaaagaaagtctcagccatgttggtagggagtccctgaaccagagttacccattagaagaatctagtattgggcagaaatgtccccgttctggtattcctgacatgttcagtcactcggtggaagcagccccaaagaaggatggtttcagggtgaatgttgtggtggatccacaggtatagcagctggaggctgtcaattatctatgctctctacaaaagctcctcttgaaaacagagctgagaaagacacttgtatacatatgattttattcccgttctaggaatctatctcaaggaagcaatctaaataccaaaataataatgataaagagctttatgaacaaagatgctcatcgcagtcttttaaaaaataattgaaaggatagaaacaatttaaatgtccaagcataaggattgattaagcagctatagtatgtctactttaccaaaaatgctgtggctattacaatggaaaacttatattttaagtaaaattgaaaatagagataaaatatggtataacttttaaaattaaaagctttgaaaagatacatattttaagactggcagaaaataaaccaatatggtagtaataggaagtttttttgcatttttgaattttccaaattttctttattaaaatttatgacctttagctgagggaaggaagcattcaaaataaaaaggcaaaaaagcaaaatagttaaaatgatttagagtcgaagtaagcaggggaaatatgaagctatagaagagaaaacaaagaagacaataaaaatatctgaagaatactgtcttaataattctgggactaggtgtggtggctcactcctacaataccagcactttgggaggcccagccaggaggattactcgatgagcccagagttcaaggctgtagtgagtgattattgtgccgctgcactccaggctgggtgacacaccaagacccagtctctaaaaacaaattctggaaaacagcttcatggctccaacataacattgaacaaagccaaagatgggaaaggaaaagggaatgtttttattttcattgtagcattgggtttttaaatgaaaactgatgtttcatatgctcttctatgactattcagtataggtgtttcaccatcattgtaaggagtatcttctgtgtatgtaagtatgtgttcactagtgcattcattttttcaacatgtgattaaacagtttgagagtcaccatatgccaggtactgtgcaagcaaatcaaaggtcacagtgtaaaatgagaaagggtatgttttggccctctattctagaattgtttatagaaagtgcataatttaagcccatatgtcccatgtcctaaagatacctgtccattaaatacagtgcatttcattgccttttcagactctcttcactatgcacataagtgacaatgtaattgcaatttgattaattcatataaactaagaaaggaggaattattcattcatttctgatttttttttttttggaaagtatcccattcctactatagtttgccaaaccctctcagggtagacctctatttacttaaaagaactagtttcatagattgctgtcatgcaccctaattagacaaacgtgttttccaggtctatttgaaggacattctgatataatgcatacctatcttcttaatcttcttattcagcttatgcatatttcttttcctttaaaatccatcaataaatgatctgtgatctgtaagtaattaatttaatgattacatgaattaaaataatgcacattgctttaaaggagttagtattttcggtttatgttacaatattggccttgggtaaatatcatccattgcctgaatttcataatggttcaaggataaaccatttcctctttataattcagtaagtttgttccaaaggagcctattgctcctctactcaacaatgaaagaaatgcattcagggaccttaggttgcctattcttaataagatggaatcctttcccggtttgttaaattcactgaatttataactcattgttactgatgaaggaattaatccaagcccgttaccagattgatctcctaaaatccacagagcgaatttggtgtcatttttaaaaagaaataaaataacaaaaataaaaatacaaaggatgtcagtaagttacagacaggagggcatacctcatatttatcacctggaaaactagagaaaagtttcatcaaaactgtttcatgcatctgtgcagggctaaagtcatctgctaatcagcactaataatgatggggataacaataataatctgctacctttacataacagtttttaccttgggaaaagattttcacatactactcttcatttagttcttataatgactttgagaaactaacataaatgttttacaagtcccattttgtgaaagagaaaattagagtacaaagaagagactgacccaacaataacatttaactggagctagactcctacttcaggtttttaaaatgctttcaaatcaatagaattcatgatttgcaatgttttcctaaattctgttaaaacacacttaggaccgtaaattttcaccaaccataacagacacctggtaagcgggcatgtaataaacaattgagatgttagaaaaaaagatatgtctctgatgagcagggcaaaagtgaatgtaagtcaaaagatatctaaagactctatagcttctggaataataaattggtagttttctttatttttcatttgttgtttcagaaagtgtttaacttttgatactaccaccaatgtaaaatataatagattgttagtaacaataaatcaatctctacgttgtccaaataggtgtgtttacccaggtccacactgttcaagttttattaaaactgtttcgttttatccaggtttccagtattgcatctcctaagacaaacactgatatttatctgctgatgcttgttttactaaccaaatattacattacacatggtttatcacattacccagggaggtgacaatatttcaggaaaaaaattaacaaatcaaaataactttgaaaactgtttataccccatgtacaaaagtactgtctatgcctagttattcactactatcacaagatatacataaatcagagtttttaaataatactgacttccccttataaattcctttaccccttgtgaaaggaacctagcaccattatgacacagttaagcattagtcacagtttaataaataatttcgttatagcctcctagtctatcagtattatttggattctcagaatgcatgtaatcatgtaaattacaaaatttcctttgtatcagggataaccaactgtcttttataaataatgttatttttggtgatttttcaatatcagaacagtatagttttggctagagaaattactataagcattcaaataaagattaatcaatttatacaaggcaaataaactttttgtactcttaaatacttaaagaataatatatacattcaaatatttgtaagaaattcatatagaggggagtataaaacacatatggaaaaggaggtatgtctgcagaagttactttgtaaagaaacatagtgctcaactaccaccctccctcaaatatcatgtcaatcaaattagcatcataagaagaactccagttctactgtgatagagtagcttatatcaaatcaccccctcgttgagaaaaactattaaagatgaataaaatgaaattattttaaaaactgtttgaaggcaccaggcaccaaccaaagtaatttcaatttaaaactcaatagtctataaaggaagtaaacacgttaaagtaagccctatgttgtttattacttttcaaattcaaggcatttgctgtttcctaagtagaacagaatgcgagactgagcacaaagctccagattagaacattaagaagtcttgtaaagagaggagggcacaaataacactttggagctgtcagcacagccaagacatgaagaatcaagatcctggataaactgtaaatgcaatgaggtgaggcctgtattctttttccacttttaacccctaaaacatttccagttcctctttcttggagtgagaaaatcaaaagagaaacaagcagaaaacagcaacctaaatactaggacattaaaaagaatattcagtagtcttataccaacgaagcaaaaactggagtttagtgactacttgaaaagcactccaaaattttatttgaacctctaaatgactatttataaaactaagggaaaaccataactagagtagccatcacaaagatggaaacccaacttcaaattgtcttaatccctgataagattaagtaaattacctttattctaataatctgtgaggagaaaattaaatccccatggaaaaatataataccatacaaaacactctaaatttttaatatgaaaaaatcatcaagcatgctaggaagtagaatcaaagaaccaaaacaaagagaaaaaataatagacaaaaacataaattcaaaaatgatacagattaaagaattatcagatatagtcttttaaaaacagtgataaatatggtttcagaggtaaaggaaaagagtgagaataatcagagaactgggatttatattaaaaacccaaagattattctagaactaaaaataaaacaaaattaataactcaatcgcagccagttagacacaacagaagatccaagttgtgaacttgaaaataggttaatagaaaatatccagaataaaacaaagagagaaataaggatgataataaaagaagaagcattagagatatatagaacatggttaaaaaatgttttaacatacaaatatctctagtcccagaaggaaagggtaaggagaataggcagaagcaaaattcaaagcaataatggccaagaattttccaaaattggcaaaagcatcaagccacaaattcaagaatgtctaagaaccccaagcaggataaacacaaagaaaccaactacaaaaaaaaaaaaaaagcctgtttgtaaaactatttaaaaataaacaataatcaaaaaggcaatctcaaaatagccagaaaaataaaaatgcattactttgtaaggattagtaagtctgataactgattgctcatgaaaaacaattgaagccagagaacaaagccatgatatctttaaaatgcttttaaaaagtaactaccaacctaagaaacccaaacaacagcaaaaaactaaataacctgattaaaaaatgagtaaaagatctgaacacacatttctcagaagaagacataaaaatggtcaacagatatatgaaaaaatgctcaacgttactaatcattaaggaaaagcaaattagaaccacaatgagatcacctcacacctgttagaaaggctaccttcaaaaagttaaaagacagtaagggttggcaagaatttggagaaaatgaaactctcatacactgttggtaggaatgcaaattgggtacagccattatgaaaaacaatatgaagattcttcaaaaactacaaatataactaccatatgatccagtaatttgacttcaggatatatatcctgaggaactgacgttagtatgttgaagagatatctgctctcccacattcatcgtagcattattcacgatagctaagatacggaagcaacctaagtggcatcagcataaaaacagataaagaaaatgtgttaaatacacacaacagaataatattcagccttagaaaataaagaaatcctgtcatttacaacaacatacgtggacctggaagatactatgttatgtgaaataaggcagacacagaaagacaaatactgcatgatctcacttaagtgtgaaatccaaaaaggccatagatacagggagtaaaatggtggttactagaggctgagtgttggatggtgatgaagaaaggggagatgttattcaaaaagcacaaagtttcagctagacaagaggaataagttttagagatatactgcacagcatgatcactataatttataagagtgtattatatattttgaaactgctgaaagtatactttaaatgttcttaccataaaaacacgataattatttgaggtgatggatgctaattagcttgatttattaattctacaatgtaaacatatactgaacatcacactgtatctcataaatatatataattgtcaatcaaaagtaaaataaaaataaagcaaaacatatatatacacaaaaaagtaaataccaacgtagaattctctaaccaatgaaagtattcttttaaaaagtcaaaataagaatattttcagaaaaacaaaactgcggaaatatttcaccgaaagattcatactataaagaatactaataggtatctttcaagtaaaaggaaaagcatctcagacaatgatagagaaatgcaaaaaataaagtacacagacaagattagtatgcgtataagtatagaaaaataataaaaataatgttttaggaattagagcacttgaagaattataattcaggacaatgataagacaaaaaatgagagagggacaaatataattattcattgaaaagagataaaaggtgtaagttacagtagagctcattagggtaaccactaagaaaaattaaaaatacgtaattagcaagttaaaagaggggcaaatgaaataacaaggttgattaataaaaaaagttaagacagaagaaatgggaaacataaaattggtagaaaaaatagaaaagtacagtaagatgatagaattaaatcaacaaatattagcaagtgcagttaatgtaaatttaaaaagttgcattgaaatacaatgtcagactttgaattaaaaatcaccattaataatatgctatttgcaggacacataccttaaaagtaagtatacagaaaatgtgaaaggaaaagtgctaaaaaaaatttaccaaacaccaacgaaaagaaggctaatatcactatacattataatatcagtctaagtagaatgaaaagaaatagtacaagaagagcattaaataatactagttaatctactaggaagatatcacagttccaaatttgtacaaaccaataacataagcttaaaatgtacaaattgaccaaactaaaaggtgaaataaacaaatacacaatcaagttagaaaattttgacatatttctctcagtaaatgatagaacttggtaaaaagttggtagataaataaaagttttgaacaccaagatttagcaaatttgatctaatttatatgtacagaatcctgcacccaatagcaacaaagtacacatatttgcaggtgcacatagagcatgcaccaaaagtatccttaaactgagtcatatagcaagcctcaataaattttcaaagtatttatatcatatagaatatcttctctgaccgtaattgaattaagctcaaaattaataacaaataagtattataaaatacatcaaatactttcaaataaagcaatagataaacttgataaaagtcaaaaattggggtcttttggtaaagaaagacaaatataagcagtagtcttctagaaacacaaatttcaaagatgaaaaaggacaaataaccttaacaggaatgaaaaaatggagtattgttacagatgctacagacatagtacaaagataataagatctggtgaacaagtttacatcaataaacttgaaaaaattgatgaaacatataaatcccctgaaaaacacatattaccaaaatggacacaagaagaaatggaaatccttcatagtactacgtcttttaaaagacatgaatatttgatttggaaaactcttctggacactggtctagagaaagaattcattaataagacaccaaaagcacaagaaaccaaaacaaaaacagacaaatggtacttaattaaactaaaaagcttctgcccagaaatagaaataatcaagagtgatcagatgacctgcagaatgggagaaaatatgtacaaactatcaatcagacagaggactaacatctagaacttacaaggaactcaaactaaataacaacgacaaaacaaataatcctatcaaaacgtgggcaaaagacatgaatagccatttttcaaaagaagacatacaaatggccaagaaacatataaaaaaaaaagctcaacatcactaatcaaagaaatgtaaattaaaatcacgatgagagatcatctcagactactcagaacagctattacttaaaaagaccaaaaacagcagatcttggcaagcaattgcagaaaaggaaacgcttatacactgttggtgggaatgtaaattactacaatcactatagaaaacaatatggagatttctcaaagaaccaaaaatagatctactatttaacccaacaatcccaccattgggtatatacccccaaaaagaaattattataccaaaaatatacttacactcatatgtttatcacagctctagtcacaatagcaaagatatggagccaacttaaatgtccatcaatggatgattggattaaaaatgtgaaatatatatgtaataggatactatccagctataaaaaagaatggaatcacatcttttgcagcaataagaatggaagtggaggccactattgtaagtgaaataactcagaaacagagacaaatgtcctatgttctcacttataagtgggagctacctaatgtgtacacattgacatagagggtggaatgataaacaatggagactgggaagggtgaggaggaagggggtggatatgagaaattatttaatgggtactatgtgtgttattcaggttatgaatacactgaaagctctgaattcaccactatgcaatatatctatgtaacaaaattacaattgtacaccataattttacacaaataaaagataaaataaaaaagtctttccacaaaactttctgactcaaatagtttcacaggtaaattatttcaaaaatttaatgaaaaaaaaatagcaccaatcatatacaactcttccaagggtagaaatagagggaatacatccgaactcattttatgagaataatataactatgcaaagaaaacctgacaagaacattaagagaaggtaaaattacaagctaatctctcttttgaatgcaaatagaaatatcttaaagaaaatattaagaaaatcaaattctctatgaaaaggataatataacatcaagtagggtttattctaagaatgcaagggtggattaacattcaaaaataaattaattaaataacaaaaatcctatgatctcaatagatccagaaatgtatgtgaatattccttatgatttaaaaaaaaaacaaaacagacaacacagaaacacacataaaacaacaacaccaactcagcaaactcacgaattgaagagaaattctctagtggatacaggaaatttacaattttcaaaaaagcaaaaaccaaacctagaacaaatgttatactagtggtcctagctagtgcacacaagtggtcctagctagtgcaacaagtcaaaaacacttataaattaaagttatatggaatgaaaaggtagaaataaaactgtagttattcacagaaaacatgactgtgttataaaaaattcaaaagaacccacaaagtctaatagaattaataagtaaatttagcaagattcctggccaaggtgaatctctctctctcctctctctttctgactctctctctctctctgtgtcatagatagatagatagatagatatgaattgttttcttatatagtaacaatacacatttagaaaataaaacttaaaatgataccaattacaagagcattaaaaaatctaattgtagaaatgaatctaacaaaaagtatgcaagtccactgtgcagaaaactataaaatattactgattaaagaagaataaaataagtatgaattataatgcatttatagattagatatcagtattcccaaaataccatctcaatcaaaatcccagcaaattacatattgtagagattaacaagcagattctaacatttttatggaaataaaaaggaacaagactaactaaaagaatctaaaagatgagcacagctaaaagatttacactaccagatattaagatttcttctaaatgttcactacttagtcatgcatcattgatgcaagggtaaataaatagattcctggaataagagtccagaaatatgtccatgaatatgtaggcagtacatttataataaagttattgctaacatactcagggaaagtatttttgacaaatggcacttgatcaattttttaaaaagaaaaaatgaatcctgtccatccttgcccccatctcacacctaacacaaaaaaatgaatttcaggtaaaatgcagacctacattttaatggcaaacaataaagattctagaagataacaaaggaaatgtctttatgacattaaggtaggcaaaagcttttccatttttttgtttttgttttaaacaggatagaaaatactaacactaaaagaagaaattgatcattgaagtgcattaaaataaaaaacttttgtaaccaaaagacaactataaggtcaggcgcggcggctcatgcctgtaatcccagcactttgggaggccaaggtggccagatcacctgaggtcgggagtttgagaccagcctggctaacatggtgaaaccccatctctactaaaaatacaaaaattaactgggcatggtggcataagcctgtaatcccagctacttgggaagctgaggcaggagaatcgcttgaactcaggaggcaaattttcagtgagccaagatcgcaccactgcactccagcctgggcgacagagtaagactctgtctcaaaaaagaaaaaaaagacaattataagagagtaaaaacataagcttcagaataaaagtagatatctgtaataagtatatctgacaaagaagtatatatcagaatataaaatgaaatcccagtaacttaataataaaaacagaaacaaacccaactggaaaatggacaatacctttcaacatgcacatcacaaaagaggatacccaagtggaaaataaacatatgaaaagacgcttaatttcactaatcattagagaaatgcaaaccaaagccatcatatcatgggctaccatgtcacacatgcctgaaaaactaaaatgaaaaaagaccaagtgttttcgacgagtagaacaataggatctctcttatacagtagtccccctttatccatggggaatacactccacctcccttagtgaatacctgaaactgcaaatagtacccaatcctacaaatactatgtttttttcctatacataaatacctatttaagatttaacgtatttatacctatttaagatttaatttatttaacattaatgtataaattaggaacagtatgagattaacaacatacttaatcataaaatagaacaattctagcactatactggttatatgaatgtggtctccctccctcctcttctctctctatttccctctcaaaacatctttttgtacttaagggtgagcccttcttgtgatgatatgagatgataaaatttgggctgcagctgactacggataactgaaactgtggaaaactgaaatcatgaatcaagtgggaggggcattactgtgctgctactgatcatgtaaattggtataataacattgaaaattatttggcactatctactaaagctgaacataagcacaccagcaatatcactcctcagcatatatccaataagaatgcttaaatatgtaaaacaagacatgtagtagaatatgcatgtggccaccacaattcataatggcttcaaactggaaataagccaaatgtccatctatagtagaagagctgaaaataataataatagaattgtgattatattaatacatggaaatattataaagcaataaaatagttttaaaatctgcaagcacatgtaaatgcaacataatataaatgaatctcagaaacataatgtgagcacaagaagccacatacagaagaatatataatcacatgattctatttctatatttttcaaaaataaactaatattagaagtcatgatagtggttatcctgaggaagtagagactggaaagatagataaagggatctttgtggtctgctaatgtttttttattggtctggtgctgcttacatgaatatgttcactttgtgaaaattcacttacctatatttttataatttctgaatttgtaactgttttcctgcactaaaatatttcatttaaaaattatctttaaaaacaattgcgaccataagaatttccattgcttttgtttttttttctctgttttcctgctacttagccttaaatatgggcatagtcacagaaatgtgcatatgaggtaaataaagccccagcttgctggctggaggacataaaggggagctccaggaaaactaaaaaatactaatgagagcacagagaaaaaggggctgcagaaagtgatcttatagggttacaaaattctgggctcatctttagctgtacatgcatggatctgatgttaatcagcatatgaatacaattaagaatgaaattaacagatagaccaatgtctacatccaagattgttcactggtatacacacaggacagacctgaaaagcaccgtaagcaaaactgatattgaaaccacagaaggaatcttgtatcttacaacctgaacctaaccaggtcaattgccttttaaaacaaaaatgtcaacattctccatagaatttcaatatgactcagaatctcataacatgatattaagaatatctaagaaataatcctaaatcaccaggcacaagaagaactaggaacatgtgaactcatatgagaaaacataatcaatggagataaaacctaaaatgacacagatgttggaattgtttgacaaaaactttaaatttactattctaaaaatgctgaaacaagcaatgagaaacaggcttaaaactcaaaaataaaattttaaaaaaatacaacaaaatatcactggatggtttccaacaaaataaagataatacagaaaacagtcaataaactttaagatagatcaactgaaattatgcaatatgagcaataaagaaaaaaagtggctcagaaacctgtgggacaataacaagaagtctagcattcatgtcattatattaacagaagcagagaagaaagagtgtgctatgtgttgaatgccccctccaaatctcatgtggaaatttaattgccattgtaacagtgttgagtatcaggacctttaagaggtaagtaagatagactaatgtcattaatgtgggagtttattagttatcacaggagtgagttgttgataaaaagaatagtttggcccagtgtcctctctgtcatgtgctttcttgccacatgatgccttccatcatgagatcacccttgttagatgctagcatcatgatcttagacttctcagcttttagaactgtgagccaaataaatatgtctgttctgtattaattatccaatttctggtattcttttatagcagcagaaaattgactaagattataattctgaaaaggtatttgacaaaatagtggctagaaaattctcaaattctgtgaaatacataaacccacagagtcaagaagtacagcaaaccccaaacagaaaaaaaaaaaatcaatctctggatacattaaaatagaactgctggaaattgaagacagggaaaactgtcttgaaagcatccagagaaaatcacacattatctgtagggaaacaccattcaaatgactgtggaattctcatcagaaaccatgaaaacctgaaggaaatggcaccccttttttaaaggtctgagagagcacagagaattctatatcctgtataaaagagacctgctctaaaacatttgctgaaaggaagctctccagacagaagacaaatgatacaacattgccactgatataaacactgaacattaggaatgaaggaagaggaaaaaaagtgataaacctatgagtaaatataagaaacgattattcttttgggttctttaaaacatgtttgacaatttaatgcaaaattacaacattatctgacggggcttccaatgtatgtagatataatatatgacaaaacaataatgcaaaactgggagagtaaaaggacttatatggttgtaagatttctacattctatttaaatgtctaaaatattgattctaagaagagtataaaaagatatgtatattgaacaactttagaacaacctctaaaaacaactatacaaagaaatatcgtcagaagaacaatagataaatttaaattgaatgctaaaaaatgttcaaataacccaaaacaaaacagaaaatgaaaaacaaaggaaaacagaagaaacaaacagaaaacaaaatataaaatgaaagacattaattcaaatgtaacaataattacattaaatgtaaatggcataaatataccaattaaagacagagattatcagaacggattttttttaatgacccaattatacactgttttcaacaaatttacttcaaatataatgaaaaaggtaggtttgaagaaaagtgtacgtgctgcaaactccaattataataaagctggaatggctatattaatattggacacagtagatctcaaagtgaagaaacctgccagtgatacaaaggacatcatataatgttgaagagttaattagccagtaatatataataagtctaaatctgtatgccctaacaacagagcttcaaaatacatgaagacataaaaactgacagaactgaaaggtgaaatggaaaaatctacaattatatttggagatatcaacacccttctctcagtaatagactaatatataattagtaaaaacagaactgaaaaaattagcttcataagagagagcatatgatcattcagaaacttaacagcatttaagagattatattccttaccaaatttttaggttaacatgagtaaggttttttgatatagccaactacagttttcgtaagagtaatggttacttcttcagagataagtcatatcagcagaggcagaaagctgagaatgggggaggtcaaatctttgtaagatgtaaactgaaaagaaagttttatagaaatgaatttctgctgatctcactgtgaaagtgcagttttcatacttttatgaaacaggcttgttactttgtttaaatatttgtgtaatccaaatagttttgacttcagttaagctgaatatttgctttaaatatttgtttttaaaccccatttatcaattctttagaatcttatataaaaggtacgtggtacttgcttaggaaaataatcaaaaatcagaaagtggcccttttaataatgtgaaatgattcaacaaacagaaaaccaatattttcttataaaatcagtaaggtggtaggtaggtagctataaaaatatttagatttttactacatattaatccttaaaagaaatcaggtaatgagtctgaaataagtttaatgtgtccttcttatttctattttagttacacacacacacatatacacacacactcttacagatagcaaaatatgctaaataggaagtaaacatggtactatggtatggattagtaagaaagtcctaccttagatagcattatctgagaaagtgttttttactttaagaaggattcgactaagcagtgtgagtttaagtgtcagggccagtgccagcatgcttcaatgagaacactgagaataagtgaaagttgaattgtcactggtttcttctaagctaagataaggtttggggcacctaaagtgcactcaactgcaaatactgttagaggccactcatcttccaagggaagtatcaggggaacataaaacttcattgagttctggctagaacaacatcttatgaagctaggtagattccatgtttctcttgctgataccaaggaacaaaggtaaacaaaggtgtcttcacttgcagctgccattgctgctgacaaagcttatctgcccacagagtggtgaatagtaattctaaaggaaacttcttgtctgccaagtagaactttgaagttctgtgtcatcccatgcaactaccccacaaagagcaggtgaatcctgaggtgaagggcactactgcccctatggtgccctgaaagttggagatcaagctttgagcccttcaccaactcaggataaaccagcacaattagacctcctataaatatgaaagaattctgataactccagctccagagattcttggacaagttactaaatggcagtagacagagacagcatagctgcaccttctgctgtatacctgaacactctagctaaaagtcagatatatctatccatgcactaagtggttgaggatcaatataaacaaaacacagttgcctgagttctgtttacagagcacatacgaaattgtctttttctctccacattgtttgcatcattcctaacccctgaattgaattcacttgttagctgcactgttgtgcaggtcttctgatcttgctttactgacttaatgacaaccactctctaaagactgacaaaaatcacactgtttcttttcacactgcccaactgaagtgggccaagttctcatcatcttagctctagtactcaaccttgaaatcatccacagagatgtcttccatgcaagatatttctcactgtaagggaagatgatggtaagtcatcatcttcaaatagaaatgatagctccaaagaggaaaaggaaaaacaactgccactccatcacctctctgactttggctttctagggaatcagttcttctgggtaaggttaaaccaacaaacaaacaaacaaaaaaatggaggtggggggtgtactttattctgttttgtttttaaagaaatggccacttttcatagatagagcaatataagtggaaaataaccaggaggttttagtgaaaatggaaaaggaaaaggcaaattttgtgacatactaggtctaacaattgtttaaatctaaagtttggtgccaaatagtgatggttttaattaatagatggatctgaaacacccatatatcatgctaaagatttagtattaaatatgttctactactgaaaataataccaaggtctctaacgacaagataaacacatgctatattgacaaaagtatgcaaaaaaatgctaatcaaactcagctcataggagcaggagctgaattgaatgatcttgttcccccaaaataaacttccaattcactactcaggttattttccaattgtcactgggacaacacaacaaaagcaggggacaaagttaaaacctggccttttcagtcaagcaagtggacaaatactcaagacaataacccacaaacaaggaagatgacagcggaaaatcccccacattcagttcacccctttgtgaccaaaccctgttctgcaggtcttctgatgacttagactttaagacagcaaggtagacatcctggaaataggccaataataatcttcaactaggaagacatactgaaatcactagggaagcttttttcaacataacctttccctccctcagctgggaatcatagattagatttaatttgtataatcacttcagtttgaagtaggtggatgacctgaagaaaattaaggtataatggcaggcttgccatcagcaagtacgcatttacaaacattttgacaagctatatctggaaatatcctgaggatccaagaatcttggttaactttatacaactacgataaattgggcactacaccaaaacatgcaggctatttgactctgcattttcctcaatcaacaacatgtaacggagaggcctaatataccaaatcattatcgaacagcttagggatgactcactttgacaggaagagcaaagtgtttcactctcatctcagtgaacctgttcatactgacataatgccacatggttcctaatacgcaacaatgtacactgttccagcaacatagaggcagctttgagcctttggatccaaattctgtgagtgagctgggctagagttttctgtttcccttccctcattatcatggcaacagagggcaaaggtggcagttaggctttatgcctggactgctggcatacaggtccacacctcttccaaaacaaaatttggacaatagttacacatgaaaatgttgtgttctgcttaggttataaggaaactaaatcatactgcaggcaactctttagttattttctcttttatcctatcttcaccagaaaatttaaagagctctaaaacagtgtttctcaaactgtaggtcacactgtcagtgctcttgaaattaagatagtgggctgtagactttaaaggaaagttaggataagataaaataggataagataaagtaggataggatgggatgggatgagatactagaggatagaatggaaaatgcaacacataggaagggtaaatactgtcttatgaaattttgttttaattatatgactgcatgtagactgtgtcatgatttaaatgcatttatctctgtggattattaggaaaatgtatgaaaaccactgccgtaaagaacatctatcttatggccctaacagcatttctctacagaaacactattggctttgtgactgggcaaatctcttttctaagtaatttcagctattcatggcaggatttaacatcatatctttcccctatccactgaattccagtagtgcttccttttcatcgtgacaaccacacattttaaatgctacctaggaggagttatcaccatctagagataaatatgaatccatagacaaaaggttgctagctcaactcatatctgatgagaagcaagtgtttctaagtatccttttgtatctagagtttgtcctccaggatgaatggaggtcagctttgatagctcttatctgggacgtgtacactgttccagctacttattctgcaaattaagtcttcctttcctagcacccatcaatctaatactaaattcattagcaaaatgaaatgaaaagaacacaacatacattgctattaatggaattccatgcatgtcactccccacacattgtactaaaaatgaactcatctccatttgagtgtctctacacaaatatctgtgtttattaatacacagcatttcagaagtgagattttccttaaagctgtaaagccatttgctttgtcaagctcccttttcagggaaaaacttcaggaattttcactatcaatttatgttgattatttactcttttgtggatctgctattctccaggcaaaatccaataaggagaaatcatgattactgtctaaagaatttattttgtaatattttttcttacttcctgtaacttactttgtgtgacagtaataaacagttcataatgctccatctactatcctcatccataaaatctagtaacagttcaacatttaaaaattttttaatgaagacaaaaatcagctggtgacttcctactggagcacaaaattaacacttgcactggagtgggtgagattttcttattcagagcagaatacagtctttttcttacggatttaaaaatcttagttacctttccctagcttgaaataataggcattttgggctgggcgcagtggctgatgtctgtaatcccagcactttgggaggccaaggcgagcagatcacttgaggtccggagtttgagaccagcctggccaacatggtgaaaccccatttctactaaaaatacaaaaaattagccagggtggtggcacacacctgtaatcctagttactcaggaggctgaggcaggagaatcacttgaaactaggaagcggaagaagttgccatgagccgagattgcaccactgcactccagcctggccaatagagtgagagtctgtctcagaaaaaaaaaaaaagaaagaaaaagaaagtaataataggcattttgaagacttcaggagaaatagctagaattcataaattacccagaagtgataacactgtacttagattttcacacataaattttcctattcctggatagtgtgggaccaaactatatataaccaagttttaaggtgaccaaaaattaaaattcacaaatactctgaatgtctcaactactttccttccagaaacccaagaaaaactgaagtgatttctcacttcccctaatgagcactaatgacaattagagatgaacagctaacctcaaacacactaaagagtgtttttaaaacagaataccacacaggttgtataaggcttatcttcaaacattttcctcaataaaatgttaataaacaaaaaaaattgacatgagggaaaagagaattggaatgaagaatatcctcctttacttttaaatgacaaaattaacaaacatgagagaaaacaccatttttaaaatgaaaagatcactcatatgagagaaggcagatcacatagtggaatgtctaaggggaaatccaggtggattgcccactggagtatacagttaaaaaatatccaaaggaagaaagaaaagacattagatatttggaaaggtaagtaactaagtaaataaataaataagaaaaatgatgacaaatttgcaagggacaccaacaccaaatgcggtttttgttttttgttgttttgtttgtatgccaaagagaatcagtcagctagtaacaagtaaggaaattcaaacagtagttgttctaggtcaaaaacaaaagatatatatgtacacacacaccacacacacacacatctatatttatatacatacacacacacacacacacacacacacacacacttggagactctcatgcctcaaatatattttgaagcatacaaatttagagagtctagatttaaaacagtggcaaatacaaaagtctttcttaattaaaaagctagctgcagataagtcactagcatcaaataggtaccaatcaaaagtaaaactgtgctcagaaaaactaacttgttcttaaaatggccattttcacaaagtactgaaagattggcaatgtggccaaattcccccaaaaaaggggtttagaagcagcctttgtaaccaaaggcaaacagtgggaatatgtataaaacaggaagatacacgaaaagcttttgcccacttggtgaattgagcctctctatctaggcttcttgtggcattaaagaagcatctgcaaatgcagtaactagaatatataatctattcagattttcaaaaggcttttgagaaagtttcatagcaataactgtgcaaataaattttgggtaaacatggaattagaaatacatattttcacaagcacaaaactatgttagatataggaagaaaatgtgaagtggaaatgatgagagaatgcttttataaattttgactgtggaattcaaagtgtcaactgcacatatttatatttcactatccttttcaaatagtaaaatatcaaaccacagcatcacggaatcctaaagagctgggatgactccctacgtactacagattaagaaactgagctacagaggattaataattgcccaaggttaaaacatatagacatcaggaagatttcataacgtttacaaacttgaacaaaaagtaccacatgagctcccctatggggatgtgttgagtattatatttcactagtgataaagaatacaaaactgttcacataaatgtggcctttaaaatatggtccctaaacaagaaccttaaaagaattataatacattccctgaaaacatttcaatgtgttctggttacaaagatattcaaaattctagacatcatcagaagtgctttggatccagtcttagggagatccaacatttaatagctatcagaaaaaaatgcctgcaaaggacatagtgaggatatcagaaaaaaatgcctgcaaaggacatagtgaggaaatgacaaggagcataggaagaaaatcaagaaagcatgacgccatgaaaaataagggaagaaagcattgcaataaggaaggagtggtcagcaagatcaaatgctcagtgaggtcccagtgagagttaatttggagaagtgatggaggtccctgcagcagacaaggtgaattgctgaatggattggtgaagaaatggaaatagagagtagaaacatttctttgaagaaatgtgagtgtccttctacaggtaaaaaaaaaaaaaatacatgataactggtcaatctctgaaagtgtgggtccagcggttttaagaggagattcagtattacccaccatactcgttttttttttttaaccataattcctagtcaaatatgtcataagcccaggaaaaggatctcaaaagaacttagaactatcctccttcaatacaaaaaataaaaggcatctggtttgcagtagggttgtagaccttgcaagacttctgcattttggtttaatcagagattttccagaagtctaaaaataattattcatctttgaaaaataagggtaccatacagctatctagctctgtaatccaaggaaaaatcaattatcttaaaagatgccttatgaggtcattgtttcacatgataaaacaagaacattaggaggacaagtctcggttggaagtctcagatcactctaattgttctaattgatgaatcttcttcaaggaaaaaagtgggctccatttctgtttttaaaaatccagagtatctgtagtagtgcaactaatgacaaccttcccgttgttcttgcctaagaggaaaccctataataagagcttcccaaaatgtcaaataatacttgtctcataacagggcttctttgttcattcaccatgtctcttttgatatgcacagataataaaagttcatataaaactaaaggtaatatagagcagaagccaacactaattctgtataaatatgtctgattaataagaatgctattgttatggttatttcataatgtcacgattgttacaagaacagaggatagaagtactcttactcttactgttttcgttcatcctctgtcatccaaccagtttgcaaatttctgttcaacgggaaaaatgaaggatagatttttgtccattaattactgctgttgcataagttagtctcataaattgtgaaatgagcattaaattcagggaaaaattaggggttttattttaaaattgaactccacttccactacaaaaatgaatacatgctccaggcttactttctaagctcccttttccacatgcacagttgctatattcttctggtgctcatgaacacatgaaagatagaatttagcatgatagcactaaaatctaggtaagagcctagtatattaaacctaaactgtggtttaatacaacaaccatacacaaaattgtatatgggatttggttccaaaaattagaaccccaccctggtgaagtaataagtaaccccacccagatgtgagtatctggtcccttactggaaaggaaataaaaacaagtaataagataacagtctacactcactgcagacagacagcccgatagattttgaaggaaattctaaggctggtagataagtttgtattgtcattattttgcttttctctttaaattcttatctcctagatcctggtattcccccttggggcagcagtataatataaaagcttaacagtcgatcttaaatttagctgacatttttatatccttcaaaacataccttttagattgcacccaagaaggagattattaaatagtagcaggagaccagttagtggaccattttgactgaacaaaaaacagcactgtgccttcttgttgacaaaccaaaaaacatttatatagtcattataatcaatttcataaataaaaggctattaatgactgagaaaaaaagggaaaaactgtatttctcccaagtcccttcatcctctcttaaactccatattagtttaagaaagtggaggaagctatgcatgaaaaatagtgtacttagttgagctggagtctcttgtgaaacaggttctgtcagtcagaaggcaagggtacatttctataattatttaagcctagtttttttgtagtaattagccagagctccattttgctgaagctggcatcactcacagctcacttttttttttcaatttagacttttcattcctttttataaaataaatttacatattttcagtctctcaatccctcctatgttttatttatgaatatagcccttcttgatggtaactctaatgtgaaagaggtagtaattaatgtcccaatctgctaggttaatccctttccacactctctatagagaagtttaaggtaagtaacagtttacagtcaatattaggtttaattatgcttaatgagagttggtgtctctgtttactaactgcatttaggtgtgtggatcctagatgaattttcccttggcctcattctgatttgttaatagtgccactgtgtactgtatactcagtgcttaaatctataaagctgcttctggagaacaaagcaagtaaggcacctgtttcagttgaaacattattaaacaaatgagtgaagttttaccgcaaccacatctttctttgggaaggtgctgttattttataatgctttccaaacaggtccatgtaaaaggctaattgctgcctaaattcaagatcctaggttaagtctatacatattaaaaaatgtttcaaactaagtacaataatcaatggtgagtattttaaaactatggagtattaaacacttctaagactttctgtattaatctttcaatgttttcattccaagtactataattgaaaactactttgacaagtagtttttttgccttgaaaatgtcttttgtcttaaaattatattcaactttgttgctgtgtataagacaaaacttttgtttccttactgaaactataaaaataagcatcaaaacaaacaccttggcctcaaggaaatcagatagtaagccgagggaaatttagtaaacaaatttttaaagaacccctttttcctatatttttgttatggataaattatgtatacaactgaccatgtagtttctttaagtccattcatagtctaatcaatttagtaaacatttattgagtaaatactttgagctaagcacaaaaatgaacatgacatactcccttctctcaagaagcttaccatctagaaaggagccaggcatgagttaaaaactttaataggctgggtgcagaggcttacacctgtaatctcagcactttgggaggccaaggtgggtggatcacctgaggtcgggagttcaaaaccagcctggtcaacatggtgaaaccccgtctctaccaaaaatacaaaaattagccaggtgtggtggagcacgcctgtaattccagctacttgggaacctgaggcatgagaaatgcttgaatccgggaggcagaagttgcaatgagccaagattgggccactgcactccagcctgggcaacagagtgcgagtctgtctcaaaaagcaaacaaacaaacaaaacccaaaaaacactatgctacaatatggtaaatcatactcatgcattaagaagacacagaaaagatcagttgatctgtagaggataaataaggcctctgctggtgaaatagcaagttttttctgggtcatgtgcagactatagcaggctaaatgaacagtaagagcaaaggcagaaagcatggcatccacagtgtatttaaaagacagcaaacagtgaagtgtgtgttgaaagaactatgtgcctgggtggaggaggcggggggtgatgggaagagatatgggagtttggaagttaggggctcaaagagtggactgagaccgaattaagaattttcaatgtcatcttgtgttagcttttatgtaatatgagggataggaaaaggtaaagagataacactactaaacaaggataaggtctgaataaattccttcaaattaaactgaattcttctaagcctactgatctttgaaaaacattttcaaatttcaaacctcccataatgttatttggaagcccttgcatttagatcaaagaatttgtgccatgtggaaaaaaattcctaaaatatgtctatctgaaagatgggatgataacatattaatggaagccagtagaaagagaagctgttaggtttataccccagggaatcctgagaaatctgcaaataattaaatgtactttgtgatataaaaatctgtttataattaatttcagaaattttctgccttttgaaaattctcccttagttaatatatcatgatgttgtttttgttttttaaattttaattggcaactaaaagttgtatatacttatgatatacaacatgctatttttaacgcatgccttactccacatatttttgtagtgagaagacttaaggtatactctcatagcaatttttaagtatagagtatatttttatttacacaatgtacaacatatctcttcaacttattcctcctgtctaagtgaaattttgtaccccttgaccagcagctccccagtctctcatcccagcctctggtaaccaacattatactctccgtttctatgagcttgacttttttagattccacatataagtgagatcatgcagcatttgtctttctgtacctggcttatttcacttaaaaatcctccaggtctatccatgttgtcacaaataacagcattttcttttttaaagatgacttacattgcatcatgtttatgtatattattatctattcctccattgatggtcacatgataacatccattctgacaggtgtgaggtggtactcactgtggttttaatttgcatttctccgatgattagtgatgttgagcattttttcatatacccattaaccatttgtatgtcttcttttgagatacgtctattcaggtcctttgcctatttttcagttgggttatttgttttcttactattgagttgtttgagttccttatatattttggatattaaccccttatcaggtgtacattttgaaaacatattcttccattccttaggttgtgtctttactgttaagtgtttgcttttagaaaaataaaaaaagaggcaaacatttccttaaaatccataaactaatgagttttaaaagaaaagaatgccatccaaactacctaatcagaaaaagactttctacagcttagatcctgtttttatagtattttagaaatgtctaaacacatggcctatgacaaatacttgcctctttttggaacatcaattacttctttgtaacggtatactgatttccttttaaggaataatctctttcccttccagtatagtattggtgagacggtaactccaggttcaaagataaacttggggaaattaggtagataaaaacagagaacatgcaaaaaaataaagaagcacacgaggtgaatgaagaaaaatgtagcaaatttatcagaaagatggaaattgtttaaaaaagttttaatattttctaaatatggtgaacatttctccaatttaaataatcatcagttatttaacactttctatgtgctaggtattcaattcatcaatttattaataatatctccaatcctaattataaccccaagagatagatgttattttttccattttattttatcggtgtgtaggcttaaacccagagaactaaagtaatttgcccaactgttagtgaatagttcagtcaagactgaatctcaaatccagtggaaaataaaatggtatgtccagtataggaagtacaaaacatacaggttaaataaacaaacgttcacatatacctatcaataaagaactccaaaattacatcagtctgttaaaaacaagccactcaaagctctagagttaactaaggtagtaacataattctgaaattaaaatgaaaatatttacataaagttaaatatttttttaaaaaatctttaaaaagtacactcaaacatactgggaaaacatttttcatgggaaacattttaggataatactatctattctataagaaaagagtcaccttcctgaagagttctttgctttcagtgctgttgcctaaattaactttctgttatgaaacacatcacgctagttttaacctagagaataatttgaacaaaaccaagttaaccatttctaaaatacttaaaatacaaagaggtggttgtgtaaccttgaagataattattcagatgtttttaagtattcatctctccatagtattttagatttaattttgtgaatttagcaacaaagaacacagtttagcacaaaatgagaaaacctgttcagaagtgaagaaatcatctaaatattaatagattttattaaatagcagcagaaaacgttatacttggtgttattttcagctatataaatatcttatttttatccaataaaaaacatactaaattcctccatttcaaatactgatgatatcagcaaagtgttcacacatctggatatctttctgtgtttacctaaactgacctttctggtatgtactgtactttctatctcagtatcttcagtgtacatttgcaaaaactacttgaacagtttacattctcccacaccatgctacttcaaatggtcttcaagactttcaaattactgtcagacactgggcattttgtaggcatatacttttgcattcctcctcaagggaaaaaaaaggggggaaagcctagattcaaatggtaataaagtctctttcaccctgataaatacatttaaaaagttgatctcggctggtcgcagtggctcacgcctgtaatctcaacactttgggaggccgaagcgggtggatcacccgaggtcaggagttcaagaccagcctggccaatgtggtgaaaccccatctctactaaaaatacaaaaattagccaggcgtggtggcgggcacctataatcccagctactcaggaggctgaggcacgagaattgcttgaacccaggaggcggaggttgcagtgagccaagatcaccccattgcactccaacctaggtgacacagcgagactctgtctcaaaaaaaaaaaaaagagttgatctcatcctgatgctagagttgtataaaagaagatcttagtgttaactcacaagctattatataaaaatatttgtatatatgtataccaatgtactatgcataaacacatttgaatatagcatgcgtatatatgcaatctatttagtatatttgaatgtatatattatatatagatacatatgcatttacatttccacatttattccaaaaacttagagagaaaatacttaaactgttttcaaaatacaaattctaaatgaaataaaatgttctttaaaaactgtaattaatggctgttatgtcaaactgtgaaccaaaaaggtcaaaccttataatttacagtttgagaggtcatacctcaaattataaccttaaaaaactgattatttgtgagtaatttgacaaatgcatctaatataaactgaatgcatatgaaatatttttgcgagtaaaaagaatgtatgtccaagtggacagctgatggaggaaatagccttttactgaacaaggctgaagtccaacataatgacttggaatgcctttgaataagcatgcaggttggaaggccaaacagtacacacatccaaaagggagcataatgaactatctgatcagaagacaaaaatactccacatatacacccaatgagaaaaaagaaaacacacttcggtcacctcctcttttttcatcattactataccccaattcacgaatgaactctgggctattgataaataatcatcaaaagaaatgatttttataatttaaaaatactagaaattcctataatattccaatctgagattttcaaatgtctatggagatcttctatatcatataaagtaagccaggtttacaaaactgtttacgactcatcttggatgcaaatattaccacacctagcttcatctcaaagccacctgctccttaaaacataatctgaaatactttggcctctccacaatttttaatctacaagtcatccaccattaagaaggcagatcattgaagataattttctccaccgtagactcaattccctaacccaagctagaattgagaaggttagcaaaatagtcatttattaatatatctatgtctctaatatttatttatgtgcttattatatctccctgttagactataagctcaacaaggataaagactaagtctcttttgttcaacagttatctataacatctacaaagtttctggcacagagctagcattccataaatattcgctagaaaatggaaagaaggggttgacagaagaaaggagggaggattgagttagctagtctcctctagtattatttgtgcaattgtggagagaaaaatccctaaaaatgtacactgtatttaatcaatttacccatccaacaattcactgatacatcgatccttgaaaccaaaaagatttaaaatggcttccaaaagtacacaattatacaataaaataaattaaaacagatgaaaaatgaaagggatacaaaatatagttgggaacaggatatttctatacgtatactggtaaagtcagttaaatcacaggaaagagaaggaatttgctttttaatttctccaatttaaccttattgtaactactattataatagtgttataaacactaagcaaatatttactcgttccttatctaaccattactatggcaaatactctataaccaggtaccttatattatgagccaggcaatctattggatgagacaaatattcagttataagaaagtataatatgtatgttataacagtaaaattatagatttttgtaggagagaaaagtaggattctctgaaccaacaaaaatgcttacatggtaactgctgaactatgaacccaatacttcatgtaccaagagatttttctgatacatgtaaatatgcatagttcttgatacacagggaaatatgtggtctcaaatgttaccagtacaaatgagacttgcacatgtaaatcacaatatgataagaaaacacatttgaaaagcattatctttcttgtaagtgaaagcttaaatctgattccacttagcctggtaagtgtttttgtcattccgttgggccagcccacacatactgggctcttgataggtcctgggctcaaccagctggccctttgtgtacttaattctttttttaatactgacgagtgtattagtaacacttccttgatcactggtaaatatacagctaccacacaactaagattttccttaattctgaaattcactaattagttgtgggtacgggttagtattacaaaggtatgttgagtggtactacaatgagtaatgtaattcccaaaaagaactgtgttaatttacttcccacttcattagaggaataaaaaacatcttattatcactaaaggatacagaaagagacctgggtattttagggaatggtagacagggagaaagcatgaatgcagcattgaggcaagaaacacaaatcacctatacatcttggacaatgttcgtgcttcttcttaatactttctgcttgcttcatttattagtgtgtttcatgaaaacattttattcaattaataaacaggtttccaaagaaagcaaataaggtaaatgattcctattttcaaaaacttatcattctactggtacgtaagttatgcattagtcaactctggaagctgcattaatcttttcaagccaataaggtcacaatcaattacttgagatagcagaataaaatacaggcttaaaagaaataatgcagccgggggcggtggctcacgcctgtaatcccagcactttgggaggccgaggcgggcagatcacgaggtcagcagatcgagaccatcctggctaacgcggtgaaacctcgtgtctactaaaaatacaaaaaattagccaggcatggtagtgggcgcctgtagtcccagctacttgggaggctaaggcaggagaatagcaagaacccgggaggtggagcttgcagtgagcccagatcatgccactgcactccagcctgggcaacagagcgagactccgtcaaaaaaaaaaaaaagataatgcaatttccaaaggtgctaccaagtcatttagagagaacatatggtacaattatgagtatcaaaactgggaatttatatattttaagcctaccataaaacatatttactttttttcttttgttggatgagagatattctaacgctgtttattttttcggaagattcagattattcaaagtgtatcagctgattgttatgtgtgttaattcaagcactgagtttaaataatcataactcaactccctaaaactgaagattctgtgtaaggttgggccagtgccctcattcctaggatcaaaccatgtaagaccagacaaaggtctcagagattttggggggttccagtctttctcctttgtccatagacgtgttagggaaaggatgacattttcttatagtacttaccccaaataactaaaatctcaacaaaaaatagataaaagtgcggattgtaaaataggtgttaataattccttaatcaaatcttgtaactaatgaaaaaacactagtttatatgcagaagtaaactgacgaaaggatgaacagaataaacaaggaggaaaagacacatttttaaatatgtaatttagaaactgtcaaaaaaagtgggacatgtcttatttaactggtgtatgagaagaatggatggttttacaggcacataaatgcaggtacagaaaggtaataggagctttgtattacaatggaacttaaactcctctgggcagtgatcagctaagatggaacagagacagttacaatgcaatgattaactagtggacaaagctattatttatggcaggtatgtaagcaattggggcagcaatgttggaggcccctcctcatcaagcagctttgccagtacagactggatgcctggaaccaggaaagacacaaaaacaataaaacctagagccagctaagggagattcaatgcaatccatctccaaattttaaatattactggaaatctacactgaagaatgttttcccttgggattggcatacactgtggttatagaatgttgaccaacacttacctttatttatctcactatgcagagcaatatgcctaaaatacctacttagaaattctcattatattacagaaaaaggagattctaacattagttggcaaaaatttttgttgataggcatgaacatcatgtcattacatgaacagatcattaaagtgagtccatttcattgacagtatatattgtgggtctttttattctgaacaaccaaacaaaacaaacacacaagaggtcattgtgccttccctcatttggttggcagctttatctgtaaaatatgaaaataaaaaactaacatggactacaatcctgcatgtaccattggtacctgcatagtaccatttctgcataagatttaatcaaatattttattcatgttctgaaatcctgatatttgtgaagatggaaaaatacacgggatatttttaactttcaacttcatgatctccagtaaaagtagaaaaataatcatatttcatattatttggttttttgagctagccaaaaaattattagtatacaagaaaaaaggaagttaccactcttcacttgtcttcaggtcttttaatgtaatctcaggaaaaaaacatatttaacaaaaatggaaattatcatgttaaaatctattccactttgaaaagcgatattctttctccctctcagataattttaaatataaacctgaaatgttcataaccaaataaatcgtctagcagataaccaatcaccaaacattaattttacacaatgaggtttctttaatttctctctgtctctctcacagacacacacacacacacacattcacacagacaggttgctaacttgattcttagtatggtaacttaaactcataaccactccaaaatatactttaccttgattttgtgaataaaaataaataatcttatggggcaaggcagggataaaaattagaagtatatttctaactttaatagctaataataaaaagaacagcagaaattactgaaaattatattgctaaaatgtatctgtacatgtggctgtgaaaacttacgtgcaaagagaattctcgttaactaccttcagaaagaggtaatgaaatatgaggtttaagagtacatctttagtacttctgtaccttaaaatattgccgagtattaatttttcatcaagttgtcattttctctgacatttggttttattaatcaaggcatttatcattaatttgtagaaaatatcgtaattaagccaaataaaataaaatccttaaaaggttaaaattagaaagcaggtgaattagaactttgacattaccctgttgacatacaggagctttctggaagtatgagaatgaagtttttttcagtgagtttggtgcctcgatcttggggctggctggtttttaaaaaatgttataaagatttgatttaaacctctctgacagttttgacattcaggtgaaagtactgctgctgcatttggaacaatttgcatatcccactgctaaacggaatgtttgaggtgtgcactggtgtaaagaaattaaaaacaagctatcacacatgcttaagtgtatgtattcacaaaactgatggttggatcgcaccaccccatccccctccaatgtaatctgtgatttactcttctataataaattaccctaccatgttagtctcactggaaaatctaaccatgcatgtaagaagaaaagtaattacagccccctcttgtctaagaagcctccttcaatccctgtgagctctttatacacaatgcagccacacgagtctattgtaaacttcttgcctgaaattctggacttctgactatcagtagccactaaatctcatctgaagagtttcaatgtccccaacaaatacaattttatttcttatagttaattgtaaagctcttcctcaggagaaattgttactgacattctgactttaagccaatatgtctgtttaacaaaagaacacagtttaaaatcatgagttccaaaccagttaaaaaaaaaaaaaaaaaggaggacagagggacataatacataatgaaatagaaggaacaagagttagagcaacacctaattaagctgaaatattcagaaagagtataaaatttctactttttaacttacaatttcatattatttttaggtatacatagaaaaagatatttaatgtgtttaaggacaataaaagaaaaataataaaataaaagaaaagttgaggtagcaaatccaagaccttaaatattataagacaattcaagaagataaagcccattcaggaaaataccactggacattaccttcagccttcagagtcccaaaggcaattcttaacacttctttttatttgtctgtaaaaaaaggaatacttaaaattagaaatctgccaaggaaaacatttgcatttctataatatctttatgacccaggtagctgagtttgtgtatgccaactaatatctatagttttaaaaagaaaactgaaagctaacacattcatatgtgtacaagtactcagtaaaacgtggcccaaatatacaatctaaaccactgcatatacatttttgaggaggcatagcacggtgtttgctatagtatcataagaagttatcttaactcataaggatatttgcatttttatttcatgttttcttttaagaaaagcaaatcccaaattgcttttaacctatttacttgctcattcttattaacagagagttcgcaaagttctatgatgtataatgtactggtcatcactggtgagtttaaaagtatgcaaagataaaacacaagccctattctcaaaatagtaggtaaggttagagatatttgcataaactcagataaaccaaagaaaataaaaagaaaatgggtggaaagaaataaagatgcaaagggtaacatgttcagtacagcttagtacctaaggcattgacattaaaacatggcttaatatttcctgttttagcagaaaggctaatagtagggtcctacccatatttagatgcaaggatgccaaacaaatggatgggttgcttttaaatttctttagtaaagaattgaagctggatgggaacaggcaggatgttgagtttactttaaagccaatttggtgattttgactatagaaagatttaactaaaaacagctctcctattaaaaattgaatttgatgttgtgttcccattagaaaatgatctctctaaatttgctatgaaatctcaatgatgaccttgatgccacatttactaataatctccacagagatttaggcattcaaagtttcaaaagcagttttaataatggaaatgcaatacctaaacatatgcttgattatataatctagtacatctacagtaaaatgcccattaaaattttaaaaatctgaggattttaattgactatatcattaatatgcatgcacagtatttttgcaaacaacaaaccacactagtaaaccaaaacaaacctaaggattggttgcactaatagacaaatagggtccagaaaaggaatctgacactcctgttatatttggggtgcatcagcattattacagttattctgcatcagcaaactaggagggatgctaaaagttagtaactgctaggaggagtgagaccagaacaattaatgatgaagaaataggatgattaggaacagaaaagaaaaaatgttctgatcatagagataaagtggaggacacctttgagaaaattaatttggtaactacatgatatattacaaaagttacttttattaatttattacctgtctcttcctctagaatggaagtaacataagggcaggcactttctctttttcactgtaaccccattttcttgaatagtgcctgccatatactaggatatcaatgaatatgtactcagtgaatgaatgaacagcctaaccaataaaacaggcactaaatctgtatctatttacagatgagaaatttaggcttaaagaaattaaatcatgtacaccaaattaaattgtcattctgcaactacaaacttctacaatgcattctttattcttccattcaatattcattctagcaacaggagaaacagacaataaacaaataaactgttagacttataatgtcatataattagtactatgaagtcagataaaacaagataatgacactgagagttacctggcctgatattttagatagatttggacagggaaacttctcaaaggacgtaagaataataagaaacctgaatcaagtaaagaagacagtcaaaacaaaaaaatctgaaggactggctgggtgaggtggctcacacctgtaatcccagcagttcgggaggccgaggcaggcggatcacctgaggtcagaagttcaagaccagcctgctcaacatggcgaaaccccatctctactaaaatacaaaaaattagccgggcgtggtggcgggcacctgtaatcccagctactcaggaggctgaagcaggagaattgcttgatcctaagaggtggaggttgcagtgagccaagatcgcgccactgcccttcagcctgggtgataagagcaaaactccgcctcaaaaaaaaaaaaaaatctgaaggaccgtttgaattgttttaggattaaataatacatatttccttgcctagtataatggccagcatataccaaacagtgtactcaatactttttattatattgctaatatttttataaattatgtttccccactagattacattgtcaaaggcatttactgttattttccttaaggttccttaaatagtgcctagcaagagctcaataaacacttagagaacaaaaatagaaagacacaattttcagttcattaattagaaaataaacagactacatgaatatgaaaaagtcaccatctttcgtatacctgaatcaatcaaactctgttaaatcaatttcacataatatttcacctttcctaaattaaaaaaaaaagaaaaaggggaaaatatattaaatggctagggccaagaagtcatagataacaaaagaataagaaagaatcagaagaaaattaagttattaacatgaggccactctctttactatttacatgctgtctgactccatcagattaacacatttttccagtgaagggacattgctacacagatatctgattcatttatgtattcctaatgcaagcacaagccttgctatgtaacaaataatcaaaaaaatctttgttgtcctgaaatgaactaaaatgatgtttagtagttttgatgctttaaagctagctcaaaacaataacaacaaaccaggggactgacaaacttaaaaaacaaatttaaatgagaaaacatcaagcattaggtttgagtcctatagcaaagaagcagagaacaaggtaggttctttccaaagagttaaatataagtgacagtgtgatattggcattggaagagatagatcagtagaagaggccaggggaacttaggtatggggtaaatgttacaagtaacatttccatgaacaatgttgagatagctgactgattacctgtggcaaaataaattctgttctctaattcttatcagtactaaaatataaatcaggtcaataaaactcaatataatatataaaacaatcaaggacctctaagaaaatacatatgtataattttctgaactccaatgtgggaaggacttttaaagtacatacacagtggtatataatataagcataaagatttatgatgtttactacttaaaattaaaaattttagcctgggcaacatggtgaaaccctgtctccacaaaaaatacaaaaattagttggacatggtggtgcacaactgtagtcccagctactcaggaggctgaggtgggaggatcacctgagcctggagaggtcaaggctacagtgaaccatgatcctgccactgtactccagtatgggcaagagaacaagacccagtctcaaaaaaaaaaaaaaaaaaagtgtaaggcagaaaacatctttaacaaaattcaaacttaagaggccaataaaaaataaatatttttaaagtgtataatgttcattgggttaagagtctttataaataaataaacatattattctactttttaaaatgagcaaaatacatgaataggcaattcacaatagaattgtgagttctcttctaaaatatggaatgcatttataaatatatttaaacatatataaaatatattttaaactatatataaaatagtaatacttattactatttattattaaataatattattaattctaatacctataagtaataaggtgaaataagaagctaaaatacatatgaaataatattaatctgcaatagcaatgaaagaaatgcaaattaaataaactaaaatattttagaatagtgaactggttagataaattatatgtaataggatattaagtgttcattagacatggcaagtgaaaatatataatacatcattaagcttagaaaacaggttataaaatggtaataatgataacataccataccaatatttaataatttttctctatataatataaatacagactatgcacaacttttggttatgtgcatatgtaagtatagatctgtatgtaccaggtgtgtgtgtgtgtgtgtgcttgtgtgtgcattagaaaaagtatgtatgtgactgtaaaaaacttaaactacattattctttgaatttatcttaagattatgacagtttttttcttcttagaatttgtttccaaattttctgtaataaaaacaaattactttttataaacataaaaagcactaaagaaggcacctagtttatgtttcaggaaagaaaaatttaatttatattattagaattcctgaatgttaagaaagacatttgaaaatgtctatctgtcatttttggtgaaacctttttaactgcatagatttttttagagaaaaaaaaatgtaaggaaggaaaggagaaagggcaggtatcgtgaggaagggaagagaacaacaaagaaagaaaaataggatttataaagataacagcaactactcagaatggtatctattaggttcctagcaaccaaattttaactggtaacatctccaattaaactttcaaagaaaagcacagcctggaatgtagaaaacttaagttggaggttacatttatactgtgaacatacttttacaagagaaaatagatgaaatgttcatcgatttcaatgataggactactgtataaagagagacaaaatacaccatgagaacataagatgctccaaatcagttttggaaataggagtagtataaatttcaattaagtaaaagtttaaagtaagcaaattttaagtagctataaaatcatgctgttcattcccatataagaaattttcaatccatagtccttaacatgtcattcaaaacatatgaccctacaacatatgaactatgacttctggttaattgtttcaatggacattattttgtataaggccttcccaatgagtacaaaatgaatagaaactgttaaagaccattatctattaataattatagcaaacaagtcttcattaaataaaaatttaaacataaggtttaattgtattttattttaaaaggcaaatgaaagccaattgatcatcctgaaagatcataaagaacctgtacagttccatcgtcaagaagacaaggatacattccttcaaagactggaaaagctttaatttcagttcatccataatcatgcatcctaaggtggaggtattcattttggatttggatatattattagagtttttaaaacaccagggaaatctggtaagttctatggtatattctcaaagaacatttcataagattggtctggctaaaccccatactaaagccatctgaaataaagtcaaattccatggagctggagctcgagagcaacaacaaaagaccattcactgactcagttatacttgctcttaggtatttcaggttcgcttctaaatagggggaaaaagtacagaaagattaggtactaaatactgtttttaactctaaaatacaatcaatttttttctttacttgtctgtttaaaagtaacccgagcccttccttttattatgtgaagcttcattctgtttatttttatttcccaagagcagaatgccttaaataaattcttaaaaaccaacacatcaacaaataaataaattaaaactcagtgactataaaaagtacacaatctaacctgcttaattattaacaggtaaacacaatgaacttctaaattatttacttaatccccttcaactaaaaactttaaagtttttgggcttgaaatgtatatcctttctaagggtccataaaacaattatttaaaaatctatttagccattttagtaaaagcaattttaaaataccaaggtaaatatgcacttaaacatttacataagttcataaaaaatagaagactttttttaaatttcacaggtcagtaaaattatttttcttccagctttccctagtcttctgtcagatatttcactccaccatgagcagaaatattcagtactaaattatattagattgatataatagttttgaagtaagcatttatagaatactcttattcctgagtataccataagaaatgtataattatgaaactataaaaatattaataattttgaaacttcaagaaaaaaagaatgaataaattaaaaaatcaccattttctccagataagactggactattttcaccagcgtagctaatcactgaagaaagattgctgcttgatgcaagtaaccattgattacctgaaatgttggttagttaaatgttctggttagctaagggttctagggggaaaggtgtttttgtttttagatcattttaactaaaaatataagatgttctactagatttctctgctttagtaaatagggaattataattttatctttcacttaaaatgaaaaaattatgttgccttagaggatggctcttgaacttttgggaagtcagaagggcctctgggacgatgaaaaaaaaccaagaatcttttttctctagaaaagtgcatatgatcacgaaattttgtatgaaatttccagggatccagagacccaataaaaaccccttgctttctaattttacagaattctaaataactagacataggagattgcactcatacagtaacccccaggacaaaaggagaatgtttgaagttccttcagaagacaggcctaataatgagctattttgttatgatttgtaacctttcttctaaaaggggtgtgtaaaaacaattcttgttaatttagtcttggttaaaggttaaatatgtttcctttaaggacaattgcattacaaggtatttgagctttgaaacaaaatagtgctgctttaaaatcattccacattttagaagtgacagcaattttcttcctatatttttgtaacaatagaaggcagagtcaaagagaaatctatttaattttcatctttacttctaaagattaacagataatagcaaatacatgagcagtccccatattcaggttctgttcaaagcgcttttatttgtatttacttatttaaacctaacaaaaactctaggaggtaggtaatatcatcatacccactttatcaatgtgtaaactaaggaacagagggagtaagtaatttgccaaaggacacccttttactgagcggcagaaccaggatttatgcccccgtcaatctggttgcagagttcggattcctacagaccatgttccatttccagctttaatctttcatgagttcttcaatctttcatgagttgatggtttttcttgtgtgttattatatttaacacaagtctacttcttcactaccatgcaaggaactttcatactggttttcccagaaaaattcatttggtgaattgttcataagatgctgacaaaactggccccacctttgtgcagctggcagttttataccatagtaaatttcccagagtcaatgccaaaaattaaaaaactaaggtaccaccagctagtaagtgtggaattatacaatcaaagctgacctctcatttcctttttggaaatagttttcatgggataaatatgtgaatgattatattccaaaggcaaccaagacaacagtataaatgggcaatattatcataataacttctcaaaggcaggattgtctgctattcctaattcatctgatgagaggtacaccagtcgatacaacttttaatttctagtcctaaatcatttctatgaaataacatgtcaaagtaaaatgcatacttaatgagggccagcaaggggccaaatttgcagtatgactattttcttgaaatatcctcttggcagattgctaccaaagacagcaaccaatttgtaatgcaggatttgcttttagtgtaccaatctttacacattgagtaattccatgaagagaaaaggctgacttaaaaaataaataaaataaataaatcccatccttatggtttgcacagaacaggttttagttataaattcattccatttaatttttattgaattactccctaaaataaatgcaaacaggcaggtaccagtgagacacaagtataaaagggcacaataaagcagaatgttcaaagtcctgtgggtacatgtgcacaacacgcagtttagttacatatgtatacatgtgccttgttagtgtgctgcacccagtaactcgtcattttttaaaaatctttgtccttttctcaaatcctccctccaaagtccaaagtttttttttacattagacctatagacttttatgaagaaattcatttcaatgcagccaagctaggctgggaatgagaacctggtttaatataaaagtatgcctggaataaaatatcatcctttgcctctatctatctctatatcatcctacacaccataataaaacaaatatttggaaataatctagttatttcctataataattcctaatgatttacagtatcaagtcctatatacttggttttcaaattcctccataatctagttccattatatatcctaattccaaataatgcagaaattatactgtctcacccaatgaaataagattttaaataaatatacattgtttcagcaaacaattattgggtttacaatgtgtcatgcaatgttcatgtagctgaaatattttcacatatatatcaggcttttcctatgccctcaacatgtccttcacgatgtccttcctatatagttcagcatgaggtattcgtctctactctgtcaatttctgttaaattcatagtgaactcaaattaattttaactcgagaaatgccagttagagaaattaaagcatgatatataattacaccgaggaaccagatttagaaccggagaagcattgtttctcaaggccgttcttgtcttcatatttcatggtcaaaggtcaatgttgaaaaagctgatgaaagctaatagtaaaactctcaagtctgtacccaagcaaagcacctgatcagtatctgatccaagcaagtcaaaaaaggaaagaagtttgtgtgtaacttttggcttcagactgatatgaaaggcttcatcctttcaattaaggcatagacttttgcctatctgtgatataaaatatattaacagctatagactaggaatttttacatttaagccaaaatacagccaacagagtttaaattttaagtaatttgttaaactaaattaactgaattttcaattataggttttaaatgcttagaaattttccatacgtttgttatagacctcttgttattttctagtttcaaaaatgtgtctttgcataaactcacggttttcaggtttttcacaactgcttcaataagcattacagtaatgctttttaaaacgaaacgatttcctttgctatattattgcccagttgacgttcttatccaaagccagttttgctctctgaatttacttttttctttcttctccccaaaggtgtattgatatgatacacactccttccatttcctggtttaatttgaacatgtcatcctcccacatcataatccagtccatctaccaacaacttatttttcttctgtgagactggcattgatgatggagatcacagggtttaggatgtctcttttcagttattgagcctggcccattcccagtcctaatctttttcttgttaaaaatcaattatacatatatatatttttattatactttaagttttagggtacatgtgcacaatgcgcagtttagttacatatgtatacatgtgccttgttggtgtgctggacccagtaactagtcattttttaaaaatctttgtccttttctcaaatcctccctccaacaacaggagacagctttctttaaatgtccctgctccgtcaccattttctgtgaacaagtctctgctccatcaggatgcacaacaactacccagacccatgtagtgacattccaaataagcttctctttggtcttggagccaaagaaccaagtcctaattcccaatttctcccaaactttcactatctcagtgtattctctcttctcactcttatttctatcaagacacctatgaatggccttctctttcattgaacaacagttgattcagatacaatcaattcaataactctcattttagatcagaaacatacatttatgtttagaaaagactaatcaattgagtacctaagaaaacaaacaaggagctaatttaatgtcctgttcccaagagcactctcacacagacacagaaacaaacatacactcacacatccctacacaccaactgttttactaaaatccagccacactaccttttttgtcttccttcatcaggccatgcttgtttggggcttttgaacacgcttttctacaaggctcttctcccagatcatttcatgatggcttccccttctcatcattcagtcctcaactcaaatggcacgtggttactctttatcccactatccaccctatctgacccaagtcacttttgatcccactgcccagatttcttttcttcacaggatatcactatctgcaactattttacttatttataaactgactcattgtcgattttcctacattaaggaggctatctgtcttattctctgccaaatcacttgcccctaggtgtcatgcctggcacatagtaagcactgatagatctgagtaacgaataaatgaatttacagaaatcgttagccataaatagttttcaagtgcttacaatgtgcaaggtagttcttttttcagttgaatcctaggatgaaaaatgctctgtctctcagcattaatggggcacagtaagtccatttaagagataggtccaagatcaagtggatgaagcttattttgaaaaagttctaaacaaaatatattcctaccacattagacctaaaatgtattaatacataagattaacaacattgttcttctcagctattgtttccttcacacttccccattaaacttttgatatgtcattatgtccttttatgatgtcaaaaacaattgaatggaactgaatgaaagtagttacaacgacacatacccaatttgggacctttactgccaaaatagatgggtcaaaatgatgaaacatggtaagattcggggtgagaccaaaccctgaatctttacatgttcactccctcccacattcatacaatgtacaaatatcctgactatacctagccttgacaagcgttctaatgcctctacaggtgaaaacatccattcatttaaaccaggacctttatctataaagtgccaaataataaatattttagcctttgcaggtcataaagtttctgtttcaactactcaattctgctactatagtctgaaagcagccataagcaataaacatataaacaaatgaccatggctgtactccaataaaactttgtttacagaagggggtgggatgcatttggcaaaccctgatctaacccatcagtgaagcctccaaagtttatatatggggagatttagaaagaaaatttgatcagaaagtgtgttaggaggacttgtgttagaatctgcttttctgtgatacacattttgcttttatatgaaatatatgtgtatgggggggttggaaaagattacgggaaaactgaacccctcaggtcactcttatcactgccgcctaatcctgcaatccatttgagggtgttcttggcattacattttggccttctatagattcatcagctttctctgcatattttatccatcagattatttatatcgtaattctacaattatttttgaaaagctacaacaaacactcggttgaagttcaaaatatacattccccttaaccatgctaattctgcattctatttcaaacattattaattttgtcaggcaagatttgtttataataaactcatttttttcatcgctcatgattcctttgtcttcaagatgtttactgatttctcttacaatgttttatgagaatgttgtcagataccctgtaagccattcaacattacatttacatctattataacaattctttctccctcaaaatcttttaggtcttccaaatttcccaattggaatatacctttatccaaagtataataaatacacctttacctgtttctggttgatagctactttcaaaaggtattttaaacgcattatatgtttttcaaaattgtgttttaacaccaaaacagccacacaattaaactaaaatttagtaaagattctaaatgataacacactgtcataagatacattacatattaattagcaatgttatcattttctattctccatcttatagtttctgtaataaatcctactgccaatcagctttcattatcagcccgtctaatcatgataaccaataaattgtactctatgcttctgacatccaattctgctttatctattctagctatagtgtcaaaatatttttgtagcttcaactagggtttgacaaaaatgctaaaactataaaatctaaatgtaaagtttaccattaaattatatcagcatgtcatacaaccatgatttttaaaataaaatgagaaaatacataaagtaagattttagataacatgataaagtctgcttcagtttgattcagtattcaataaataaaaccacttgagaatcccagtaaaagtaaaccttgagatggttgaaatatccattttaaataacgggaacttttaggtaattgtctctatgaaacaagaatcaggcttttgaggtcataaaatgcttgaccttcccaggtacaatgaatgcagaaagcttactactaagttacacaataggggtaagactgttgaatctatctgaaaaattacattttcaaaagctccacaaagtaactgattcattaaagaaataattggaaagattctttctctttcctcatatgaaggagaaatcacaaaacgttgcaatattttcaaaagaggatgaagtgctcacatttcacttgtgaggtttcaatagctttattacctatgctcttgctgtttgttcagcatgctgaagaaaagtatttccaaaataacataggtttgctaatccttggttcctgataatatcacatgataggataggagctttcaaacacagtcaagctgacagtcacttgctctgtactcagagggaccaatttctccctgtagacatgaatacagcacaaataataaagtgccaaaagttgagtgtaagtgcaaacccttcaacatcactcaggtatcagcaaaaagtacctgtttagctacatgtagaagtcaggtacaacatgttgaaagggagggaagattagaattgaaataatttatctgcctctgctagtttatctgcatcactgaaaagaattaaaccaaccttgccaaaggtaagtcttgtctaggtacaaactgtcttatcaatgccatctcatctattccctatcgtcttctttttttttctttttttgaaagaaactttttatttattgtttttttcacattgcaagtgatggtatccagtttctttttttttttttttttaattatgctttaagttctagggtacatgtgcacaatgtgcaggtttgctacatatgtatacatgtaccatgttggtgtgctgcacccattaactcgtcatttacattaggtatatctcctaatgctacccctccctcccccctcccccaaccccatgacaggccccggggtgtgatgttccccttccggtgtccacgtgttctcattgttcaattccccacctaagagtgagaacatgcggtgtttggttttttgtccttgtgatagtttgctgagaatgatggtttccagcttcatccatgtccctacaaaggacatgaactcatcttttttatggctgcatagtattccatggtgtatatgtgccacattttcttaatccagtctatcattgatggacatttgggttgattccaagtctttgctattgtgaatagtgccgcaataagcatacgtgtgcatgtgtctttacagcagcatgatttataatcctttgggtatatactcagtaatgagatggctgggtcaaatggtatttctagttctagatccttgaggaattgccagactgtcttccacaatggttgaactagtttacagtcccaccaacagtgtaaaagtgttcctatttctccacatcctctccagcacctgttgtttcctgactttttaatgatcgccattctaactggtgtgagatggtgtctcattgtggttttgatttgcatttctctgatggccagtgatgatgagcattttttcatgtctctgttggctgcataaatgtcttcttttgagaagtgtctgttcacatccttcgcccagtttttgatggagttgtttgttttcttcttgtaaatttgtttgagttctttgtagattctggatattagccctttgtcagaagagtagattgtaaaaattttctcccattctgtaggttgcctgttcactctgatggtagtttcttttgctgtgcagaagctctttagtttaattagatcccatttgttaattttggcttttgttgccattgcttttggtgttttagacatgaagtccttgcccatgcctatgtcctgaatggtattgcctaggttttcttctaggatttttatggttttaggtctaacatttaagtctttaatccatcttgaattaatttttgtataaggcgtaaggaagggatccagtttcagctttctacagatggctagccagttttcccagcaccatttattaaatagggaatcctttccctatttcttgtttttgtcaggtttgtcaaatatcagatggttgtagatgtgtggtattatttctgagggctctgttctgttccattgctctatctctctgttttggtagcagcaccatgctgtttggttactgtagccttgtagtatagtttgaagtcagttagtgtgatgcctccagctttgttcttttggcttaagattgtcttggcaatgtgggctcttttttggttccatatgaattttaaactagttttttcccaattctgtgaagaaagtcattggtaacttgagggggatggcattgaatatataaattacgcaggacagtatggccattttcatgatattgattcttcctatccatgagcatggaatgttcttccatttgtttgtgtcctcttttatttcgttgagcagtggtttgtagttgtccttgaagaggtccttcacatcccttgtaagttggattcctaggtattttactctctttgaagcaattgtgaatgggagttcactcatgatctggctttctgtttgtctgttattggtgtataagaatgttcgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctgtatttatttctcctgcctgattgccctggccagaacttccaacactatgttgaataggagtggtgagagagggcatccctgtcttgtgcccgttttcaaagggaatgcttccagtttttgcccattcagtatgatattggctgtgggtttatcataaatagctctcattattttgagatacatcccatcaatacctaatttattgagagtttttagcatgaagggttgttgaattttgtcaaaggccttttctgcatctattgagataatcatgtggtttttgtctttggttctgtttatatgctggattacgtttattgatttgtgtatgttgaaccagccttgcatctcagggatgaagcccacttgatcatggtggataagctttttgatgtgctgctggattcggtttgccagtattttattgaggatttttgcatcgatgttttcatcagggatattggtctaaaattctctttttttgtggtgtctctgccaggctttggtatcaggatgatgctggcctcataaaatgagttagggaggattccctctttttctattgattggaatagtttcaggaggaatggtaccagctcctccttgtacctctggtagaattcggctgtggatccgtctggtcctggactttttttggttggtaggctattaattattgcctcaatttcagagcgtgttattggtctattcacggatttaacttcttcctagtttagtcttgggagagtgtgtgtgttcaggaatttatccatttctgctagattttctagtttatttgcatagaggtgtttatagtattctctgatggtagtttgtatttctgtggaatcgatggtgatatcccctttatcattttttattgcgtctatttgattcttttctcttttcttctttattactcttgctagcagtctaccaattttgttgatcttttcaaaaaaccagctcctggattcattgattttttgaagggttttttgtgtctctatctccttcagttctgctctgatcttagtgatttcttgccttctgctagcttttgaacgcttttgctcttgcttctctagttcttttaattgtgatgttcgggtgtcaattttggatctttcctgctttctcttgtgggcatttggtgctataaatttccctctacacacttctttgaatgtgtcccagagattctagtatgctgtgtctttgttctcattggtttcaaagaacatctttatttctgccttcatttcgttaggtacccagtagtcactcaggagcaggttattcagtttccgtagttgagtggttttgagtgagtttcttaatcccgagttctagtttgattgcactgtggtctgagagaaagtttgttataatttctgttcttttacatttgctgaggagtgctttacttccaactatgtggtcaattttggaataagtgcgatgtggtgctgagaagaatgtatattctgttgatttggggtggagagttctgtagatgtctattaggtctgcttggtgcagagctgagttcaaatcctggatatcctttttaactttctgtctcgttgatctgtctaatgttaacagtggggtgttaaagtctcccattattattatgtgggagtctaagtctctttgtaggtctctaaggacttgctttatgaatctgggtgctcctgtattgggtgcatatatatttaggatagttagctcttctttttgaattgatccctttaccatcatgtaatggccttctttgtctcttttgatctttgttggtttaaagtctgttttatcagagactaggattgcaaccactgcctttttttgttttccatttgctccgtagatcttcctccatccctttattttgagcctatgtgtctatgcacgttcttatctctctttctctcctaaactttttttttgtaataatctctctctccacctaaacttttcaacttctctctctttctgtcttttttactccctccactagacatacccactctctctcacaaataaatactcactgtatgatgctaactgctaacttaaaggagatgtaattttatcactcacatatgattattgatgtgaaagtgcaagagtaaatatgtcagcaactgaaaaattagggcaacatgatccaaatcaagtgctaaatatattaatcatatacatactatgcacttctatagaaaaattattaggctataagcaatcataaagattagcataaataacctaaaaaaactattaaaagtcaagacagggagattcagctgacagagttgtatctctctttcttttcatataaagagatattcagtatgatgttgctaattaagaagtgaaacaagttagaatgaaagctataaagggaaatctctgggtgtcagacaaaaagaaagaactcaaagccagagcagaaggtggggctgaactcttggtgtccccctagagcaccatagccacatatatccatatatttgtccgcagtgtggggaaacagacaaagcctgaagccaatgagaggagtggaacagaagctgagactcccacttattaatggatgtcccctcacgcatctgtaagatttagactagaaaagtctataggtctatagactagcccagagacagagtaataaaactagaaatcttcttagggttctgggggaaaaaaaaacatagaaaatgaaacccagatacgtgccatgagtgccttaggaatcagcattgcattatttgggacagaaaactcaaagctaaaaattaacacaaaaccaattaggttttctgtagaccagtacaggcacagatcatgggtcacagaatagaaggaaatactaaattactttggaaggacccaaggcactcacagagaaaacaactttcttcacctgagaatgagctaaccataggatcaaaaactgatactcttttgttcaattcaacatctacctattaaatgcttttttaggcagataatattttagaccctgaagatatattagtgaataaaacataattcctgtttatactctcatgaggaagacaatgaatacagaaatataaaatataatgttcagtactaacaaatgccacaagagaaaagcagtacaaaagaaaatagaagaagagatggagaaacagatatgtagaaaaaatatttatagaaagactctaagaaggtgatatttgagcagaaccctgaacaaagtaaaggagtgagtcatgaggcagaagatacatcaacaggaaagaatacaattagtaaagatatagaagatttaaattacatcattttgaactaactgatgtgtaaaaacttcaccttttgaaaattgcacattctttccaactaatgtgtaatatttataaaattcaaccattatgatctaaaaagaggtgttaacaaataccaaagaattggtattacaaaataaggtatctgaccacaatggaataaaataagaaattaagatgaaaagatagattaaaaagccctatatatttagaaactaaaaaaacattcataaatattccatgagtcaaagaagaaatcataattgaaatattaattatttaaaatgaacacaataaaggcactacatatcaaaacctgtgggatgcagctaaagtggttcttagtggaaaatttatggctttaaatgcatatattagattttttaaatacgtaaaattaattagtttaggatctcacttagcaagttaaaaaataatagcagaataatccatgtaaaagagaaggaaagaataatgattagaacaaaaattaataacatgaaacaaatgtacaatagagagtatcagcaaaaccaaaatttgttctttaagaagaggtgtaatatattaggctaaaccatattattttttcagtattcaacccatagtaaaacttatgctgatcaaaaaatattaatcattaaatatttaagaaagaaaatagaggcactgattagaaactttaggaataaagagaatgtatctcaaacaatataggaaagatttaaaataacctgagaatatactaaacaactaaatggcaatcaatttacaaactcaaatgaaataagcagtttcctagaaacatgaaatgtaagaaaaatatgtaattagaaatagaaaacctgaataaatttatgatcaataattgagagaaaaaataatctcctgacaagttacatctcacatggtttaacagttgaatcctgccaagcctttaaggaatggataatcgtagcctgatataaactattacagaaagaaaaataaatatccaaacttcactgtcttcttacttttttctcagagcacttagtgtcttagtaatattttcacaacaaacttagcttaaaagtatgtaacagatccattaatttagtacttaggtctaaacaattaaataagtatttttgtcccagcaatacagccatatagaaataataaacacaaatttttaaaaattatttttacttcattcttatatagccatctttaagtttattattattgggatgtgtgtgcctgtcaggcactgcacaacttttcaaaccttgaaatctgattggacactgccacacttatttcctgttctatattgattttcatgcagtacctgctttctatgacagcaaccacaaaaaccaagcttcacgaagacatgacaccatcaggatgaatttactgaaatcccacgctaaaactgaactattcagggtagtgtctgacctggtgtctgacagatgttgaatattgctacgtttctcttaaaaattttaaatagctcatggcccacctgtgagttcactgtggccctacaggagtgccttggaacatagattgcaaaccatggcattatggtgagaaatgacttatgtaaatttttaagtaaacaaaactgcaccgaatgttcatggataagtgtgtgcgcatgtgctgcatgaaatgaaatgaaaatataaaaatagtaaaaatatgaactgaaagcatatgcattaacttcagaagagtggttacctctagggacaaaaggtggaactgtaaacacaagggaacttcaactatttctgcaatgactaatttctgtaaaaacaaaattcaagcaaatatggcaaatgctaatgtttttaaaatatgggtgatgggtatttggtatttattacattaatttcgtgccttattatacttttgaaatagttcataaaagaaaataagaaatgacaagcattgtgagttttcaaaagcttcatataggttgctacttttagcatgccattctaaatcccaggacatctggttactgttagacctgcttttctagtttccatttagaatcattaaactatccattcagagtagtcttaacatttaaagacaaaaaatcatataaagacccctatttcataagcttcaccctaagtcacaaatgctgcttttatttagtaactttgaaaaaatctcagcagaaatcagatataagtgctttctattcacttcttcaaaatatacttattttctcatttcagttattgaaaataataccatagtatgatagaacataacatgtattcatttagtgctatcccaaaccccacaaatctctggtctattgcaagaaatatactcattttcaaacttagtattaatatatttattttgtaggatactaaccaagtcaaaaatgaaactacattgaattaactgatgattatgccagatgtacattaagtttgtgttagtcacgtatgccagttcctcacatccatctcccctttaccttctcccaaccccaacttttcaaaataaaattaatattattcattagaagcaggaaactatagagggaatgtcagcaaatgtcagaagttccatgtatcagtcaaggatcaaagaagttccacaataataacatgagctacaataataaagtaaataagatagcaattatcccaccttactctgaactggccagatcatggcacatgtcttttattatgaggacactgccttatcaaaaagcctaaagagaaaaacatgtagaatggtgagaaatcttatttttttcttttcttttttttattattatgctttaagctccggggtacatgtgtagaacatgcaggtttgttacataggtatacatatgccatggtggcttgctgcacccatcaacctgtcatctacatgaggtatttctcctaatgctatccctcccctagcctcccaccccccaaaaggccctggtgtgtgatgttcccctccctgtgtccatgtgttctcattgttcaaatcccacttatgagtgagaacacgtggtgtctggttttctgttcttgtgttagtttgctgagaatgatggtttccagcttcatccatgtccctgcaaagaacatgaactcatccatttttatggctgcatagtattccatggtgtatatgtgccacattttctttatccagtctatcattgatgggcatttgggttggttccaagtctttgttattgtgaacagtgccacaataaacatacgtgtattttttataacatacacatatgtctttatagtagaatgatttataatcctttgggtatatacccagtaatgggattcctagatcatgtggtatttctagttctagatacaagataaaaacaaacaaccccatcagagagtgggtgaaggatatgaacagacatttctcaaaagaagacatttatgcagccaataaacatggaaaaaaaagctcatcatcactggtcattagagaaatgcaaatcaaaaccacagtaagataccatctcatgccagttagaatggtgatcattaaaaagtcaggaaacaacagatgctgaagaggatgtggagaaataggaacgcttttaccctgttggtgggagtgtaaattagttcaaccattgtggaagacagtgtggcaattcctcaagaatggtgagaaatcttaaacagtaggggcagttgaggcaactagagaggtttaacttggaaaacagaagacaaagagagaaatctccagtatcaccatgtttttggtagagtattatgtggagagataatcaggtagttacaaatcactggaagacaagagcatggatctccaggaatgactgctagatccacagtgtagaacctttggggtgattaaaacgttctggaattagatagtggtgatgtttgtacaaccttgcgaatatgctaaactctattcttgaaatgtgtgaaattttatggtatgtgtaaaacaaatttttaagtgtccattagattcagtaacatgattagtataatccaaataatacatgaaaagtcaaaaagcaaacaataaaaacaatggtttccaaagaaataaagtaatttttcaagacagattgaaatgttaggaaagagttttctttttcttttctttaaaaaaaaaatagtgaagggcttgaacaagttcgaatgttgataacaaaggagtttacaaagagacaaagcatgaagacatagaaaagataaaattaatcaatactgcaaaatttctaaaaaagtagaattagtgttcaaaacataggtaaacagattagtctttttaagtggtaggttaatttctttttacaaaacttcatgaaaagaggataccactagctagtcccacccagctgacccaggatatttacagattttatcttgggatgttaagcatgtacttagatggatgtgtctacttttttttgactagatgataatgtagtctgctggggagaagaaggagcaaaggtagaaagggtaaataatttgttcaacattagccagctagaaatggatagatttcatttttgaaatcatttatttttttaggatatatttaaggtgctcagcatgttttgatataactataaatagtgaaatgattactacagtcaagcaaattaacttctttttattttgaagtgattatatacacacatgaagttgcaaattagtatagataggtcaaatttacccgttacccagctttccacattggtaccatcttacataaccatgtacattatgaaaatgaggaagttgacctagtacaataaaataaacaacaaattttatttggatttcatcaatttgtgcatgcactcattttttgtacgtctttgtatcacatgtattgatataaccaccaaaaaaatcaagatacaaagctgttgtgccatcacaaaagaatttgtgacctctttatatgcctgaccttctgaaacctctgaaaataactagacttaatcataagagtaatgggaaactactgaagagtattaagtgataaagtcacatggcagactgtttcatgtttccctttatctcaaataaaaacaggggtgcataactgaagaaagaagaggcattagaatattatttcaataactaaggtaaagcatgatgatgtagaatagaatagtgactctagatatgcagcagagtggataatttcaaagatgtagattcaaaagaatatggtagttaactgaatgtggtagtcaggaagggatcaagctgagcttacctgacttggatatctgggttggtggtaatatcattcacagagatgtgaatcatgagagaagtggcttggatgtgctaagtttatttctttatatgtcaagttacttatgggttattcaaatgaagatgtctagaaggtaatttggtattggagtctgaggttcaggaagaggatcttgtttaagataaagatgtggctgtaattgatccatatatagtaactgaagccagaaaattgggtaagatcaatcagaatatggtatcatcgaagtcaagagaaaagaatgaggatagtggagggaaaaggaggggaaaggaggggaggttggggaggggaggggagggaaaaggaggggaaaggagaggagaggagagcagaggagaggagaggagcagggaaatgaaaggaggaaggaaagggaagggaaggggaagaggaagggggaaagggagagggagagagaaagggaaagggagagggaaaggaaaggaggaaggaaaggaaaggaggagggaaatgaaaggaaaggaaagggggagggaaatgaaagcaggaaggaaaggaaaggaggagggaaatgaaaggaaaggaaagggggagggaaatgaaagggggagggaaattttcagggcaaaacagaaagaatggaaggacagaaagatggaagagaggaaggaaggaacttgcacaaattgagggcacatgtaaaaacttcaaatatcatgtactcattacatataatttgtgctatataaaacttaatgcaaacttatcagcttttctttctttaaacctactttttttttacttactgtttttccctcgaaaagttctttattcttagaaggaatttcctcaaatatttatattcgataccaatattttttctaaaatgaaacatctctattttcttggcccaagaactgtggtaactagcttgaaaacagtgctatatatttgttatgtcaggaaaaatatagttgaatgaagtgttctctttcccataaagaaaaaagagtttcaagctacatttaagttttctttatactaccacctctccaagcgtttcagctatcattgttttttaactgcctctataatatacaatatgcagccaaatatttggagatattttggtcaaaaggtatgttagcaacaacaatagaaataataaaacaattctcaatgataactgaagctattgcataatttaaataaaatggaaaaagtcagcatcaactttgaattcattggcctttgtcaatttatgttgcaatgttatatttgtttaaggcataactctgaattcatttaatgacctagactatttagtgttggactttcatttaaaaaaaaaatagcaaaataaaatgccatctcgtagagtgctatttaccatatgagatccatctggcaataccatctaatatttaactttgaaggcactgttatcaaatagttgctctaaagtgcttataagaggcaaattcttctggtttttcttctaaggcatattatattactgataattttaggataacagatctgaatgtagatgattttaaatgttgattacagcacattatttaatattttaaatattgactaattcatttttaaattatttgtaaattagcagactatttcttttataaaattaaatattttgtattctcccaccccaccgctagaagtctttaaggggaatattataattttaaaataaaggatttaaagtaacagtttcctgttagttttgtggactgttttcttttccagtaatattttgagtccagttcaccataacttaccaataccctttcacattgcccaacccctagaaacacttaacagatttttctctccataggttggctatattcaaaagaaacattggcctatcaggacctctcagtatccatgttgtggacaagaccaaagagaacttaacactttgaaaacagctactttaccttatgtgcgactcataaacatttaactcagtgttactcagtgatgtgctgccaaaagtaatttaccaggttccaaatgctatatatctggataaactggtctccaaaagcaaacaaacaaaaaacctcattatatatttttaaagaaaaatgtggcccccactactaggtcagcagagaattctgagaatatataacaagtcctatgacttcagtcccaaaagctctggcacaggaaaacactataaacttcttgcaacaagagaataccatcaatactagcagggacatgcttatgtctacatttaggtgaactagcaaaatctttcatctgatatgtactaaattcttgaccattacgaggaaaaaaattatatctgaagtggcatattctaaacctgatgaatttcccacaaatcaaaaaaaaaaaaaaacaaatttctcacaagttaaaaaaaggagcctatatttcaaactattacttgtattgtaggcttctgaacaattttattatactcttcagtgttttccaggtttgttaaaataagcactttaaaaacaggaaaaaataagtttgaaaagataaattctagcactctattcctacaagataaagaagtcagattactcttttatatccaatggaatacatgaattagacttataagatggttggaaacacaccacaccacatttaatacacattccagaataaacttcaaataaaaatatgagctgttgaccaatagcagtattataaatttaaaatggggagctttttttaaatcacatattaaaaaagaagaattgggaaccatgtggaagcaaagagcaatttaatatacatacacaagtttagggattttttttttaaagagaaattgagagtcaggcattaaaggtatacaaaatttgtgtctcaatatattaccaattaaatattgaaatgtaaaattgaaagcacaacacctacactaaaaccaaaaaattaaataaattcttcatataaaatctaacaaaatatgtataagatctattatgaagaaaactacaaaactctgatcaaaggtatcaaaaaagaactaaataaactgagagatattccatgttcatggatagtaagactcaatactatcaaaatattacttcttcccaatttaatttttagattcaacataatcccaatcaaaatcccacaaagttattttgtggatattcacaaactgattctaaagtttatatggagaggcaaaagatctagaataggaaacacaatattgaagaaagagtcagaatgctgacactacccaaccccaaggcttactatatagctacatgagtcaaggtactgtggtatttgcaaacatacaacttagatcaatggaacagaagagagaggccagaaattgacccacataagtacagtcaactgttctttgacaaagaagtaaaggcaatacaatagagcaaaagtcttttcaacaaatagtccaataactgaacatccacatgaaaaaaaatctagacactgacattaaattcacaaaatttaactcaaaataaatcatagacctaaatgtacaatgcaaaactgtaaaacttttagaagataaataggagaacatctagttgatcttgggtttggcaataaggtcttagatataacaccacaagccagatttatgaaagaaataattgacgttagagtttattaaaattaaaacttccatatttgtgaaagacaaatcacagactagaagaaaatatttgctaaacacatttctgatattcgaccgtcatccaaaatacaccaaaaactattaaaactcaagaagaaaaacaacttgattaaaatgtgagcaaaagatctgaacagacatctcaccaaagaaatgcagatgaaaaacctgcatagaaaatgatcaacataatatgccattagagaattgcaaattaaaacaatgagatatcactaaacatctattggaacggctaaaactcaaaatactggcaacaacaattgccgtcaaggatgtggagaaatacaaactctcactcattgctggtgggaatgcaaaatgctatttggcactttcttaaaaaattaaacatacacttaccatatgatctagcaatcatactcattggtatttcattgaaaattatgttccacaaaatcctacacataaatgtttatagcagcccaatttataattgcaaaaaaattggaggcaacgacgatgtctttaagtaggtgaatgcatgaacaaatttctacatccatacaatggaagattattcagcactaaagagaagtgagctattaatcatgaaactatacagggaaaccttaagtgcatactgctaaatgaaataaaccagtctaaacagctatatcccgtatgattccaactatatgacattctggaaatggcaaaactatagataccgtaaaaaagatgccagggtttggaaatggggagggataaacaggtagagtacagaggatttctatggcagtgaaagtaatttgtatgatattatgatggtgggcacataacatcatgcatttgtcaaaatccattaaatgtacacccagtgaaccctaatgtactatagttataataatgcatcaatattggttcattagttgtaacaaatgtaccaccatagttaataatggggaaaagtggggaggagaagggtgaatgggcatacaggaactctactttctccccaggttttttttttgtttgttttttgtttgtttgttttttgtaaacttaaaactgctacaataattaaaggctattgttttagttaaatccatttatttctaaaatttaaaacaggaaacataaaacaactaagtttaagaagctgagtgtggtgatatgagcctataatcccagcaacttgggaggctgaggtgggaaaattgcttgagctcagaagtttaaggttagcctgggaaacatagtgagcacgcccctactaaaaaacaaaacaaaacaaaacaacaacaaaaacactaagtttaacaaatattatgtttgcaagtgtcaggtgacaggcatgtttcatttttttcaatattacctgtctagtgaaatcaaagataaatatgtagctgaattttacttactgtgaacaatcaggtggtttgaatttctcttttcagcagtagaaacaaacgttttggaaatcaatatggatttttaaaaactccaaaaaacattaatttgtatttattaatattatgtcttcattattatattgtcagaacaaaaggattcaggttatttataaaatttttaaaatgtgtgtttttatctaggaatatagtcattttaaaattaatgctactgtcaggatgaaggcagggagctctgatacttttcaaaccacctattctagcacttgagatctctgcagaatttgggcctatactgtcatgagaacttgggatttcaatagatctgctcgtggtttcaatctctagttggtctgcaaagaaattaactctgtgctactgcccaaaactatcccccaactttcaaggtttcctgccttgaaaacatgcacattttgtcctcaaaagagtacagaaaggtacctataaaacctgcactgctatggtctaaaatgaccaaaaagatgccttgcctataatctccgtatatgcaagactgaacattacattacatggaagtattctgtaaccaagagtctttgcctttaaaacaaaatatttttttttccttagaggatagctatttggggacttagcaaaactggacaactctcagaaacaagtttttcttcagtagaacacacactagggtttgtgcctcttttctttgttcagttttatacatgtataaaggaaagacaaaaaacaagagggtctttcatttttccacagttccctttcttgggtgccattcctctcattgttcatagatgaatattcagcgtattcttctcacacagaacacttggccagttttttcttttgctctatattaaagggcataatatttctttaactgaggaagacatatttataatataattttggattaagatttttatttacaaatcatttcatagaaagtttctctaaatttttagcaagagatatttggctataattggtcagatttatctgtcttcatttcaaggatctctatggtactgaaatttctgtttaaagaattttaagtaagttcatttatatacagttcatgcaacttatttacttatcccccttcaacatgccagccatttctttccaaatgttaaacagagttactaaaagttatgtgtgtgtatgagtgtgtgtatgtgtgtgtgtgggcctgtttatgaaggagaagcagagacagagggaaagtgggtagtcattgtattcaagccaacaaccccatttcaaaggagagggattcttaccctgaaaatttgttttcaattcttcacttttaaattaatacatttagaaaaggtttaatagaatgtggctgaacctcaattaaataaaaatttccacctcttgattttatttttttgttgtaattaattggtcattgggtttatctgtatacattttatctgtatttgtatttattgtatgtgtatttgtatttatttgtataaatttatctgtataaatttttaatgaccccaaatatatcatgaaaacatttaaatgttttcctttatctaggaaattatacacatgtttgaaaaccaaacagtttatatctgactagatgtttagttgctattactattttgaacttggaatggacattattttaaaataagttatttgtaaagaactgagatttactgcatcctaccttatgtcaggtactcatgtcttgtctcaaatcatgttctgaacatctctttgcattaatataattaatcccagtttacagaagacaaaattaagaaccaaagagagagagtaggtaacaatcaaggtgattcaggacttaactgacaaatctatcaacttctctctacctctactgctgccttcttagttgaggtcactgtgatttccatcctggaccactgaaccactgtattcaccttctaactggattcctcactaactgccttgataattccaatccattctgcaccagaagcaggtttattatgggactgtgtcatacttccctggcttcccatttcatttagggcaaaattctatgaggtctgtctctccatttctctttaacttcatttcaatctactctctttttagctcacagcattctacccacgttaatgtcctttttgttcctagacattgccaaatgttttttttttcttttttcttttttgttattgctttctgatctactataaaatgcttttcttctatggaggcttcaaacatcctattccttgccctggatttctgcatcactggatccttcttatcatttgagtctcaacagaaacaccacctcttaaaatggtcaccctctgattcttgcccagacctttgttagttactgtcagaaaaaaataacttctttatgtacaatgaactagtttgcttgtttgtttgtttgtttatcatctattcctccactccctctccattccccctccatagtaggacaggaatattctattttatttactaccctcatatagtttctagcacttcgggtactgaataaatatttgctggatgaatgaagtctttgttttctccactctaaaatgtgctcatattaattaaatatagtcataaaatttatccagttggatatatatatatatatatataaccatttgtccttagtaaagcttgaaatatgtgaaatcatggcacttcttttttttcccctgaatattatttcttggtcagaacattatcttcctccttggcaaaaatatattgtgcctttatgttttagcaaagtatctcaaagaatcatataaccgtagcaaaatggagctgaagggcaccttagagcccacctacccctatcatgcacctggcacctgagcctcttctacagcatcaagtggccactgagacataccaggctggaggaactaagtaccttttaaggcaacacatctaattcttagtgttttaatagcctaatatttgtttagcgttttggtactaatacattccaagtttctgctgtctactgacttttcactatttgttcccttagatattcatttgaaatctttttagtttaacctgatttagctgtttctttttattaaaaaaaactcgaggtaacttcttttctgatttaatgtagcaataccagaaaatcccttttgagtttagtctttcagattgttagtaaacttaatgatgagaataggagtatttgttatttttctgcaaaatagttctatctatatttctttctacttctcattgtgcaaagtctgttctttcattaagacactgtaattacattatagtcagtatgttttaagtaaaattctgagattcctttactttttcttgagtcgtctaaaaaaatatgttttgataaaatcaagtgaaatatcctttatgacttcaacttcttctggaaatacttgtcctctatatattttatcacttaatttgccaattatgtctactccttttgaataaggaggaaataccattttctgaaataaaaaaaagagaaagagaaaaaacagaaattagagaatattttaaacaatgtgttttatgtgttttttaaatgtcatcaaactcattcttcaggactttactcataataagctgttcaatgaatacttatttaacaatcgctctgtgttctattacttatccctttttctcacttatatgctcaactttttattctttataagttctttcttcttagcatataaacatgcatgattatctcccatcaaatatacataaaaataagcatacaatagaaaagaaagaaaatccttttttgaagatttgctctgttaccactttcttctctattatttctagtcaaatctttgaagagagtttttacttctttacccctcatcctgtttacagtccactgaaaactgacttctgcccttataacataatttaattattcccaccaagatcgcaaatcacaagacggtcaaatccaattgaatatattttgacttgaccttactttatatctcagatgttttgacattcttgacaactcctttctttcaaaaacactgtcctctcactggcttcatactttttggctcttctcctgcccttttctcttcctttgcaggctcttctgcttcttcttgaccctatatatgggttcttcttctgctttccaacagtctcttgctctcacatcatccttttccttgagtgattatattcacatcttcaacttcaaacatcacctttattttgatgactctcaagtctgtagctcctgcccttatcacagctcttctatatctctccagttgtatacatactgctgactatggaatatctttagctgaatgccccatagatacttcaacttatgacatatcaaactgcagtttttaaatcttcactccaaaatgatatttttctgttattcccgtctcttttaatggcactgtcatccaccaaggggatttggaagaaccttgagttcaagccctttcctttgtttccctacagttgccctgtaatctgtatgctgagggttaaaggcagggctaggagaaaatatgtttctattagatgagatgtatcatcaatattcaactggtattagaaaaataaccataaaaatgctcctgataataagcagctaaaacataaagaacatctttttgtaagtaatcgtgaacaatgtttgagagatagaaggatcattcaataatctaaaaattctaaacataattttacatatgaaaaaacagtcctagagaggaaagataaatgtctaatataaaagtaacttaatgaaaaagtgtggactaaaatctagatccacttctgtaagttttgtatttccttggtattagaagtaacttactcctccctgtccctgatctatgtaatggcaaacattttttcttggtaggagataaatcaggtcattacaagcatagaaagcaagatttaaacaaagtatatctgtaatacaaatttctgctagtagaatgtacctacattttaaaaagtgagagttctttctcagctgctttctaagtaatttacactatttatgctcccaccaatcctgtatatttcctatatgctcacaaaccatgaatattatctaatttgtaaaaccttgtcaatctgataaggaaacttagtatgtgtgtatgtaagattgaatatttttatacgttattggacacatatttttatgaattatgtttttagatcctttgaacattatctactgggttatttatatttcttgttcttgaattttcttctgtttcttggataatgttttcttctggaatgtattcttcaaatttttttaatgctatatatttttgttctgtattatttttacagttatgtcatctcatttgaatgtacaatcactatatagcccttaatctatatggttaaaaattgtgtgagtaaaaactctttgccactctccccaccccatctgaattcagattgacttatcctgtaagcttttattccaggactaaaattttgctttaacaaagccaataagcccaggtgcttagtttctcctacatacctattctcccaacaatgctttctcatcccctttcaggcagtgagaataaatccagtaaaataattacgttctatcacattattagtccagagctggcaagtagaggttacatatgtgcatgttcatgtgcctctacaccagcttcctcttcctgagatgactaggtatttactgtgatttgaatgtatccctcaaagttcatgtgttggaaactcaatctccaatgcaacagtgttgaaaggtgggacttttgagagatgattaggtcatgagggctccacactcttgaatggattaatgttatcacagcagtagctttgttataaaagcaagtttggctctttcttgctccccatttgatgagctctttcaccatgtgatgccttctaccacgttgggatacagaaaaaaggccctcactagatgcccaacacccttttatagggcttcacagcctcgagaacagtgagcaataaatttttctttatacattacccagtctgtggtattctgttatggcaacacaaaataaactaagacagtattatgtattttttcttttgttttacattttactaagtgccgacttattcgaaaaggtaattagctttggttaattatcaaagttttgtctttcctttcctacttttgtcccactaagcaaaaaacaaaacaatgagcattgacctttacctttctctggtaagggagtatggaaggttttctactactttgtaaaaatactgctacagatggtacttctggacccatgtggaacctgggggtccttgctgtcctgaagagaagtacacaggcctggctggcttttccacttactgattgtagaatctcaggcattgagcaaatataggcagtagccagggagcagttacatcaggccttaggtgaaacccactgctgtgctggcttcaggtctgacccaacacagtcatagtggtgatggccacaagggagcttgggttactccaccctgcaaaggagcttgggtcactctgagctttgcatagcttagagcagagaaagaaggactctgtattcttgggagaaaacaaggaaagagaacaagagtctctgcctggtaatcaagagaattctcccagatcttagccaagaccataaagcttatacctctataaatcagcaagaaccacagtgttattaggcttgggatgcccctaaagtagatatttcttagatcacaacattcaggtcttttcaaatatctggaacatctttccaagaagggcggctacaaataaacccagaaggtgaagactacaataaacacataactcttcaatgcctggacaaacatctataagcatcaacaccatccagggaaatgacatgacatccccgtatgaactaaataaggcaccagggaccaatgctggagaagcagagatatgtgtgacctttcagacagagaattcaaaatacctgtgttgaggaaactcaattaatttcaagataacacagagaaggaattcagaattttatcagataaatttaacaaagagaataaagtaattaaaaagaggcaggcagaaattctggagctttaacatacaattggcctactaaagaatgtctcagagtcctttaacagcagaatggatcaagcggaagaaagaatcagtgagcttgaagacaggctatttgaaaatatacaatcagatgagacaaaagaaaaaagaataaaaaacaatgaagcacacctacaggatctaaaaaatagcttcaaacaggaaacctgattattggccttaaagaggaggaagagaaagagacaggggtagaaagtttatccgaaggaataataacagagaacttcccaaccctagagaaatatatcaatattccaagtacgagaaggttatagaatgccaagcagatttaacccaaagaagactacctcagggcatttaataatcaaactcccaaagatcaaggataaaaaaggatcctaaaagcaccaaaagaaatgtaacaaataacatacaatggatctccaacacatctggcagcagacttttcactggaaactttataggccagcagagagtggcaggtaatatttaaagtactgaaggaaaaaatcttttaccctagaatagcatatctggtgaaaatatccttcaaacatgaaggagaaatgaagactttcccagacaaacaaaagctgagggatttcatcaacaccagacctgttctacaagaaatgctaaagggagtacttcaatcaaataaaaaaggatgttaatgagcaataaaaaaatcatctaacagtacaaaactcactggtaatagtaaatacacagaacaacacagaacattttaatactgtaactgcagtgtataaactgctatctcttaagtacaaagagtaaatgatgaaccgataaaaaaaataaatacaactttttgagacatagtacagtaagatacaagtacaaataataaaaagtttaaaagctagtggacaaggttaatgtgtagagtttttcttagttttctatttgcctgtttgtttgttcatgcaaacagtgttaagttgttgtcaccttaaaataattgcttataagatagtagatgcaagctttgtggtaacttaaactttaaaaaaatacaatggatacacaaaaagtaaaaagcaagaaattaatcatatcaccagagaaaatcatcttcacgaaaagaaaagaggaagaaaggaaagaaggaagagaagaccacaaaacaaccaggaaacaaaaaacaaaatggcgggagtaagttcttacttatcaagaatacattgaatgtaaatgaactaaactctccaatcaaaagacacaaagtggatgaatgaacaaacaaacaaaaaagatccaatgatctgttgcctataagaacacacaatacctataaagacacatacagactgaaaataaaaggatgggaaaagatattccatgccaatggaaactaaaaaagagcaggagttgctacacttagaccaggcaaaatagattccaaggatgaaaactataagaagagacaaagaaggtcaccacataatgataaaggggttgattgagcacaaggatataacaattgtaatataggtacccaacactagagtatccagatttacaaagcaaacatttttatagctaaagatagagatagaccccaatactataatagttggagactttaacaccccactttcagcattggacagatcttccagacagaaaatccataaagaaacttcagatttaatctgtgctatagaccaaatggatctaatagatatttacagaacatttcatccaacagctgcagaataaacattcttttcctcagcacatagttcatactcaaggatagaccatacgtcgggtcacaaaacaagtcttaagacattcaaaaaattgaaatattatcaagcaccttttctgaccacaatggaataaagccagaaatgaataccaagaggaattctggaaactatacaaacacatggaaattaaacaatatgttccagaatgacaagtggtaaatgagtaaattaagaaggaaacttaaagatttattggaacaaatgatagtaaaaacacaacatgccaaaatctatgggatacagcaaaagcagtactaagagggaagtttatagctttaagtacttacatgaaaaaatagaaaaacttcaaataaacaacccagtgatgcatattaaagaacttcaaaagcaagagcaaatcaaacacaaaattagtggaagaaaataaataataaagattagagataaatgagtagaaaatgaagaaaataatacaaaagatcgctaaacaaaaagttgttttttaaaaaaaggtaaacaaaattgacaaacttttagacccaaataagtaaaatcagagatgtaaaaggagacatcacaactgataccgcagaatttaaaggatcgttagtggctgctataaatagctatatagaaagaaatagaaaaatttggaagaaatggataaattgctagacacatgcaagctactaaaattgaaccaggaacatatccaaaacctgagcagaccaataacaagtaatgagatcaaaaccataataggaagtctcttagcaaataaaagcccactacctgatggcttccctgctgaattttaccaaacctttaaagaacacccaatcctactcaaatactctgaaaaacagaggaggaggaaatacattctaactcattctatatttgacagtattaccctaatgttcaaatcagaaaaaggcacaacaaagacacatttcggatcaaatggctttgatccaaaagacagtaacaaatgctggcaaggacatggagaaaagggaacccttgtacactattggtggaaatgtatattagtacaaccactatggagaacagtttggaagttcctcaaaaaactaaaaacatctaccataagatccagcaatccctatatgtgtgtgtgtgtgtgtgtgtgtgtacactaaaaagaaaggaaatgagtatattgaagatatatctgcactcctatgtttattgcagtgatatttataatagcaacctaagtatccatcaacagatggataaagaaaatgcagtatttaaacagaatgcagtactattcagccataaacagaatgagatcctgtcatttaaaacaacattgataaactggaaattattaggttaagtgaaataagctaggcacagaaagacaaacttgatatgtttgaacttatttgtggaagctaaaattaaaataattgaaccatagagataaagagaaggatggctatcagaggttgggaaagatagttgtttggggtagggggagaagtggggatggttaatgggttaaaaatagttagaaagattaaataatacctagtatttgctagcacaatggaatggctatagtcaaaaataatttaattgtacattttaaaaaaactaaaagtgtacaattggattgtttgtactacaaaggataaatgcttgaagtggtggatactcgatactccatttactcttatgtgattattactcattgcatgcctctatcaaaatacctcatgtaccccataaatatatatacctactaagtatccacaaaaattaaaaataaaaataataaataaatatttttattgagtttttttctgtgaattatacaatctcctaggctcttagtctgctaggagatgtagcgatgaaccaaaaagtgctcttatggatcttagggtatactagttaacgtagaagggttgctctaaatttcaaagtgtctgtttatcaaagcatctatgattatcggtgtcttttttgttttttgtttccttattgtttgtttttcatttgagtacttttctcattaaaacactagcttaagcaacatgtcaaggagaaagacaagacaatacaaaagacaacaaaacaagctcttcactgcattgcctcacccataaacttataaagtggctgtcactttataaaaggctaagaaaagctatttcgctgaaaaccttattgactgttttaatgacatcacatttgtagttctgttatgaggaaataaatcatggaaggagtgaggagaagtttagcaatagttgtggtcttacttgctgtgtggtgggtctcagatgccctatatgctatgcaagtagaaatcattgcttatcattttaatgtaagtttgattggaatgtgactaattacataatagttatacaaaaaaacatattctagatcagctaattaagcaatataaaatatgttttgtgcacaaataaagaaacatattgtttcattcctataagatacataaataaagttattttggactgataaatatttttttcaactttcaaaagttccagggtacatgtgcaggatgtgcaagtttgttacgtgggtaaatgtgtgccatggtggtttgctgcacagatcaacccatcacctaggtattaaacccagcatccattaactattcttcctgatgctctcacttcccccaacccaaacccctgagaggccccagtatgtgttgtccccctccccatgtgtccatgtgttctcattgttcagctcccacttataagtgagaatatgtgttgtttggttctctgttcctctatcagtttgctgaggataatggcttccagctccatccatgtccctgaaaaggacatgatctcatttctttttatggctgcatagtattccatgatatatatttactacattttctttatccagtttatcactgatgggcttttgggttgattccatgtctctgttattgtgaatactgctgcaattggcataaacgtgcatgtatctttataataaaatgatttatattcctttgggtatatacccagtaatgggattgctgggtcaaatggtatttctgcctctagatctctgaagaatctccacactgtcttccacaatggttgaactaatttacactccccccaacagtgcaaaagcattcctttttctccgcaacctcaccagcatctgttgtttctggactgtttaataattgccattctgactggcatgagatggtatctcactgtggttctgatttgcatttctctaatgatcattgatgttgagcttttttcacgtttgttggctgcataaatgtcttccttgagaagtgtctgttcatgtgctctgcccactttttaatgggattgtttgttttttcttgtaaatttgtttaagttccttgtagactctggatattagacctttgtcagatgggtagaatgcaaaaattttctctcattctgtaggttgtctgttcactctgatgatagtttcttttgctgagcagaagctctttagtttaattagatcccatttgtcattttgcttttgttgcaattgcttttagcgtttttgtcatgaaatccttccccatggctacatcctgactggtattgtcagattttcttctagggtttttatagtttggggttttacatttaagtccttaatccatcttgggttaatttttgtataaggtgtaaagaaggggttcagtttcaattttctgcatatggctagccagttctcccagtaccatttattagagggaatcctttccccattgcttgtttttgtcaggtttgtcgaagatcagatggttgtaggcatgtggtctcatttctgagttctctattctgttccatgggtctatgtgtctgtttttgtaccagtgccatgctgttttggttactgtagccttgtagtgtagtttgaagtccagtagtatgatgcctgcagctttgttatttttgcttaggattgtctttgctttttgggtgctttttgggttccatatgaattttaaaattcaacatcccttcacgttaaaaactctcaataaactaggtattgaaagaacatacctcaaaatagtaagagccatatatgacaaacccacagccaatatcatacagaatggacaaaagctgggagcattcccctttaaaaccagcacaagacaaggatgccctctctcaccactcctactcaacatagtattggaagttctggccagggcaatcaagcaagagaaagaaataaacatattcaaatagggagagaggaagttaaattatctttgtttgcagataacaggatcctatgtctagaaaagcacatcatctcagcccaaaaccttcttaagctgataagcaacttcagcagtctcaggatacataatcaatgtgcaaaagtcgctagcgttcctatacaccaacaacaggcaagcagaaagccaaatcatgaatgaactcccattcacaactgctacaaaaacaatgagatacctaggaatacagctgacaagggaagtgaaggacctcttcaaggacagctacaaaccactcctcatggaaaactagaaaggacacaaacaaaaggaaaaacattccatgttcatggatagaaagaattcatatcacaaaaatgaccatagtgcccaaagtaatttatagattcaatgctatttccattaaactatcattggtaaatctttttaagaaaaatttatagtataaattaatagtttaaagatggcaatttttatttagatagatcaaaaaaaatgctgtcacagagagatgtgaattgaactacctattgaggaagtatgttatcattaatgctttctcacaatttctttcatattaaggattttaaaaagttaaattatatacaatttcatttgtatcatcactatagtttctttatcaaatatgtgttgagtaaatgctgtgtttcagacattgtgctggaattggagatataatggtaatgaaatgaaggatgcctcatggatcttacagtctaattgaggtagaaatacaaatacacatacatatatacaacacatatgcacatactaaataatcacacaaatatatgaatatttactttcagataatgttactaaattgtggttatttctgtgctggcaagaaacacccagtttcttgaaatttacttttcaatgacttcttccaaatttaatcctgtttatgcctaaggatttttgttgttgtttttttaatctcttaaagttgcacattgaatcactgctgatttgtatgcatgaagttaccaggacttctaattttgtaccaagtttatatgtgctaatattttccattagtaaagaagactgaaagatgcctcagttgcctggaatttatgccaccaaggaaaaacagtgattagtgtgtttaaagagttagatcattgggttaatcatgctttgccatagtatcattgctatcctttaaataaaaaaaaaaggtttagttagaaaattttttaacaagataaaattaaccacagactataacgaaaagtaatttcagcaggattatttattctcccaaagttgaaaaaacaacaaaccaaaaaaggtgtatatgtgacatctacttaattttttaaatatgattatttccatcttttgttctttgatctccacatgagcagagacacataaagtggcaatggggccaagggtgctagatggcttggcattcattaactatggcaattagcaccatttagattgatatgttcccaagatgaaagtaagaattggactagacaaaaaaaatgatgatcgcatttgtgaaagtggaacaacactgaccaacaagaaacaaagaaacagagctcaccttaaaagacttggaatatttgaaaaattgattatgagataagataatttcaacataactacaattccttgaagagttattaatgcttcggtagcattaaagtaaaatgaaaagacaccagggcagtctgctttaatagcttgctggcttgaaccctaatacataatgttcttgtaatagtttatgggtgactgcagtaaattggtagtgaatgtttttcatttttttggctcttcatatcagatctgctcttggagaacattttgttctgagaatattatgaaggcagttcatctactttagaagttgcttgacaattttaatacagtgttaacttttctcccctccagattgtgtgatttttttgtcctttgtacccgacatcaatttatggtttgaaattcagcaatttgctcagttatactttacctaccctgactaaatattttaagtgctgccacaagaaaagaaaaaatctaatttttcccaatgttgttgttacccctctctgtttatatagcagtttaaatctgcccttcatcttgacagagaaaaaattttagatggattaattttgaacctaaataatttgttgacaaataatttatgatcatattcaggggttgttttgaggtaaaaagaaaactgcattgaatgaattataccaagtgaaatcatggtattttaaacaaaatgaggtttataattacctgggatttagtgaacaaaagtatgtgatgcagggctccctgaagaatttagtgcatgtcctatgttttagtgcttcaagcagcaaatattatgtatatacaataaaaaaggaagttgcagacttaatacatactgaaatggtctcaatgttaacattagactcatgaaaaattagcggacatctaagtactttattcgttcttttagtctttgctgtacctaggaacatttgtttcatataaaagttatattacaaaattaatggactgagggtggaaagagaatttgaaagaatgtgaaataaagtctggatatatactgaatgcaggtggaagatgtctgaggaacattaatgacaataaagagaagtctcttcctaagttacagacatccaaaaccaaaataagagccaatgtggttacataaaactgcaaagaaaatcttggttggacagagaactccgaagaggtagtaaaaggaaaaactgagcaaactagggaagacaaatgcagagaaaagttagaaataattagagaagaaataaaatgcttccacaaaaataagaacaacaaaaattcaggagataaatgcagaacagtccagctaacagaaaaggatttttgaactgtgtatgcaagaagcagacagcatgattggaaatgaagtatttgctctttcctctaagagtggaagaacaagacattcctgggcagcacaactctgcgtaggattagttgcacttcctcaaatgtattttcaagcaaaaagctgaaacccaaatgtcttgagccaccagaagtacccaggctcttatgtaatacaggctttagtgttttattgcttattcaaaaagacaaattatattttaaaattgatatatgtgtgagcatggttatgctacacctataaattaccaaacgtaataccaatagcagccaaccaacagtttagcctcagtattttcacaacagttcaaaatgttttgttaaatcccatgaaagtagcttcagtgacaaaggtttcagatctttgcaaatgataattaattcagaggcatataatgggaaacactacagtcaggtctagacaggtttagataaactaatggcccaactagttatggcagctacagtttttaacttcaagtaaaggaatcttaaagcagttcaaggaagaaacattttctttcttttcctttttaaaacatttaattgtcttttttgaggatgataaaagataaaatctagagactttattgtactgtactcattatagtctctcccctgcctcatatgtaaatctagtttgcttcttcatgtttattcatctctactttaaataaacatattgtacatatactctatacacacacacatataatacctattctcttccatttatgcttacattgtaagtcttttaaacatttattgaaacatttttgttggattgactctacattgaatagctttattataaatgaaagacttcccttctattaaacagaaatttcttttaataccactatgaggcagaacattattgctatggtataactttgtacgatcgaatgtcctactggttagatctgtgagttaatttaaatttttacaggctgttagatggagtaaaaggcaggatacagccatggactgtaggttttttatcctttagttacttctttaacttttaatttacattaatggacaagtttcatctagtctaattttatgtattacttgagtctttcctcatatttttggaatgccatttttaatttagagtgttttctaagttaaagtcttaattgttcttttcctgaataatagcttgcatgaatacaaagaactttatgtttgaattttggatttagtcagcttgatttttcactgaaatcaggcctaaacatatgaagttcagcagcaaaaacaaaagcaagcttacttactgaaaacgcattgtctttctataacaagcttactgtaaagactggggtagtatgtatatttccatagatacatatatatagtatctgtgtgtacacatatacacgtaaagttaagaaagtttgtaaaaaaactacacatacgcaacattagaaatactgttaaatatttatgtgtaatgaagctgttcttttcaatgatgtcctacattgtaaaggttttatttaaaaatttttatataatgaatgcaaacttgagtcactgttcaaacatgaatattttctcaaatgaacatatttgcatgtgttatgctatataaactgagttctgtaaaaaggatcctttttcttctgctaccaagaaattctacttttataattcaaacaatctactctctcccacactcaaaataagtcatcattacttaaaatatgtgtagtgtaacaatggaaatgtttgtatatttgtcaaactaaatattatgttaaaatattttatacatttccactgagaatgctcttcttagttaaaaataaataaaatttaaaaaaatttgaatggagacattttgaaagtggctattccaggtaggataaatatttaatttactccatagcataataattttaggaatcacttcattttgaaaaattattctgaatactagcaacattttggcctttaagacactttattaacagttttgaagaaaaagttgagacatttgttcaaaagatttgaatctattcacataatagttcagacaatctccatttttaaattcctaaattttgaaaatttaggatacgtaaaaaagataaattaaggaatgatggtttaccacatggaaaaagtattatttataaaaattttaaaagtataatttatttacaaaatttagttatttaataacatatataaaaagactcaagttgatattctaaaacatacttttaaacaaaaggaactgtctattacataatgaaaatttatgcaaccaaaatgagtattattctttgcaaagtagttgccttgggagacagttctttaaacagtatagctattgctctaaatattgcacaatgtgcgaacaatgttgaccttcagtgccaacaacatatcattttgaatattttcactgacaactgctctttaattttcgttgctttttagaaatagtcaagagtaacttagagccatgtttacctgacagagccaagtttattgccatagcaaaacctggcctgtatagttatagaaatcccttatcttcatttcttcacctccaactctacaatctactccaatttgttgtcctttgcctcctctactcccttcaaactaatctttctaaggctgtaactatctgttttcagtcaccaaatgggcaatcatttaaaaaatattatggaaatgataaaagccatttatcttgggtggttttgtgcagtttctaaaggcagtttcaaaagaggtaagtaactttgatagtgatagaatcattggaataaatatattaccttcactatgacaaggatatttggatgtttaacttttggatatctgatatgtattttccattcagtgcagtatttattgagcacctatattatgcaaaacactgtgcgagatgctgagacaaaatatgaagatgaagaaacaatgagaccagccctgactcatgaacaaatagtgaggtaaggagataaccttcaatgactctactgtgagacagatttaagtgttctcttggagttagaatgcactatataaatagagagggaagaattcattttaactgaagcatgacagttaaattgtgcctagaaggacagagattgaaaccttaacaggtagaaatggaagaaagaactaggaagaggaagtaagttgttcaatgtagaatagggtttctatctttttttaaaaaatggacagtttactttctattcatagcttacacagtaaaactgtgcttgtttcaactttgctggcactacacaatatgcctagattcaattctgttgaatcccataaactctctttttttgttttgtttttcattccatctttctatgcctgtgccccatgtgttctttctcagctctcatgtctgtgtctttttcagttctgcatcaccttcttttcttctacatctgtttctcacctttccctgtctctgctatcccctctcgtagtcatctttccgtcttgattgccataaggaattgaaatatgctatacttctctttgacaaatccaaacttgaataaactcttacactatggagttttcaacaaatccttactctttgtacttttttccttttttaaattgttccttcccttcacttaattccttgtaatctgtccaaattttatattctcctcccccacttttctcccttttctttctctcctttttgattcttacactacactactggtgtactcagaggaaaaaatgatgctaaaataaagaaaatgttctttacaatcagaatattattaaccagtacttccaagcataactagttcaatcataaaagttcatttaagatttcaatgattccaacttatatctctttatctctttttgagtcaagtattaaatgactagtacttcaaagttaaatgtattttactgtataatttttgagactgatcatttatatttgatatctatatctcatttcataactatactacatggtctaatgtatagcatatggaaagtttttgtagcttacctcttcttgcaagactaaatgagaggactactgttggcagaaagcaaagttggtcaaggccaaaaataggactgactgttttctttagaccctccctttttcttccttgtaataatcttgaactcctagattccagtttttcctttatttagccaataaatatttactgaatcctaactattttccaggaactatggtaagtgctattgatagatgtattaggccttctttgacacggaagagcttacaacctaggtggagagggagaaacataactgcaatataaattgataaggcccataatgggacgaagaacaggctactatcctcattatacatctggtactcagagacctctacgttattccttggattttccccatacttgcaacccacctttttatcctcctcattaaaacttacctgttattgaatcccattttcccttaaggcaccccttttggataggtgctttgggaaaacaatcccacaaattaactcacactggatattaaaagagtaaagcatatacctcacatccctcttgcattttaacaagtcagtccatttgaaaagaactggttgctagtgatgggaatttcaagaactgtacagtaggccattagaaaagtaaaactttcctcatacacttcaatcacaacagagaggggttgaccgtacaacataaaacttccttttagatgccctaacactattattatttaaacaacatagcagctacatattcactaagaaaatacaattgaatttaattgttgttagtagtagtagttaccgctagtaactactgttactaaaatagaaattatatatcgatttaaaattataaaatttgccttattctttctttaacttttattttaagttcaggggtacaagtacatgtttgttacataggtaaatttgtgtcatgggggtctgttgtacagattatttcatcaaccaggtattaagccaagtatccattagttatttttcctgatcctttccctcctcccaccttccatcctctgatgggcccagtgtgtgttgttcccctctatgtgttcatgtgttctcatcatttagctcccacttataaatgagaacatatggtatttggttttttgttcctttgttagttcgctaaggctaacggcttacagccctatccatccatgtccctgagaagaacacgatcgcattctttttatggctgcctagtattccatggtgtatatgtactacattttctttaaccagtctatcattgatgggcatttaggttgaatccatgactttgctattgtgaatagtgctgcaatgaacatacacatgcatgtgtctttataatagaatgatttatattcctttaggtatattctttgatattattatgaagattcacatgaaatagcaaggaatggttttctagttggaaaagtatgattcccacaataaaagtaataaaatataataagaaatatttacatatatcaagaaaaaatgattcatgggatcacaaaataaaaattatacaaattgaggaaagccttatttaatataatgtctttaggaaaaaaattagtatctgtggacctgggattcctcccctgtaaaatgaagggtttaaataagaaaaactccactttcttgcttccaggcttaacacatatgtgaatcatttgcataaatatttctcaattttcctactacatgaaattttagttgctacaatatcacaattaggcagtctgcataaataaaggagtttctcttatatttctaaatataagagaaatatataaaatatactaaaatactaaatatataaaatatttaaaaatactaaatatactaaaatacagtactaaaataatgcctaacacaaagtaactgccttagcataatttaggtggctgattggatggattaaagcttggattaatagaaaaacacaatgatgcaaatgtgaagtcaggtatatgtctacacatctaacaacatttaatgagagacactgaagacccagaaatgagtatttttacaggcttacaaataaccgatgttcaatttgggggtcaaaacaagaaatagagaaaactgaagtaagttaggtaaggtccattttgactaggattatttctggcaatttcccctcatctactttctgcaaattcatgcatgttcactgtactgtgcttactgacaatctgtaccaaataactcctggcagtttgaaatcatttcatctataacatataaataccttatttgcttcaactgtacaaatgctggaccccatctcaccaaagttttctagaatttaattgttcttcacctaacatctttaaaactcaatttattggtctgtaaaacagtaagacctacattatagagttattgtgacaatcagacggactcaaagcatgtcatagtttcacttacgtatctaccaacccactatcattagccttctacttgagaccaacccctttacctaagtactaaatgtggtaatccttgaagtctctgggacttttctatacaattatcatttttctctgcttgacttcaatgtcttctctgctggctctttatttttcaaaacatgtaaatcatttgtattctaacattaccttgactctgtgcctctttttaccaacaattctccctcctttcatcacctgtgtatattgattaaataaacaaaaaacaattcaaagtaattttatatgaaaaacattgcgggaggaaaatagaataaaaagcaacagtaacaatataaaaaaaaaatcacctgttgtcaaccacaggcatttcttcccaggtgtaatatagttatataaaataaacttgtcatcagaagttttgaatctcagtatttttgcttaatattaaattttatatagcattaccttttctaaaaaaagtgttaaaatagtattttaatgactgcataatatcctatagtaagaatgaaatataattcatttattcattcctacatttagacatttaggtactgtcaaaaatttttgctactataaatggttctgataaacatgcttgcagataaatctttgcatacgtctctgaatatttctacaaaataatcttcaagattggaaattattgactaaagtaaaataaacaatgtgaatagcttttacctttctgacacaagcttaaagtctttgttctttcattaagggaaatttttccatttaaatttatactaaaaatattgtgttattgacaaggcaagtaaagaaaagaaatcaatgctactgaatcaggcactctgatggatattctgtctcttcctattcaacacattttcctttggcaatctcttttcatgagcttatcaactaccaatgtattgatggcttccaaatttctcttcaggtatgaattctcctttgagcttgaaactcccatgtccaaaggcttcttgactatatcctatggtgtgtcatgcagtcctttggattctgcattaataaaagtaaagtattcttacttcacaaaatattctgtaaataattacccaattttgttaatcaagtcatatggaagacaatgcataaatatacaaaataaagaataagaaatgtactacaaatattcagaaagcattaaaatatgtcaaaatactgttacagatatatactaataaaattgaaaatctcaggacataatcttctaagaaaatatacattttcaaaattgactctataaatggaaaattttaacaggccaataaatttaaaaattaattaagaaaggttccagaaacaggtggttcaagagcaaattctatttaatttcctttttcaaaaattgatagataaaattctatgtattttccatgtataacatgtttttaagtatacataccttgtagaacaactaaatttagctaattaacacatgtattacctcacagttatttctgagtaaacatccattcattatttttcaagaatacatgtattattaactatagtcatcatgttgtacaacagatctcttaaacttattccacctaattgaaatgtcatatcatttgaccaatatctccttaaaccccagttttaatagaaaattgaatttcattaagttttcaaggatcaaaataaacccataacatagtaacaaaaacaaaatatttccaaattcattttctgaagctagcaaaagcctaaaacagtacagcaaaggaggctactgagcactgttacttcactccattgaattaggactggatgcaagtgtaaagcatcagatttatagaacttactataaaaaactctaaaatatctcattaacattttcatattacatattaaaatggtaatatcttggctatattgttttaaataaaatacattattaaaattaacttcatctgtttctttttactttttaaaaatgtagtcacaagaaaattttaaattgcatatatggctcacattgtattcctattagtattaatatagataattttgcttataaggatacaaaacttctcagcgagttaaatataacaatatattaaaaataatttgtgatgaccaagaaagttgaaagttttccattagaatatctactaatatatatgataaatttatataagtatgattttaaaaacaataattttgatagtgctgaaaatgcatgcaataaaaatcaaccacaattcttaattttaaaactcttaataaactatgatgaaactctttaatgtaatgaagaatatctacctataaaatggttgacactacacctaatggtgaaaacattagtggtattcccagtgaagccaagagaaaaacaaactcttgctagcacttattattataatttggaagctccagcaataccacctaacatgaactataaacatgagaaaggagtagaataaaaaaattaagaaataattagaacttataaatcagtaacctgcttgtttactatacacacacacatacacacacacacacaccaaaaacagccatttaaaaatgcaaaggaaagaacaatctcttattaccaatgataaaaaataaaaactacatagaaactaacactacaagaaaaatgtcagacttatatggaaaaaatgtttttctaagtaatgttaaaaaattttgaataaattaagacatcttccagatgagaaacctctatgtcaattctccctaaaacagttcataaatttaatgcaaccactctcagaagtccaataaaattgaagggggggggcagtggtagagagaccttgattaaataattctaaatctcttataaaaaattggttaagaatagccagtaaccttttaaaatgaaaaatactaaaaagaaacttttattagcaggtttaaactgtattgtaaaagccacaataaatagtgtagtcctagtaaaccatatagaaactgatagaactgaagagaaaaaataggctggaaatcaaatagaaagacaagaaacaagcctatttgtaaattaagtatttagcatatgataaataatgcattttaaatcagtgggaaaaacatagattttttttcaattgatggtgctgagacaactggttaaatatttagaacagagtaaatttagagcctatctcacactgtatatcaaaataaaattccagatggtttgaagagttatatgtaaacaataaaaccataaaagaaatagaagcaaatacagaagaatttttaatcttatcttgggttggagaaggtcttcctaagcataaaagcaaaggcagaagccataaaaaatgtaatatggtttttaaaaatagaatatttgaacacataaaaatgaaaggtcagtatagcaaaaacaaatgaaactaaaaggcaaacaataaatttagaaaaaactatttgcaacatatgacagagtatcatatagcagctgaaaacaatgtcctatgaaaaataattaaggacctgggaaaaacaactagcacatagtgttaaacggagaaattgttataaaacagtacatacattattataggaactttgtaaaatacacttacatttgggtataatggtttcccacatataccatgtttataatttccatgcttttatacatatagtcccctttgactgaagagatcctccttccttccctgtctatacatctcctattcatctttcaagcatcatttctgacatccctttagacaacaagaagtcttctttgaattatcaggctggaatatgtgcccttcctttgtttgcccatagtacattgttgtacaccatcaaattaatgctatttaatattatctgtttacatgtattactccacccctatgattaaagttccttaagagaaagggtaatattttacctctttctgcatgctcatttcctagtattatatctgtcaattagtacacattcgaaaatattggtttgaattattgctaaaatgtcttctaattaagattattccaaaatgaagctaacatcaatagggagacaaacaacacaagaggcatcaaactgtataagaagtctgaaagaaaaaaaagacttaacgtcatgagagatgattctgtcctcattttcacgttaaaccagaagcttccttcagggtacagctcaatgagtcaccctagagtattctaggtatatattgatattcctaaaaatctaaacatatgtaccatatacaaaccgtgtcccacaatttatcacttaaagtttattgtttttaaatgatttctcatttatgagtcttttctctcattagacgttaatctctgttatgtgaagaggtcatgccttatctaggcagatatcctacaaagtgtttggctaagtaccctagtactttaataaaaattcaatatgcacaaattttctatacagctttaagtaattttctgtttttatttacatacatcccttcataattttctaagaaaatcaggatctactccaatttcctcattacccatcatcatccagaatgatgaagagatgtatagattattaagaaaatatttgcgtttgctgagtaaacccgatattatctaatcaaaagaacagcttcggctgtgctgctcctagctgtgctagtccacacagctttcccagttttcatgaattagtggaggtaatgttaaaccacttttctagtaagagtgcataaggatatttaagtgagctcatccctctaacaaaggaaagaataattttcattaatcattattcaacagtacatcttcttgaactaaatcatgagaggaggaacttatgatgttttttattagtcaaaacattttctatatatagcttagtatatgcaacgtgccaaattacagaattctatttactgctaatgtcaatttaccaccacattgcttgatataattcaaagttttccaaggagctatttgacctcctatagactgaaaataaaatcatgagatttaaattacttaatgccaaaaaggaaagtcatctttttctccttcttatgtctttgtttcataaaactattatcagacagtccatgcaaacaactaaaaacaaaaaattatatggtgtagttaattgaaaaaatgcttttgctacacacagaaattgacactaagtgctgtattagaaggaaatcagtgattttcaattgacattgcacaggaaatcatttagtgtcaattgatattaaatgggtaaaattgtactgaattagtacaaaatgatttggtggaaaaaaatgtgcttccattaggtgacttgatattaagtgggcttaaatgtaataagttttagaggtcactagtcaacaaaaattggggcatgctattcaaccctgagtacatcagactgcttgctcttaataccctcatcaaaagataagttagtgtcatactatcatgacaaaattgtcttcctttgggctttcaagggaagtgggaaaattcaaattgtttaaatgagctaaattagccagtggtaaggaccatgacttcttagatttatctggtggtcctaatcctttaaaaatatttttttttctagaatttttggcatgaaatgaaaggcaacataacagcacgtattttatgtaatatggtccagattgcgctttctttataaaatggctttgacagtaagcacacaataaattatattgtgttagggagtgatatgattatatataatgaagtaaccactttattgatcttttaagaaacctatgtttttaaacctgagtaatgaggaaagagaagtgtgtggctgcaggagacacaaggaaggagaagaaacaggaaaagttacattacacagtcactacaagaacaaattgaataaaatattatagatattttctgggaagagaaatgggggtttgtgaggtacagaaaattgtaaaactcatttgttacttagtaatacaagaaacaataacaataaaacagacatactgggaacactccacccaacaaaaacagaatacgcaatcttctcaagtgtatgtaaggcaattaccagtgtccaggatagaccacatattaggccacaaattaagtctccatagatttaaatagacaaatatcatacaaagtatcctttctgaccacaaagggataaagttagaaatcagtaacaaaatgaaaacagttaggcaacatactcttaaacaaaggatcaaaaaagaaatcacaagagaaattagaaaacacccagagatgaatgaaaaagtattatcccaaatcaaaacttaagaaacacagcaaaaggagtgctaaggggaaagtttataattataaatgcttacattaaacaacaaaaaagacctcaaatcagaacctaactttacaacctaaggaactaaaaaaaaaaaaaaaaaaacaaactaaacccacagctagcagaaggaaagaaatacgtattagagcagatgtaaaatacagaatagaaaaataagataaaaccaataaaaccaaaagttggttcttcaaaaatattaataagattgacaaacctttggatatatatactaagaaaaaaagagaagactcaaattacaaaaatcagaagtgagagaggaaacactactactattctacagaaataaaaatgattataaaagagtacgatgagcaattgctaggccaacgaattggataacctagttgaaatgtagaaattcctagaaaaacaaaacctaccataactaaaccacaaaggaatagaaaatctgaatagacctatataacttgtaaggagattgaatcaatattcaaaaatctcccaataaagaaaagtcctggacctgatgacttcactggtgagttctaccaattatttttaaaaagaataatatcaactaaagtttcctcaaaaaacaaaaaattgagctaccacatgatccagcaatcccactgctgggtatgtatatacccaaaagaaaggaaatcagtatatcaaagaggtatctgcactcttatatttgttgcagcactgtttacaatagctaagatttggaagtgtccatcaacagatgaatagataaagaagatgtggcatatatacataatgaagtactattcagcaataaaaaagaatccctctcaaacttttccaaaaaaatcagagaaggaaacactccctgattgattacatgaggcctgtattaccctgatgccaaaaccagacaaaaacacaataaataaaaacaacagaccaatatctcttatgagcattgacaaggattgaaaatccttaacaaattatagcaaaccaaattcagtagcatattaaaaggattttaccctatgaccaagtaggatttgtcgttgaaatgcaaggatttttaacagatgtaaacccatcaacataatacaccacattaacaaaataaagggaaaaaacaataatcttgattaatgcagaaaaactacttgacaaaatctgacatccttttataataaaaatcctcaaaaactaagaataaaagtaaaaaaccctaacataataaaatccatgtattaaaaactcacagctaaaataatactcaagggtaaaatactgaaagctcttcctctgagatcagcaacaaggcaagtactattccacataatactgaaagtcctagtcagagcagttaattaggaaaaaaagaaatgaaaggcacccaaatcagaaagaaataagtaaaattatctctgttcacatatcatatgatctcatatgtaaaaaacatattccacaatttccaccaaaaaaaaaccctgttagaactaataaataaatacaacaaagcagcaggataaaaaaaatcatcacgcaaaaatcagtcacattgctacacactaacactgaacaatctaaaaagaaaactaagaaaacaattccatatacagtagtatcacaaagaataatactatttagaaattaaccaaagaaataaaatttttaccaataaaatctataaaacttttctgaaagaaattaaagaagacataaatgaaaagaattgtgttcacgaattggaaggcttaacattgtcaagatatcagttctgcccaaagtaagatataatgtattccctataaaaatccaaattatgttttcacagaaatagaaaaactcatcccaaaattcacacgaagtatcagagaacccccaaacagccaaaacaaaactaaaaatgaagaataaaaccaaagcactcaaacttcctggtttcaaaacgtactacaaagctacagtaatcaaaacagcacggtactggcgtaaagacaaactaagaaataaaatagagtccagaaataaaccctcaccagtgtggttaaatgatccttgaaaagggtgctaaaattattcaatggggaacagacagtcttttcaataaatagtgattgggaaaagtgggtatccacatgcaaaagaataaacttcaatccttacctaacaccatatataaaattaattcaaaatagattctaaatataagctttaaatataagatctaaaactataaaactcttggaagaaagcatgaggcaaaagcttcatcatactggatttggcaattatttgagtatgacaacaggccataggcaatgacaacaaaaaagacaaattgagcttcataaaaattaaaaattaaatgcacctcaaaagtcaccatcaacagagtaaaaagccaaaccactgaataagggaacatgtttgcaagtctcatattggataaggggttaacatccaaaatatacagagaactcctaaaaacacaacaacaaaaatctgaatcaaaactgtgcaaagaacttgaatagacatatttccaagaaagatatacagatggcaaacaagcacatgaaaagatgttcaacatgactaatcatttgggaaatgtaaatcaaagctacaatgaaatggaatctcacaccaattagaattgctactatcaaacacacacacacacacacacacacacaaaacaagttttagtgaggatatggagaagttggaaccattttacacctttgatagaaatgtgaaaaacagcatggcagtttctcaaaaagttaaaaaatagaactaccatatgacagagcaattccacctctgggtatatattcaaaagaactgacagcagggtcttgaagagatatttgttaatatgttcatagcagccatattcacaacacccatattcacaattactaaaatatggaagcaattcaagtgtctattggatggataaatggatacacaaattgtgatatatatacacaatggaatattattcagtcttaaaaagtaaggaaattgtgacatatgctacaacatcagtgaactttgaggacactatgctaaatgaaataaagccaaacacaaaaagacaaatattgtatgatccaatttatatgaagtacttagggaaattaaatcataaagacagaaagtacaacggtggttgccaggttgctggtgggaaggaaaaatgaggagttgttcttttatgtgtataggctttaagtttgcaagatgaaaataattctggagatacttggtggtaatgggttcacaataatatgaatgtacttaatgccaccaaactgtacagttaaaattgaataaggtggtgtattttatgttatgtgtattttactacaataaaaaagttgaaaaaaaaatgaaagaaaagctttgtgatttttttttctttcttttttttttccgagacggagtctcgctctgtcgccaggctgaagtgtagtgtcgcgatctcggctcactgtaacctccgcttcccgggttcaagtgattctcctgcatcagcctcccgactagctgggactacagtcttgctctgtcaccaggctggagtgcagtggtgcgatctcggctcactgcaacctccgcctcccaggttcgagcgattctcctgcctcagcctcccgagtagctgggactacaggtgcgtgccatcacgcccagctaacttttgtatttttagtagagacggcgtttcaccatgttggccaggatggtctcgatctcttgacctcatgatctgcctgcctcggcctcccaaagtgctgggattacaggtgtgcaccgcagcgcccggccactttgtgattttttaaatgtgacctgccccaccccaaaaatacatagatagggaactcttcatggtaatcactgggcttgaagagatagcattaaccttttttctaatttggccctgagactgaaaaatatatatatccataggaacccatacagaacttacgatgaatgtccacgaagtaaaccaagaacattccccctagcattagcagagagcattctaaaatataatttagtttcatcacagaggaagcttacaatgaaactggagctacattcaggacagtctttaaggttcaggagaatgatttgctgattcaaatggacaacagagaaatctgattaaataataatatatttatgatcattactgtttattaagcttttactaatagtgaggataatcttcagcattcttcattaactatcaatcgttttgcttaacaatctgataaggtccacctatttcagaaacaaagatcatgagattaagaaaactgaccaaagtaacaagcacagtaaggtgttaaacccacatctatctgaatccaaagtaaagaaatttttggggggggcggagtgaggaggtggaaacagagtctcactccgtcacccaagctagagtgcagtggtgcaatctcagctcactgcaacctccgtctcccaggttcaagcaattctcctgcctcagcctcctgagcagctgggattacaggcttgcacaccatgcccagctcaatttttggatttttagtagaggcagggtttcaaaacgttggccaggctggtctcaaactcctgacctcaaatgatccgccagcctcgacctcccaaagtgctgggattacaggcgtggccaccatggtgggccccaagtaaagaatttttaactaggtaatttggactttcaaaactgggacatagttggtgatttaaaataaaaatcctcttgcaagaatctgaagctaaaatgttccaaagcacaacaggagctgtgaacaagttagtagtctataaggagaagtataaatacattggaagaattaatctagggggaggaatgtggtttaagcagtaattgataggtgaagatgagcacaaaaatcagaaaacacataactgtacctgtaagttgctattcctttaaatcttgccttatttttaaataaataaatatgctagaaaacatttattctttgtggttttagtacatagaataatattttaatttccaaataccacaaatgaggtctaaaacatgattaaataattaactccattatccttacaatagaaaacttagctattcaaacaatgaagtttcacatgggtgatgccacctcctacattgtcacacattaaaaagttatagtcacaggtttttaaagaaataacagcttttccgggttaaacttccaatctcaagcctattcatgatgataaatgtcacagggtcaaagacctacagggaaaatctacgttagctctaaggtgggttaaccagtacacactgattaatccaaaatccatttgttaggaacaaggcaagtactacacacccttcattttgaagatactcataaacccaattaacaattttcaatgacaaagcttgtccctttgtatgtatgtataataacatcatagaactctatacaagcacatacaaaacaaggtgaaaactgacttggccatacaggtttgcaatctaactagaaagcataaatatcacaaataaatagatgtaaatacaattagtacattgataaacatacttcatactcttatgcagtaaatactcaaaaaaataagcaatgaaaataacatagaatacttgttgaactgactaaactcatcccagtgaagtttcctgaatacattttccttgaatttttattataaaactgcagctaaattttgcctaaacaagtttatccctaaatgtaaacaatgcatccaacattatagaaatcatcaatttttaaaaatctgttgttggtaaactattaacgtcattatattcaaaggaaatgttaaaattattaaaattttaatattttaattctaaaaactatatactactatcaacatttgcttcacacatctgcaatatgaaagtggtaacgtctaaaggtttaacattttaaaataatattttcaccttttagccattgcattatatcaaagttatgcaattttttacctttttattattattttttgcattctctccctttactggagattattgccttcttctctgacatcataactagataatatctcaatgacctgttactgtatccttggataagaggagatagcatctccagtaaggtcaaatatgagtcaaccatgtgatatgggtactgaaaaattccaattaaatcttaaactgacctgacagaataacagtatctagaatgagggagatgacattcccactctcatcagcaatggtcagatggcatgatcaatactgtgatacatgacccagaagcacaataatatcctaagaagggggaagaggaagggtgaaagactagaatcataacatatttggaatggtagaaagaatcaagggtattacatgttgactatgcgattaggaaaacaatcgggatagaaaacgtttcaaatgtttgaaaacttcaaatgagattactctgtatgttcccaaggcatatactattaataaaatgatgggttgagaatactagatacaggtttcaactcaaagtaaataagaacctcttaacatcagaattgctcacagatgacgtgttgcttgaaatattagtgaacatatttcaagcagagactggaggtgtttaaagcagttttacaatatgattctattagtcttctcaaagctcagaattaaaatatttaataatgctgagtggtggatgtttttacagtgtggcctggaatctgcagttatcaacctacaagtgtctgatttttattagcaaagtattaaaaagttgttcattttcccaatttaagaagaagtttatgcactggacattgcttttcaaaagttattttttgaatagtggtaaccaaaggttggggcttgcgtagtggggagaatggggacatgttggtcaaagggtacaaaatttcagttaggagatataaattatggccatctattttacagcatgaaaacacatagttggtaacaaataatgcactacacacctgaaaattgctgaggatagattttaaatgttatcaccatacacacacatatacatacacacaaatgataagtatgtgagatgatagatatgttaagtagcttgatttattatttcacactgagtatatatatgttaaaacatcctttgctcaccataaatatatacaatttcatttgtcaattaaaaataataacaaagttacatatataattttttttatttcaagtggtatggctttatataatgctgaatgactcactgactgattgaatcactgtcattcattcaacagacatttattcagagcctggtatgtgccaaagactgcaaagtggcatacaaaaagaaagaataagacaaagcctatgcttataatatgtcagggtaagtagacacccaaaaataatcattttcaaagtttaagatcttattctagaagcctgtgctctgggagcacactggaatggcatttaactttccagaagaatcaaggaagacttcactgaggaggtgatatttgagctgggctttaaaagattaataggatttaactagatagcaagggaatggaatgatatttcaggcagaagaagcattatgtactcagaggcatgaaagtacatggtgtggttagtgaaaaaggcaagaaatttggtaaagctgaaatgtgaggtataaagtatggaaagagtgaaaataagactgacaaagtagatcatgactaaatatttggggtcaatataagccatgctaaggtgtttgggtttaatcttgggcacaaagaaatgttttcaagtagaaaggtaacatggttacatttgcattttagacaatatatgtgcatcatgtgtgagaaactcatttctataaatactagtttttgccttgaaacatttcagggggagtggaatcctcgagttactggcaccagcaagggtaaattaatgggcactagatggcggcatagagtgcccaattcttcataatatcagttactatttctgagcctgtatttttgacttaaataattcctttattcaaaaatcccattaaatgaatatgcactatttagactgattggcatgaagtaatagactactgtaaggggaacacgcattttttaaaagaggtaaagcccatgttggtgcatgatggaaaaggcagttgaggattataaaaatatttggataaaattaaaaatacaactttgagttcaatggaatcttaaatttctcttgcagaagttgccattcgtctttaaataataatacatatatgtgtaaaacacctaaacttcataaagtcatgttatattcaccatctgtcctcttcttcaattaccaccattaccacatggacaaacattacaattcacattttacaaggaacgaaactgaggctcatgtaaatgtttttcccagtttatatggtacagttaataaataatagtaccaaaaccaaaactctagtttttttattacaaatccagtctttggttcactttgtcatgtttcacaactgaaaaacaattgggaactaggacaagattaagacaaggaaatgatagaaccaaatgattctaatgccattctgtgataaacagagagcaaatactgtaaattggattgtatattcattaagcccatggtttctgacaattattttggaagaatttacatgtcaaagaaaattatgaccaatatttagttataccaaggaatttacattggagaagctctatatatttttaatgtttggttgataatatgttaacaagatgattagtaagaaacacaaaaatagtttgtaacttaagatgtaaaagattccaaataactataaattccctatggagaagccatctctgccccatgtcatcatgcctttaaaattagacgcaaaagtttgaatactcaacagtagaattgtttatttagtagtgtggaaggtctacctctgtctatttcctgagggaaagcggctataatgagcctgcctgaattatgagaataaagttttccttttttaaagagtttattctaacagataggaggtaacttttatttctgccttcctctcttgccactccatccccagctaagaatccaatccctcaagagctgtcatcgtttttgttgttgttgatactctccaccaagacaaactaaaccagactgagaccatgccattttagcattatgaaacaagaaagaaagcaaaagtcaccaacagagcaatacaggaatttgagatgtacagaggaactgaaaaaagaggagctgataggagcattctctttcaaagctcaatttagtgttccaactacttaaaaccctatcacaatatactctatgccatcagggaagaaaaatgccaattttaaaacattattttcacttttttataaaaggtaaaacatgttaaggtccatacgtaaaatctttccaacacatcagttcatctgcaaattagtagctgaagtctgctcaaacgcagaggaaacttccatttaggtcttgaaaaagaatagagctcattttaaaacatctttatttatttgtgcaacagtgagtttagaaacaaagtatccagtgtattttcctagagttaaaaaaagaaatatttttattgagtacattccaaaacaattaaatattctcttaccccacccttttcaccaactgaatagttttcgtttgactttgaattaccacccacttactgatttacaaactggtcaaattcagcatatatacccacactcatacaaaatgcatttcaggtttccctttttggattaaaaactaaaattttattttacagtgagagctaatttgttaggtaagacacaattaaaccaagaaagataaatctaaacttacttacttcttccaaatttgaaaattgtccatgagatcttcaccaataagctacatcttttccatgctttatgatcataccccattttttgtatgcaaagaagaaaggggactaatatctttgatcataagtgttgagatcctaaattaaatctaagatttggggccttattaatacaaagggagaaaatagttaactgaagatgtcattagtaaaaattttcattaacttctatctctataatttctggcctttccagttttcggttgcatctttctagaaatgcatgtccttttcctagccttagctctgaaaatattgcttctacccataaaatgtcatgttgataatgctttaaatattgaactataaaatttctatatcagaattaatgagcctatttcatgttttaacactgaaaatacattctaagagtttagaacttctttaataatttgtttaaaaagtagttgaaggccaggcatggtggctcacacctgtaatcccagcactctgggaggccaaggtgggcggatcacttgaggtcaggagtttgaaaccagcctggccaacatggtgaaaccccatctctactaaaaactaaaaaaaaaaaaaaaattagccaggtgtggtggcagccgcctgtaatcccagctactcgggaggctgaggcaagagactcgcttgaaaccaggaggcagaggttgcactgagccgagattgtaccactacactccagcctgggcaacactcagcaagactctggtctcaaaaagaaataaaataaaataaaataaaataaaataaaataaaataaaataaaataaaataataaaataaataaaagtagttgaaaccagaaaaaaagagatcatctaacatataggagtagaattttgagatataaagttttactccacattttctttgtcactaatatttccccactattccttgcactcataagcccttattttcagaatttattgtctattatggttttaatatgtgtcccctccaaatctcatgatgaaatgtggtctccggtgttggaggagggcctggtgggaggtgtttggatcatgggggttgatacctaatgaatggcttggcaccatctccttggtaataagtgagctctcactctaagttcacatgagatctggttgcttaaatgcatgtggcacctcctcacctccttgctcctgcttttgccatgtgaagtacctgctcctcctttgccttctgccattactgtaagattccttaggcctccccagaaaccaagcagattccagcaccatgcttcctgtacagcctgcagaactatgagccaattaaacctcttttctttataaattaacttgcttcaggtatttctttatagcaatacaagaatggcctactacactctccaggaagtttcaaatcacgtaagactaaatgttagtattcttactgcaagccaaccagcgtaggttcaccctcttttattttgcagcgagaaaaacaaaacaaaacaaaactaaatccatagagctgattttgatttacagatacattcattttatttataggtatcaggcatacttttttccaagcttcagacctccaatgagaaggcaaagcctaatgtggttcagtcttattacctggctaatttgaaaggcaaaataaatgacagtgaagaaataaaagacagctaaaccagatgatgttggtttgtaaactttaatgactacttattaaaattttgcaaaaaatgaaattggttattatctatatcagtgatttccaatggtggctaccagaagaattgcttgggaaccttttaaaacataccaatgccagagccctgccttacaccaattaaatcatatttggcagtgccaagtttaaaacatacctgaggtagcattttgttaagactgtttaacaaagttatcgagaacacaagctactttcaatctgaacttcatttgcctcatccccaaaatgggcagaataactacactatgtggatattgtgagaattaaatgaaataatgcttaagaagaatccagaacaatgactggctcacagtatgtactcatttgtaggtggtattgctattagagctcctgttgatctgcactggtaaaacctgtaggtgttacagaaaggaaatggtatgcctatgaataaggaaaaggaagaacactctttaaacatcaatcgcagccagcaatgtgctatacccatgagacataggaaatacagcagcaaatcatacttagcattcctgtgatagatgttagccttaatgaagtatcttcatgccatacacaggaccacaaaagcctctgtgggacccaacatacaatttcctataataactcgtgaatcccattcattaaattagtcatattgaacattcttattcaatttctctatatctaatgccaataaactaaaaaacatgtagtatatgttcctatttatatctgcatataaacataaatacatatttttacatatatatgaaacattaaaaaacagaggtaatttttttgtctatataattttcccgtagtggccgaatttcctaaaataagcatacatcatttttataagtaagatgctgatttcattttaattaaacaaataaaaagtcatatatatttaaaaatacaaagaaactacacctttctacaattaatttattagaagtttgtttactggtattgttattgtctgcactgaccttaagcctccttaaagaaaaaaaaaaggcaaacaactaaaatgcaatcaatccagtcaaattcatggtgttataaagttcttcagaacagcactaacatggaagacttttataataggaaaggaaaaaccaaataagagagaaagagaatataaataaattattcagccctccctttcaaaaagtaaagaaaatattttcagaatagattatttctttcattatactactgacatattctttccctaaattctaattctgatcctaatctttttctctacttcttttttctcctcatattttaagattctaagattgttctcaaactgttggcaactgctagatcacttgatgagggttcaacaagcatgtggaccaccagttttagttggaagaatgccattgtttacaatctttcatcaaggtatctcttactggctcaatgataaattgtgtgagccatagatcaggtgaaatttttatccagaaaaataattttaaaacatcttcatttgtactgaatcagaaaatcatgacatacttagaggtcactgggattaatactgaattcgagatggctctgtcaggtagttctagataatttgcaataagcatcaacccagaggttacgaaaaggtttctcactgaagactaccttcaatatgtaacagatgctaagtcaaaaattatattacacacaaacctaaaacgttgaaggttttaactcggaagatggagaaaaaaggattcttaatccatcttttgacagcactcagtcctataaagttgttagaaaaaaaaagtcttcatgttttgcacctggaaattatttttaaatgggcttaataatgtggcatcaattcctttcccccaaaatgagtaaacacatcaaatgttgggtaaaagtcatgttctcagtgatcgttgagccatatgtaccaaaattaatattctaaagaaattctgctatcttgtcctcaactaaaaatcttgttgaccttaaattaataggtcaaggctacttaagaattgatatgtatgacttaataagactacttgaaattataggaatagtttttataggatttacaagtattatgaagaaatagtttttcattttttcattcatagttgcaaaatgtaggttatgaaataactttaaaaaacaacatttccattcatgtaaaaacctccctctccttgctatgggcaagtctggttctccataccgtcacaatgacactttcgcagtcaacatcacagctcaggaaataattattaaaaacaaacaaacaaacacaaatatctattatagagtatgggtttttagtgataagaaaaacaaaagtcatcaagcatttcttcacatattcacagaacaaatgccaagagctgatttagaccttccaacttaaaatttaattatctgctaccacatacgttagatggtatctgtttttccacagtacagtaatatgttgatataatgcagaatccaacaatttggtatgataaaggaattttatcaatactttcttctgctttctctctgaacatatttgtcatcatctttgaggctgatttaccagttttgaagcaatcctgcgcattacttgtaactgtttttgctatgaggagtacaattctgaatgaagtctttgtagttttgatcttttcacctttagtaataaaagtcatctattttgtaccagaaaacagtaaaatggcaaaaacaaaaagtttcaatagcttcctttgattatttgacaaagtttgagaaaagacaacatacttggaaccagaggaatcaggaagaaaaaggactgctggtatttgtcagtgggctttctatttgtgcttcttaagctgattgtacgaaatcctcacacctccatgttcactttacccagcacttattaaatgtacattttattgctccagaaaactattcactatttatacttataatcattattgtacattattgttagaattttcatatttttatattttaatgaatctcctttaaactactgatgtatttttgtgaattggaaatacaacagaaaagtaacaatgaataatgcaaaatttaataaatgtaaacaatctgcaagttatgtaaaacatattaacccggacatattatatactgtatcctgttaaatgcctgttggttgagataaacacaagcaaatcagtttcaggatctaattggtggtgaacagctttcactatagtaaagttaactttatgtataacgaaattgtttacaaggcctgcattccacacaatgacctggaattgtgacagttcctcagtcccagagatgctatattcatgattttgcaataaacaaaactaatacttattaagagctaagaaaattttctggccgggcgcggtggctcacgtctgtaatcccagcactttgggaggctgaggcaggcagaacacgaggtcaggagatcgagaccatcctggctaacacggtgaaaccccagtctctactaaaaatacaaaaaaaaaattggccgggcgtggtggcgggcgcctgtggtcccagctacttgggaggctgaggcaggagaatggcgtgaacccgggaggcggagcttgcagtgagctgagttcgcgccactgcactccagcctgggcgacagagcgagactctgtctcaaaaaataaaaataaaaaaagagctagcaaaattttctaaattaaatcctaaatcttttcttaattgtatcacatcttcacatacacacaaatctactatttctatctcaattcagttagctttatattcctgaattggtttgactcagatagaaaagttcccacaacaactcattttgagaccatttcaaggtctgcctatttaatgtagtttaaatcctatgtcaaagtcagggccttgggtttatataatttatactgataaatcataatgataatcataataatatctcaacagaaatgtctgtcatttcaggtaagataaataatcttgactaaattaaaacaaatgttgaggtaattattactatgtacatttgaaagcaaccataagcttcacaaaatgaatcaaattcacaatcgctactctcacaaagtttatgtattaaggactattgcaaaagtcatccattagtcttttcttacacaaataggaagtgaaaccaatgatttaccctttgtttacaaagatgtgactatttttaaattgttatttacatttaaattgagcatttatttagcacttgtcttaaaacagtaatttttggatgatatataaaagagtatttattaaagacttctatctaaaaaaaaggatttataccaatccatgcacatattagcttacttctacaacctcacctttcacaggtacacatacttgaacctccaaacttactccattcatactgaactatgtgaactatatgcaaacccatgaacgggtcatatactttttttttaatgctaaactttttaataagctgtttctcttcttataaaacccttaatacttgtaactggctaattcctactcaccttttcagtgctctcttagccatcatgtcctgtaggaagtcttccctgacttgggttaagtgccccttcttgtgactctatacctctctggtatatagagagaggaattatcactcaacagcaattattataagatattgaaaatgtccagtgcccagcctgtctctcccactataccatacattctcaaagaaaaggagtatctggtggttacttttttatttctagcatctagacaaataacaagtattgactaaataaagtatatttcagaatacaagttgggtattccttgtccaaagtgtttcgtatttcagattttttcagattttagaatatttgcatacacataatgaaatattcttacaatagaacccaagtctaaacacaaaatttatgtttcacatataccttatatacgtagccttaaggtaattttgtacaatattttataataattttgtgcacctctcaagtgaagttaggtgtgaaattttccacttctggcatcatggcagtgctcaaaaagttttggactttggaatattttacttcagattttcagattatggatgttcaactggtataaggcaaactgtttagtcaatgttatttctcagaagaaagactctcatattatgggccacacttccaattactttcttataaacaacaaagtagtatttaggaaagatttattagcaaggaattacctcagttggtactggtttgtcatggctttagaggtcaatctgctagaatagttaaaaatagaggcaaaataaaatgtaatacaagtttagtttttatttctggaatttttttcacaattgcaaatgttagctgctgatttaaatatgcctttcaaacatcatataaaacagccaaaagattatatcattacatagtacagatcgtaaatatatgcttaaggaacaagtgttgaaaaaaattcccctagtgttatggaaatggtatttgtgtcttctgatgaaattttaagtgacagtatcaaagatgaatttaaaacatgttataactaaaataacttaggtaaaaccaaaaatgatgtggttcggaaaacattgaaaaggtacgaattttataaatgtatgtgacgaatatgaataaaacgttcataaagttaggattgaaaattaacattagtaaattaaaatattattttatatgactttagttataattatgtatatgctatgaaattataagtaaatatttgtctctcatatctaaagctcccttcaaaagagtttttttatgataaaatataaaattcattagcttagagttatttgggggcatgtatgacatttgataaatacatgattaagtgaatgaattaagctctcttcatcttagaaatcaaaactagaattatattatcaaacacctttatgtttgtttatataaaaataattttaatacattttataaattatgatactttaaagaatgtatgcattcctaggggtcctctgaatctctcaatgatttattaacttttatttcactttctataatccctaccataaatattcagtcacataccatctcacgcatacaggcataactggcatgtaaacttaggtaacttttcaccgaaacttttatgtgcagatgacagttctgattaaaggctatgatcaatatgtcctctgatatggacatatggttaaaatatcactgtgtagttttccctacagaaaagggtaataataaaaggatggtaataagatgaaaggtactctacaactctattagaaacaatagaaaaacaaagtcaatccaaaatcataggaggacaaaattacaaactattgtttttaaaataatgatctatcattttttagcacaatcttcaatttcaggtataagcttcaattcctatactcagaaattccaaaacgctgttatttaaattattaatgatttaacggaaattttataatactaaaacttaaagcttaaggtatcttggctaaatttttttgctaggtacattcattcaataattcattcagacatttaggtaataattaaatgactattaaagtcctactatattttgggtagtatgttagttcctatggtgacaatgagaagaaaaaagcagacacaattccgttttcatattactaatgccttgtgggaaccagacattaatcaataatcataaaattattatataactataaatagattttggagagaaaaatgagattccatgatagcatctgaggaaaaaaaattgacatgcttaagaagatttcactgagaaagtgatgtttaagctgatatgatagatgggtaggagtttagagactagcaaattaaagctaatagggaccaggattaatattaagaggttcttttttaaatgaatacataggtattcataggtagtaagagctgttgattagtaaattgttgggacaggaattaacgttgttacagtaataccttcaaaatagtttgttttcctaaattggcgagaaatcattctagaaatgctggccataggatctttgtgtttgacaaacccgtgttttgtaagacaaatttcagcaagttctttttccaattatcataaatttagaattatattttctgtcttcatccagtttcacactgctctaaagaactacctctgattgggtagtttatgaagaaaagaggattaattgacttaatagttccacaggctgtacaggaagcatgcctggggggcctcagaaaacttaaaggtgaaggggaagcaagcatggcttactatggaggagcaggagagagaaaatgaagagggaagtgctacacacttttaaccaaccagatctcggtgagaactcactcactatcatgagaacagcaagcgggaaatttgcacccatgatctgatcacctcccatcaagtccctcccccaacattggggattaaaatacaacatgagatttgggtggggacacagagcccaaccatatcagtgaaatcctaattgatgagactttagccacaatttaatgatataataaaactttctaaagataaaagtgtggttaggcatggtggctcatgcctgtaatcccagcactttaggaggtggaggcgggcagatcacaaggtcaggagatccagacaatcctggacaacatggtgaaaccctgtctctactaaaaatacaaaaattagctgggcatggtggtgcatgcctgtaatcccagctactcgggaggctgaggcaggagaatcgctagaaccaggtagttggaggttgcagtgagccaaaattgcaccggtgcactccaacctaggtaatggagtgagacgctttctcatggaaaaaaaaaaagtgactagaccacagtactatcttgtatactaaagaaatacagagttaaagagatgagattataattatattgcactaataaatggaaattcgtcatctttcctcctgcaaagtttaactaaaagacaaatatcttgttcaggaagaagcttgtcaagttttcattcctatcactgattatcctacaaacacacacacagacacaaaagtgagctaatttaagaaatcataaatttaaattactgagagttttgttataatgtttgaggtatatctaattttcactataaactgtaaatgctattataggagactcagaaaatgcaaaaagctagaaatttcagaagataaaattattcagaatcccatcactgcaaaatgagcactgtaaaaattttcatgtttgaattgtttttagtaataataattttcattctttaattgaatttttaattaatttcaaaaaacgtttatagctaatcaaactctctggtcattcagttttttgtactcttcagtaaagtccacagtaaaggctaatctgaatgctgacatcactgcctataactctctctgttgtggtttagccattttagctcccctttcaagaacagtaattccccctgaactaaatattgttaaccacagataaagaagtacaaaacaaagcctatgttgttttcctgtgaatccaaatgagaaataacgactttaaagcatttgatctatccctttaaaagatgtaacacattggagactataaatcttctccctataaatccaacagagcttttcttatccttcatcgttggaacagtttcttgtttgtttgttttgctttgttttgtttttatttcagttcagaaccatataaagtaactgaattggttttaggtcaaagctatgtattttttggtgtcatcaaatattagaatcactcagaatggcaagatgctcacatcctgagaagtaaacagggatggaagccaaccataactccaatctcactcagggtggtgagttcactaatcagcaagagcttatttaagtggaatagtgagagtacttgctcaataatttgataaaaatttcttttttaaatgaatgcatatggttaaatttgtgtaaattaagtatgtgtatattaactcacatttattgatgagattctactgtatttcatcccaactttcattagaatacatattctttctataatttaagaatttccatattgaaacctgcaaataatttgttctctgcttatattatccgaatgccctataaacctgtctgatacttaaattctgaatgaaacttctaggagatgtaagatgataatatccagaaaaataaagaggaaaaaggatgaaaacaacagaatgtgtcggtataaggacatgttacaaagtttttactgggtttagtctgtggttggtttatcattatattgcaaaaaactctcccataaactactaatgattgtaattcctattaaattgggctttcatattaaattgtttaaattagttctttactctgtaagcataatcataatccattgtcccccattagtcaatttctgctttgtaaaattaaatattctgaattttaacatgtgaggcattgaaatatacaatgcttttcacatacccaagacagaaagcctatgactaaacttatgaagaaacaaactatagagaaatagctgtgaaaaaatacttcttattgtgataaaaatatcaaatgatctgtttacagggagcaataaaaggcaccatttcaactttcaacataggttgttccttttcatttgtatttccaggaaagcgctgaaataaccaatagtcatccagtttaattattctttaaacttttttaatttaagctcaactatttgaatcatagcaagtttgtaagtttcacaaccaacgtcttaatattaaaaatgaagaacttaggcttagagagattgtatgaattatctcacatttttgcacttactcagtagcagcattagaacccaaactcaaatcttttccccgtcaagtattccattagaacactacagcatgttctattttgagtctctctaggctaagactacatagttcaagtgaaaattaataatgcataattaattatttgccaaacaggaggaatatttaaggttaacctttatcatgcaagcaacaattacttagataatacaaaatcaactgatttgacactttgattattataaatcacaaaacaaataaaaaactaggaatggctcccaggttggcccatagagggattattaagatccctacatgtattcataaaagtaatgcaataattttgatttttcttagctctttatgcttttcacactcaatattttactcttatagtgacttacaggcatcaggaaaatgcagaaattaattataagaagtgttaggacttgcctcaattctcctgctaatccatgtagaaggtcttcaacctcaggtctgagttcttatagaaatcaaaacttttataggagtccatgctttcctgacaacagacaaacattccaggggttccttgagacaaagccatgtacacaatgcaggtcccagtttcttggacttctttctattatcactaatatatatagccatagagtaattttaacttacaaacttttgctccctccaacttacaatcttttgctccctcctggtaatctctctctctctctctctctctctctctctctctctcactgtccactagccttggaagaaaccaactgtcatgtcataaggacactcaagcagccctacagacaggactttgtggtcagaaactgagacttcctaccaagaaccataggattaatccattttggaaacagattattctttagatgaccactgacctggtcaatatcttcactgcaacctacaagaggctctgaactagaagcacccagtaaagcaggtcccaaattcctgacccacagaaatagtgagataaatgtttgttgttttaagctgctaagtctgtggtaatttgttatatgacaatagatagcaaacacccactatgagaaatccaggttaactactgaatctgtttcttcaccgttacaatgagataatagagatataaatatctaacatatcgcattgttgtaaagataaagaatataaaaaacactgtccctagaagacagtaaaagctcaatgaatgtcattttttatttttctattaatattataactatcattatcaatctcagaagtttgccatgtttcataatcttttgctggctcatgtttacttcattagctgagcaagtgaaattcatacactaaaataaatacagataattgaaattaattatagagaacagtacaataaacgtattataagaaaacactaagaatattttcatagctttggggtagaaaaatgttccttggcataatccaaggtaaagaccctcaaaaagttgagagatatgactacataaaaattgaaaacatctttagagtaaataattccatataaaagttagaagtcaaatgccaaaagggtgaaaatattttatatatgtcaaaaagtgagtatctttaaaatacagtcttacaaaataatgagagatacatataagcatgtatgggagtgtgtaaaacattttttacagcagaataaaacaaaaacatgcaagtaagtgaatggaaatttcacagtagttcaaatgactagtaaacatataaagagatgctcaaaaaataaaggaaatacaaaatgaaaaagtcatgggtatcactttttaccttggcttagactgaaaatgtttattatcgatgagagggtagagaaactagcacaaccctgtgagaggtaaagaattcttgaagagtattctggcaatatgtatcataaccttatatgtgctccctcatgcccctgcaacctggcaatgattttatcctaaagaaataatcataaaagtcacacatgatttgcaaagagtcatggacactgatacacataaatacttgaaaaacaagcatctttcatatttttgcattttaacaagttagcttatagaataatatgtattatatgttgccatttttgtattttaaaaagtgtcttctcttcaaaagttattttaaaaataccgaactatactaatgattgcgtgagggtatgtggatagcatcaggaggatcttctgtttatatccagaaaataataaaccataaagctacctagttgtttaatagtcaaatcttaccatctcaattttatggtacaccatttatgtaagtggttatccatatttcattatagggtgtttgggcttaatatgagaaaaggaagagcaaagaagtagaataaggaataatgtactctctttatttaaccagaaaatatggattgagatgtagctacttaacaataacaggtttgtgtctaatgagagcctcaaggagttggagtcattctgttgtagcacatatctattccagaatatatgtgcttgtataaattctgttgagaataaaaataatctacatactctaattacttaaacataattttcaaaattattatagagtcaaaacagttaaccccttttcattatccttctgtcttctctaacacctctggtggatgagctgctattgcaactgtcattgcaattattgattgcaatttttgtcattgcatttattgatataagaaagtttaaatccattaactttaacttcgtatttcttttctgtcccatgtgttctttatttttttttctctttgtctgcctttttttgaaatagttgagtattcaatgttccattttatctctattttggccttactgttatatctctttattttgtaatgattattgtagggtttacaatatgtaacttttaacttatcaaggctaccttgaaataataatataccacttcatatataatatcaaaccatttcaacaacacacttctatttccctgctccaattatttatgtaatttatgtcaaacatcttactactatataacccacaatacattgttaattattttgctgcaaagtgttaccttttaaataaaattttaaaagaaaaaagtgtgttatatttactcatatatttaccatttctggtactcctctttactttgtgttattacaaatttccatcttatttggtatcattttccttcttcctgaagaacctccattaacacatcttgtagtgcttgtctgtgggtgatgatttctctttcagcttttatgtccccaaaagtctttattttatagaattctaggttgactctttttatctttcagcattttaaagatgtctatattagtccgttctcatgctgctaataaagatatactcaagactgggtaatttataaaagaaaaaatttaattgactcacagttcagcacagctggggtggcctcaggaaacttacaatcatgatggaagaggaggcaaacacatccttcttcacatggcagcagcaagaagtgctgagcaaaagggggaaaagccccttataaaaccatcagatcttgtgagaactcactcattatcatgagaacagcatgaggtaaccactcccgtgattaaattacctcccaccgggtccctcccacaacacggggattatgggaactacaattcccgatgagatttgggtggggacatagccaaacatatcaatgaaattctaagtcttctagtttatattgtttctgacaagaagtatttaatatttgtgtcttcctcctgtacataatgcctccatttcctgtctctttctgggattttcttgttatcaattgttttcaacaattttagtatcatgtgtcttgatgccatttccttcatttttctcctcttacttatagttgaaatctctagatctttgtaaatacagttttagtcaaatttgaaatattttcagtggccaggcatggtgggtcatgcctctaatcacagcactttgggaggctgaggcaggcagatcacttgaggtcaggagtttgagaccagcctggccaacatggcaaaaccctgtctctactagaaatacaaaaattagccgggcaaggtgggggttgcttgtagtcccagctactcaggaggttgaggcaggagaatcacttgaacccaggaggcagaggttgcagtaagccacgatgtgccactgcactccagcctgggcaacagagcaagactccatatatatatatttcagcctttgattgtccaagtaatttttcttccttccttccccacctcctttttaggactaacatacaggttaaactgcttcatagtgtcccataaatctctgaggttatatttgtgtgtctgtttcaatcttttttctcagattgtgtgtgtgcttcagattggatagtttctattgctatgtcttcacattcactaatcctttttctgtagtatctaatatcctgttataccataccaatgtagtaaattttttcattccaaatatatttttcatctctaaaagttccatttagttcccttttatgccactcatttctctcctgatcatagtcaagctttcctttaaatccttgatcacatttataataatggttacaaaatatttttcttctaattccgtcatctctgccatttctgaacgttttttcattggtaatttttttcccagttacatgtcacattttccagctttttcatgtaacataaattttattttgatgtcattcatcataaactttttgttgttgactgctgaattttgttgaacttcacaaagtattagacatttttctggcaggctggttaatagcttgcagatcagtttggtccttttgagtcttattcttaagctctattagggcaggcttgttaggccctactgaaaaagaattatcctttttgggatctcatttccctggctattaacaaagtgtctccactttggctgaacaaaactcaaacacttccaatccgcgaaagctccaggagtggttcaccttttcagctctctggttgttctttgccggccttctggaggtttacccaaagtatgcacagtttaatattcagcattcaataggctcaaggcaatccttttgcagatttccaaagttccttgtctgcatatctcccttcctccggtattctacctgcaaattctactgcctcatctccctgaatttcaatttctatctcctaatctcagtgtgatcactgtgctctgtttaggtttcccttctgtacattatgatcaggaaagtacatccaagcataaaattttttctatgcaacagaagaagatattatttttaagtgtatacctctccctattatgtcatacaaatttcagggcttattttcaagaaccatgtcttttatatggtatctggttatgttgttactattttgaaataaaatacaggaattgaatttattcagtgtttcatctttgaataacctgaaaattgtatagtaattccttatcttctcacccaaaccactgatatataaaatactatttaagacgacaagatcaaacaaggtcacttactatcttcctttgggcatacctatattttagccatgcttaactttgtatcattactcaaacaacctcttttaacacccatcttcttgattctatttttaagagaatgagatctatggtaaactgtctaagttcaaatcctgacccaactagtttataaagcaagttatacttaaagcatctttgacttcatattatcatgtccatgtagaaataataatatagtctacctcaaaatgattatgaagaataaaagaaacaatatacagtcaatgaatgtgagctaatgttatcacttgcaaaccttttccctatttctttatatgcaaaccctatccgtaattccatttcagttaaaatgccatctctacaggaaggctttcccgggatccatgctgagaggattctttcttaagatactcatcacagggcatttatgtgatttatatttttcttcttagcttctatactaagcaattaagttcttgaaaggagcttccatgttttactctctcttttttcaaaaagatatcccacagtggacagtaaattgctttgtatttagtaggctattcacaaatacttgcctcagaaaagaaaattaaacatgactatatgggggaagtttttcaaataacttatgaatctccctaaatctactgccatcattttatcaaatcccttgtttacaccaagatacatatgtttgcaaaattttcttagctaacaacccagttaactttatcagaaaaggagaaatgagattagtatgacatgacttgttcttggtaaaataacaccttggtttctacatggtcacaaataatctattcaatatttcagaattttgcaggagataaagttaactctgtaggttagagaattcacctttatttcatctttaatattttatatgtttgcttgtatccattattttatatcttccgattctccaaatatgatcatttctggaagttatgatgttcagtcaaagaaagtttagactttggagcaaaagtccttaggtttggattccagttgttctgatagacagcagtgtggcttgaaaaagatatatttactttcagttaacacatctataaatggagataataaaattttcttggagcatggtgattattaaatgagaataagtgaaaaggtatgacctactgcctactgctaaaaactttttatttgcttccttttggtttcctcacctgcaaaatgcaaatagtcatccctgtttacttttcaggattcccttaaggattcagtgaatacatacattgtgatactttgaaaaacacacattatataaatatgcaagtttttaaaaaaattatggtcattattattcttgaataaaagttaccaaactctgtggacttagattgtaaatttgccaaaatagtctcctattaaccaatttattgatttccattcatttcttctaatttgaagattattcttcttggaaagaaaaatataggcaaaatatttgttcatcatctctgccttctctgtgtcatctctgaaaattatgtcatattctcccaagtaatgcctctatctattcagtctgaggtgacttttcaaatctcttctaaaagtttacgattttacaagagtaaattagagtgttcttgtacacacacacaagagaccaaaaaaaatcagaacacattttcacaaacagctgaaactatttaatatgggtatccttaaaaacaataaaatattatgaacagtaaaagtcaattatttattttatgacagaaatatttcagtgtgattatatctgagtatatcttcaattttttttgttcaggcagcaagcattggtcctttttaccaaccactacaaattatgcaccctaaacattatgcactctatgctataaaatgacaatataaaaatataatccaatctacattaattgaacataaagtacattctgatactcagcttagactaaccataacacagaatttgtcattaaacgttcagttcacacacatacactcaaaactgatccaacaactcctattatgccagttaccagcattgccagcccctttgcccttcactgcctggagaacgtccatcagaaacagggaagcagagcaaactgccacaatgcaccattgatgtttgagcaaggctgcctaagcagctgcaataacagggcaactcttcaaagtgtcagcattgaaacttacaattctctctcccatacactatcaatgaaaacctttataagctacaatcaattataaaataaatctttgagacaaatcatgttctttcttcatttcttctctccttcttttcctcccaaaaccaaatgtccttggttaaaagaaaaattcaaggagaaatatcccccctttctatcttggtctctgcctctgcctctcttatgtctaaaaattctctcaaggaggtttaaggatatctgctaaacacttttgtttacaagacaagttctggggttttttgtttgtttgctgttgggtttttattgttggaatgtttttattttaaaaattcaaaaggcacttgatattttgagcacactcatactagatttttggcaaagcatgtttttgattattaaaagacaatctaaattctgaaatgcatgcaccaaatcacataacctccatatttttgtaaaccacaacaaaagtgcctcatattagctacagatgaatagctaatgagtcagcaaacagttaaaaacattccatgagaatagatgcactagccatgcaaagtttttgagggaaaaatatattaagtatttaaaaactacttagaatgaagggaaactattctttctttaacaaagcaactatgtttaatttgtcttatgattatacctaccaaaccaaatgaaagtttatctgtctttttctatttctccttagccatcaatagttaatgcctttttaaattttgtaacatatatttaaggtctcagaattgtagcaacaacttttagattcttcatcattgtttttatcattcaaacagcatgcgaaaaccccttcaaatataatgtcaaggtataactctaattcctgcagataacaaaaatatatacacttcatcatgagttaatctactacctgaacaatcaaagtccaaaatacttggtatctgagttcagggtgcaataataataaattgccatagacttggttaaacaacagaatttaacaacaaaaatgtatttctcacagttctgagggctgagaagtctgagattagaatgccagcatgaccaggttttgatgaatgcctttgtcctggtttgcatatagtagtcttctcactgcgtcctcacatgatggagggccaagagacagagtggaagcaagcttctataagggcactattcccatcttgagggccccaccttcatggcctaattacctaccaaaggccccatgtacaaatgccatcacattaaagattaggttttcaatatatgaattttgaggtgacacaaacattcagctcatagcatttagaaatctgtaagaatttttagttatcatttctcattattgtcaaagcaacacacacacacacacacacacacacacacaaacacacacacacagtttaccagttaaatagtaccacaaagtttatacaaaatacagcatcccgtatccaaaactttgaccctctgccaaaactcattctagtgtttgcctgatttctaaataatatgcttctattgttatttttatttataaattttagacataatatattaacttcctatcatggcagaagacttagttctttgatactacctcatttccctttcttccatccttccagtaatcagtgaagtaatatttttgaatacatttggtaccttgagtagtaacaatatttccttcctattgttaatattgtcactttgccccccacattcccaaggtttgcaacagaaatgtaaaacctctataaatataatatttcacactcttacacatgaagaatcctattctaattctttcccctgaagacatccctttcgggagttctccatcttctagctcaagtaaagactgcttatttttaagatcaatgcacagaagttatccagtaacttcccttcacctttctcacctcattttaatcacctgtttcctgaaccctctatcttggtcttttctcctcagtttttcctcacttggacgtagcatacccttgaaacaattccggagaaagcaagtgtgggggtacatttggagaaccatgtgtctaaaaataaaaatgttttttctacccttatacgtaattggtagtttgggtgtagaattcaaagttaaaagtaattttctctcataattctttttttttttttttttttttttttgagacggaatttcgctctcgtttcccaggctggagtgcaatggcaaaatcttggctcactgcaacctccgcctcccgggttcaagtgattctcctgcctcagcctcccaagtagctaggattacaggcatgtgccaacacacccagctagttttaaattttttagagatgaggtttcaccatgttggtcaggctggtctcgagctcctgacctcaggtgatccacctgcctcagcctcccaaagtgttgggattacttacaggcgtgagccaccgtgcccggccttctctctgaattttaaagccacatcttctagctttgaatgttgtcattaagaaatcagataccattctggttcttgagccaatgtatgaggcctatatttctctcgggaactttctattatcatctatttattactgttattttgaaattttccaattatgcatcttggtgtggaattgctttcacatttttatgggcactcagaagatccttccaaactggaacctttggggctgaaaaattttaccatatacttttataacagtttcctccctatcattttctttgctctcgcctgccttctgaacttcccattaatcagatgttcagcttgttggatcgtttgtttgatttttatctcttctctcctattttccatttatttgacttttttttgctctattttcaggaaaatttctatcatataaaagcttatttcagttattataaaagtgcttattctctggttatttcttctttttatataatcttgtcatgtttcatagtagcagtatcttctgctatctctctgagtatattaattatactttatttctacttcagctactgttttctacaggacatactgcctctaattcttaaacaggttctggagtatgaactgtcttgtttctcattgacacaacactctccagtcacatgtattcggctttcccatttctgccagttcctcctttacatcttccaaaagttgtgtctctttaatatgttgcttcctcttccttatgcctgtggatttatatattttttagtcttttgctcaaaatttttagtcccttactaggaaggaacatggaaaaacatgtgttcaatcacgaagtttaactggaagtctgctgttaaatttcctgaagatgttaatcctagagctataatcatgctattcacagggtcataaaatcatagggctcttactataaaaaggttatcagagatcatccgattcaaccctcttattttataaaagtgagaaaatggaaacccaaagaggttaagtggtttgtgcaaggttatttaaatagcaatccatacatttggtatttgacttgctttcattaccatagtgcctcctcaaatagatatccccttaaagtagtgactcagaagactcccagacacatcctagggttaacacatttgaataagccaatctagcttttggatataaaatggaggagagctgtcattaaagaaaatctgggaaaaaatgtctccaagaataaatatttgactctggacatcctgttttctactagtagaaattccctaatcaatactctcccatgaaactcattccccttattcagcttcagcataacacacttatcctaacttttactctttcaggttacagaatcacatcatattttctcaaagcaaggtaaatctgtgtttgaaattcaaatgaatcttttatatctttcctaagtttctaccctcaattccttcctgacctctggctggccaccaacctcctactcctaaaatagtccttttttttttctgcaaatggcaccacccaggtactcgagaaaaacatcttgagagtcatcctaaacttctctttttctttaacagcatccaacttccaccccttcaccgatacagtacccaaatcttatcaattctacttcctaaaaatcccttgaatccattcctcttaggttcctcatagcttcacagtcactgtttcagttcatgccctcactatacttcaccctgatttccattaattgtcttctaacagtctcacagactctggtctgctttcttcataccccttcttccacactcaattgctgaagtgctttttctcaatagaactaagaagtcatttcctcacttaaaacccttcagaggatcccacctcatttctgacttcttagtatagcatatataaggcacttcatgataggcacctacttatccctccatcttcatctcctgtggctcttcaccttgcatgttatggaactagaaatcagaaaatcaaaagtctcctctcgggtttctattcacactggattttcaacaccaaatgccaaatgtcccttcccctgtcttctcccaaataaaggaatccaacaaaagagagtgaaaagattaaaaaccagttaaaaccatttaaaattattaaagtgcttttaccataatattttacatttatatttataatattttatctttatcttttagggattatagtctgtttaaatatgttggtagtacattaaattattattcagaacactgaagatgtaaattaaatatgaccataacaataataattagactcttatcatgtgaaataattaaggaattaacacattattatagtaagggccaaatctaagaaatgtactataccataccaccagactgcacacttttagtagacaggactgtgtcttaatcatctttacattccctactatgccaaatactatccccaacataatagatgcacagtgaattagtaaatgattaaataaaattagaaataatatcacacccacaaacccgggaagcaattatttgcctactacttgatgaggccaataattcaatgatatttattattatagttgatcgagttagtcaaatgtcatgagtgcctcttaaaaaatttatatatatacacacatttttctgcagatctttatacggaacatcaatctaatctttatttgggcatataaatcattcaatggataacacagtgaaaattttcaacataacagaaagacatatgctatttgaaaaatcagtaaaaaaaaaaaaaaagatgattctattgttggtattcttatcttcagattgtcctccacagcacatccctctgatacagagaaataaaaactttcttacctagaactctgatcaagttactgccttttataccactataatgatattcaaactggcttctaagcaaaatagaacagaaacattgcacatgcacatgcacttgaattgtacacttcttctatcgtatcaacttcatgtaccatgatatgctcgccattaatatgcactaaagctaacttgctagcctgccgcaattttattgttgcagcaaaacaatagtggtggattaacccatcacctcaagtttagcaatacatcctggaccagttatagatatgcattaatccacaacttaaaatgtaaaatatcaaggagctgggccaatccaggcatatgagtcaagaacacagcacttcaaacatatccaaactgaaactggttcttttctctgcctagaaaggtacttaacaatgggttctgaatatcatgttgactgacaggtatgtcatataaagaaggaaatcctcttaaatcttacctccttaaaaatatcaggtttaacagaagagtatgatgtgtagatccctactagatagaagcctgaatacctaacccattatataaatagtatgtattgtatagtatataaaggctgcgattttctgggctgctgcctactttttatgttttactgttgtcttcatgtaaaataactgtatggaaatggtatacctaaagagacaaaacgggtgaaatttaaatcaaccaactaaagaataaacagtataggttaaaaaggatacatgttaacaaaatgatgacacacagcagaataaagaaaatatatgaagaatacacatctgagggcaaaaggctgaggacagttgaaattgatagaatttgtaatgactgaaataaaagcacaagaaagagtagagaagaaacttgaataatattcatagataggaatgaactgtggaaattccaatgccatgataaggcacgatatagaatgattgtatttcttttatccaaaagcttcacgacaggtaaagatagactataatctgaagaacaaatagacctaatttccattataggccccgaaagtgaccaatagtgatacttataatatttaagaaagcaactgggcacttaactttagattataccatttaaatttttttcaacttgggaaaatgtttcaaattccactttgctacctacttgctttattttttaaaaaattagaaaaatgccatgtaaatcactgtagatagtattgcattgcttgtttgaaaaaaaaaaaagttgacagtttgatagtgcattcattcttatgcctccagcactgaatcaaccactataacattcaaaccaagaggaaactttcagcagtcttgatgctgtctcctactctgaagtgtgagtctcttttctacaaagagcacatgcttagggaggaaaacaggatatgaaattacacaaaaatatgtgccccagcattcagaaagaaagcaggtaaaagcttaattctcctccaaaaaaagcagtttctaaatgtggattcattaatgaaaacttacaacctagcagtcagcagaagcatttaggaatggaaggcatacagtacaatgccaactattagaatcagtgttctactaccacacaactattctagcttagctaacagtcttttttgtcacgacttttgtttctttttcctttgtttcctctgttttcaatcgggagagaactgtgtgaagctgagtgttcgtttaagtcagaaacacgttggctagatctaggttcagtgtgggtgagtactgtgtaagcattccacacacctccactaatatgccacgaactctccatatcccaagctttctgataggattcagttgagactacacatagcgcttttacttatgtcacacatgtgatctcaggtctcagcacgtactgacataggtagttaccatcaaacttgctcttctcataaatcctgagaaaaaaaggtaggttggaggtagaaaatggacagaatgtctctgctaacctaaacagaactagtatgtgttgctgctaaaatattccaatagctggcagcaatgatccataacattatatttgtaatataagtatacataaacactacaacagatgatctcagattgtcattgataatgatgatggctaactttttttagtatgttacttgtaccaagcattgctctatgtactatacatctcatttaatcctcatatacaaaaaaaaaaaaatattcttgggtaaagttattttcattttcattttacacaaaaggacattgagatacagaaagaaactgaataaattgattttaacatatttaacttatttaaagttaaaacatgaaattatttactaaccctttgatgtaggaccaatggctgtcactgactcttgatctgctatataaagtttcatgttttccttcttgcttaaactacaccatgatgtatcacctatgatttcctgttttggtttatttaaactcaatgacagcttaaaggtacttggaaagcaaactgaatgagggatccttccagctttttacattttttcacccctacctcaggcaatctttcacagttgtctagcccacacctttttaaactgcaatttgttttagcaactcacctttaaaaagtctttccaaagcaccaacttaaatttcataaaatcaacaactctttatatttttgaactcatattttatcagtttgcataattaaattacaattgcacattcatttggcataaacaaattcaaaaacaaacacaaatgactgtagataagcatggcagcaggtaaacagatgaacagaaacacaccattttttcagagtattctgttggccagaagcaggaataacctaagagggagtctactgtatacctaccatttcctaattataaacaatactatttaataggtatattagctttctggaagaatggatttaccatggaaaaatacaaacaaatttagcagggaggttcacaatgataccaaaattctacactagaaaagtaatacattccttcttatctttctttaattagaaattgtaggagacttcttcactgacaaaaactaagagcacaaaattccaccccaaactcaattcagcataagaagactcctacccaaagcataaacatatatactcacataaaaaataaaaaaaacttttaaaattaataaagaaattaaggttttaagaaagaaactttctccctactagagaaaaccatcacctcttggtggggaaaactgaatttaaagttcaggttcgggcagttactacttatgtgatggagtaaatcaattcacctcactgagctatagtatccttttctgaaaaaaaaaagataataataatggttctctcctcacaaaactgtagtcagaattatataaaataaaatatataaagacactctgcaaactatcaatcatcttatacatataaattgttattactggaaatcctagcttatattttggacagagaatttcagagtcaagggaagtcatttcacaaatgacaaggctgtgattcaaaagcctaaattactttcctacttacagtggcatggatgacggagcagaaatagagaattcttgattaaccaggagaagaatatcataggcatgggtgtgagatcaactggagattcaaggaagctaaagtgcccagaatgaactaatgttgtaatgtagactgtgagcagagataaaattccagaagccaaggagtgttgtacggtaagtcctggcagtgc

SEQ ID NO: 125 - DNA, 809182 bp, Homo sapiens
ttttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaactgtccagataatagagaactgctcaccatcctcagaagcaattcatgtcctgtctcaccctctctaatggttcttcggactcctttttccggagctgagaaaccctaaaacatagcacccgtttacgtctagacatgcacaggtgctgtgaattgaccccatttttgcagttcatagtttattaaggaggaaagaataagccctgtcataattagttgaaaatacattttgaggctgtataaaaagaattataaacatggcacatctgagggcaagtcttttcaagcctctgtggcgatgcactattccctggagcctttagagggcagcagcacactggctgactccagcggatttcagagaggcgaactcccgaccagaaccttcctcctggtcaccatgccaaaggttgatttgccaggctctggcctctcagtctctttcttttcagttctcattctctctctctctctctctctctctctcattctctctctctctctctcattttctctctctctctctctccaaccccttcctcctctctctctgttaaaattatacactctgatgaagtcgcccctcaaccggaaaatgaaagctccaatgaaaaagttagacaagccaacaacaacaaagaaagaaaccagggaaaaaggaaaagggggctggtgacagggaaggacttaagaataagaaaagggcagatgtttcgcaaatatatgcaaagcaaaactgggtgtaccctgaacacttccacagagaaacagaccaatcattgtgcacttcctcccgccacactggtggagctctgcattcaaaaaaagaaaaaaaaaaaaggcaaaaaagcgtggccgcaggcacccgcctttcaacggtcagttctgacattctgactgaacatctctcaattgtccaaggagaacaaaaacattttcatctcctcactgcaaacatttctgttatgagaaaaggctgcttcaagaattgggagtgtgttttaaggagactggcggccgagttagccagcagagccttctggtttttaactctcattgtgctggccccagcaagaagttttaggctgaaacatagcagtgagtaaggctgtggaggatgttggctctttcctaactagaccatattgtatgtggaaagaaatatgcattaaaacatattgatgatatggtaggtattaagcatgttaaatgcatggaaattaaccagatcggcggcatttgatgtatatatttcacactcttttgcacatattgcacacatacagtgatggcaatgctttctgcaacatatggaaaaataaatattttatctgtgtgagctcttagcagtctccagggtgttgagagtgctctcttctttcaccctatcccaattttctctcttcactgggctcccaccctctcttgcacgttaatgtgccttttacttatcagcttggtcttttcctatctggtaagtaatgtgcctgttacttatcagataggaaaaaattagttggaacctcctattggctcatgataatttagaccagtgatgcctcccccaatcttactggagtcgtaacaatttccctactcttttccccaacaatacattaaataggcttagtatctgggcaggagagaaagggtaggtggtaacaaaccaccccaataagggtggtagcggaactgcgctccactacctattagctgtatgtcctgggtagattactccgcatctctgagcctcattttcctcatctgtaaaatgggaataataatacctaccgcttagggttattgtgaggaacaaatgagataagccatgtaaagtgatttgccttgtgctggcacatggtaagagctcaataatggtagttcctctcatagggattgttagttctgtgatattcatcatgttagctttaagaagacatttccgggcaaggggtggtagctcatgcctgtaatcccagtactttgggaagtcgaggcgggcggatcacgaggtcaagtgatcgagacaatcctggccaacatggtgaaatcctgtctctaccaaaaattcaaaaattagctgggcatggtggtgcatgcctgtagtcccagctactcaggaggctgaggcaggagaattgcttgaacccgggagtgcagaggttgcagtgagccgagatggcgccactgcactgcagcctggagcaagaaaaaaacaaaagaaaaagaagacatttcccttcatttcagtaatctgtttagatatctagattttgggtaggggcaaatggattgttattgtagcaaaggcagaaacaatgttaggaccagcaatctcttcctcaacatttgatcttgctgtatacttcctgacatctcctttctgctcacatgtttgtcattgctgtggctacactacaccatgagctccttgaagctgagggttgagcaagctgcacttagcctatagaagcccatcaagcctggacactatggtctattcattgagaccaacctatgggactctggcttatcgtgttttcttgcaatttatcatttctctacctggtctgatgtcctcacatcaatttaagatattttagtgattaaacacattttattttctcaatcttattttttttaaccttggcagggctgatttataatttttttttcagtataatttcctcttaactgtatcagtcaggatcctggcaaaaatagatggcacatgcaaagtttttagctaaagaggatttaatgaaaaaactgtatttggagctgcagatgaggttaagggacctcaagagagatagcaccaggtactagcaatagtagagactgccaggtactagcagtagtggaaagctttaaaccatttaaactgaaggggcaagtaaaatggtgatgaattctgagtccagtcagaattggagttgggaaggagggctgaactaacacatttcctgacctctctcttcccccactttcacatctcctgctgatgtctccttttggccaaattcaaagggaagcccaaggacaagagagcctgggtaatgtagtccagaaggccagtcttctgggtcacacatcagggcaaaagaatggttctggggtttttttgggggtagaatggggtggcaagactaatcaacatatgtgttcttctctcttatactttcaattatactttctggaaggaaagacagaacaaaataaaataggttctgtcttagcttccatgtacctattatgtcgaattgccattcacagagcaagaaaagagaatgctgctcagccgagcagggatttttgtttgttttgcttgctgccatattcctagttcctagaacagtgtctggcacatagtaaatggtcagcaaattttaaatgactgagtaaatatactcacctctgccgtgacagactttatatatatatcatctcattgacttatcacaataatctggttaagtaggcagggccactgagcattattgtgcaggtggtatggggggggtgggtaggtattaaaatttaatatgtgcctccccaacccacttccaagccttgtgactaggcccgaagcattgtcaacccaccagaagagatatacttctgtaaatgattcacattttaattttttatcctctttattgatttttgcacctagcaagtttctgttttattattattatttctcttttatgcattggaaagccaagtttctgaatagcaaagactgcaaagattataacccagtctgtccattctctagggcccatgagaagtaaaagcaggcactggcattctgcacagatgaaatacttcctacgacaggaatacatgctcacttgtggacttctctgtaatctgtaggcaacatcagctcctgatttctaggtctggatctgggttctctgtagcacaggaaggtaagagtgataagaactcttttccctcttaaaggatatagaaacttttaaacccatctgcatcatagtaaggctgtgttatctgtatcagcatagttactctgtgatgaagaaaaactcagaaaactatccagatgtgggaatttctcgggtattccttgcacttgaacttaaggatgaatgaaggtatatacaagtaagttccttgtgtgggtgtggactgaagaaactatgtttgatcttctgtcatgtctttagtccccagtaactcagtcctattagtactatagaacacattcccctccgggaaaggcaggcctgtctatcacctacacagcagcccccatcaactatgattcagttgactggaagcattaaaggtaaaaaagcaacacaaaataaagcaaaactctggcttcatccctttaggtttgatttataccagaatagctaaagacatagaaatatgaatgtaaatatcctacctgaagcctaagagggatgttagtctcccaggtttagcgttttccagtaacatagaagtctgtaaaacaccatcccattacctgcctcataacatataggaaaacttgtgaatataacaactagttattgttttaaaatgtgtaattaagttactttgcatgcagaacttctaaataattcaaatgactggcttttctattggaaaatagcatatattcatctgttatttcagcaatgattaatgaatacttgatatcaaactttcatcagtattttcccataggtatcatatcccctaccccaaattatttctgtacttttccttgcaaggtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgtgtattaaacaaagtgaactaagaagccttttattggagacataatgtactcacagtagtttcaaaatcaatggtgtcactcttcaggtaaattactccaaggcttgggcctagtgcagatgttcattggggcagggagcagagagcggctgcatctagatcagacaaaaaacaaaaataaggttgttaaatgaacaggtgatggtgatggcaattatttattttgataggaaagaactttgggacttgagtgagaggttggttgtttggttctacatctttgcaccagagaatggcgaggtacggaagggagaatggagaggatgttgtccaggctccattttcagtgctttcacctaactgcctgtgcagcctgggacatcaacagtaccctgtcagtgcgggcggagctgattttgtggttctgacttagaagctgagttgtgggtgacagtgggggaaggaagtagaaacagtgtccttcaaccttcccacagttgattcttctagtatccttttcttttttttttcatttattatatttatttattttttattcacacataaaaattgtatatatttatggtataaaacatgttttgatacatgtatacattgtggaatggctaaatcaaactaattaaaatatgcattaccggctgggtgtgctggctcacacctgtaatcccagcactttgggaggccgaggtgtgaggatcacgaggtcaggagatcgagaccatcccagccaacacagtgaaaccccgtctctactaaaatgcaaaaaaattagccaggcgtgatggcgcacgcctgtagtcccagctactcaggaggctgaggcaggggaatcgcttgaacccgggaggcggaggttgcagtgagccgagattgcaccactgcactccagcctggcaacagagcaagagtccatctcaaaaaaaaaaaaaaaaaaaaaagaattacctcatgtatttatcactttttcatggtgagaacacgtaaaacctactctcagtaattttcaatatatactacattcttattaacgatagtcatgaggatgtacagtacatctctggagttattcctcctgtctaaccgaaattttgtgtcctttgactgatgtctcctcagcgtctggcagccaccattctaatttttgcttctataaattaagcttttatagattccccatataagtgaggtcacgtggtatttgtttttctgtgcctggcttttctagtacaaaaaaaagcctattttttccccatatatcatggatgacctctagattcatccatgttcttgcaaatgacaagatttccttctttttgaaggctgaatagtgttccattgtgtacttttaccacatttctgatattcttgatttcatttcagtctctctctttattgcttagttcttaatgtattctagtgacacccattgatctgggcatgttctgagcattccctctgtccttcactgcaaaggctccattttcttccataggctctaaccctgaggacaccgaattaccctattttttcccctatacctcagtctgctattctgccttcttcactggcttattttctttcttctgttctctaaatgtagacattcctctagatcctctcctcaggctttgtctaccccagtcctccctgacctcaacaatcacttctccatggagagcatccacattgctatctttagttctagcttttctacagagctgcacacccacattctaaataacagctggttattggttcattcgttcctttgtccattcattcagtgtttatatagcatctatgaggcacctggatgaatacaacagggtctctaactttgagaagttcacatcgccatcaaatactacacaggcttttctaattcagaaagtttagaacttaattcattgtctttcctttaaaatctgttccttctctagacgtcccatttcctgccattggtattctcttcatccagttacgtgggcctacagctggggagtcatcttcaattcttccgttttttttttcttcctatatccaattagctacccaatcctgtagattctactctgattgtgattcctgaatcaatacctgttttctataccagcccctatttctccctttgctacctactgtgaggacatctatgaaaagctcctgactggtttcacttttccagtttttctttacctcttgtccatccttcacacaaacattacattaatttttctaaagtgcccttctaaacatatcacttctttgcttacagtcctccttgcttattggattaaattcaaacttctcagtttggtattcaaagctgctacaatgtagcccaatctagtttctcactcttatctctacactccattctacgctccagcaaagtcctactctttcctaccatgttcatggtatttcttcctttctttcaatgtctacatgtagcttcttcaagggccatccaaatgccacctcatttatgaagcatttcacaaaggagagtgcccttcttaaatattattagcacattctgtactactccctttgcatattctaccaattagaatggttatttgtgtaatttgtcttccttcttcataagccctttgaaagctgagacaatttttactctgagtaccctatagtgggccatgacttcttgcacgttaagtttgcactaggctgataatctgctgaactgaatttaaaaagaataaaccctcttgccttgagtcatagaaacggggactaaattgaaaagacctaaaagctcatctgcttcaaccccctcatttttcagacgaagagatgaagggaactgacttgctcaaggtcgcatccttgttagtggctgggcaaggataacagacataaaaggccacagactaatatttatcagtgcttacttggcaccaataggcccaacagatcatcagtaatgacaagaccagagagagggaggttggggtgtgtaacctgcaaaaatatattgtgttccaaaatataacaaatttgcttcatttatttgcttcaacaaaccgaactaataaatatgttttatagttaaatgttgtctaaaaaatgagggtggatttaaaaaacaaggaagcaaagttttctaacattaccagcagaaataattatgacaatactgtcaacaccactggggaggaggtgcggatggttaatgggtacaaaaaatagaaagaatgaatacgacctactatttgatagcacaacagagtgactatagtcaataataacttaatcgtacattttaaaataactaaaagagggtaattggattgtttgtaacacaaaagataaatgcttaagaggatatatgccccgttctccatgatgggattatttcacacggcatgcctatatcaaaacatctcatgtaccccagaaatatatacacctactatgtacccacaaaaattaaaaacaaataaaatgttaaaaataccactggggtgataaactcaggctgaaaataagaataaagaaatttctcatgctttggaaaagctgtgtgttcagctggagttcttggtgaaaacatgcagtaattccgtggttaaattcattactttgtagaaacaaactattggcaatctgctattatgccacattaacacttctttttccacctagcttagcctagtactcattctctaggtttgtttaaatgtttacttgtttttctttccttatattactaatttacttgtagaaatgcatagacaattgcctctgagtctgttcaaattttcttgccttgttcttctcttgtagtagaggaaacattagttgtttctcttctctatccttatcctcaaacagaatcattttctctcacccaaagatgaaaagcccaacaaaacatgctgtggggataatagtgtttacctaggtgaggaaaacagacttttccagggaatctcagtaattattacttggccagaaaagctcagctcttaaatgttagctccaatactacaagacctcatctgcatctcccaggtgagcgcttgactcactgttactcaccagaggaaaaccttggtaggtagcattaatcaaactctttttggccagtatggtggagccatgctacgcattgagacatccattaaatagcatcaccccagcagccacacaaacagcaaaatgggctcaagagctcttcattgttctttctaacccatcataaggctggacagattattgacacttcaccagatagaacttacttctccttttgccccctggcaactacattaaaatcataaaggaaatcactcatcaatagtacattgcagtgaaaaattatctggcaaatttacaaatcctttgtgtaattatataaatgtacattttaaatatatctaaaatctgatttacattgtgcattttataattaatacaaccatagtatgtctgtcctttaattaaatccttctttctcagtcccacatcctgctgctataatcttactttcatttttggcaaagtgtcacctagctccatcttctttccccttttgccttagtacacacctgagcgtctattaatcagaaccactgcatggtgtgtcatgttttattgcttaaagggtggttacactctaaaaaagattcggtgagaatgacttcatggggtttcacatttattctcttttaatgactttcatatccagtgtactcggtttttaagtcaaaagataattttgaggggctgctgatgccacaaattctccctagaacctgaaaatccagctgttgtctctgcttcttacatcatcactgtaataaagaatctgctcttggaacccagctggcaagtttcttgatggtgtcagaggcgaacagacagtaggtcacttctctacagcccgtttcattgttggcgtttctgcagatctgtcttggaagcccttagagagcagagctgttatgaaatacactgccacatatcaatgtaaggaactttctgcagatgtctactttgagtatggcctgtcccagtcctaggaaatcacaccacatcgttctaaaattatagatggggggttcatgattaaagtttacaagaaaggtaatagtaacaataacagctagcatttattggatgtctaaattttatcagggactgcaccaggcatttttataaatgagtatgttcttgtttaaccctcatagcaatgctatggtgtatgttttagtatacccattttacagataaggaaaagtgagacttaatgggcttacgtaacaggtcgaagtttagaaagctactggatagtgaggccagaatccaaacccagatctctctgagtctaaatctgtactcttttcactatataacaactgttccaatgcagcatggacacgggacacatttctagttcccgctgtgatcacagtacaaggaagatgcttatttccacgatggttcagagccactggaaagatctgggagcacagactccaggagaaggaactatttcagaaactgccaataagtatagtcccttccctcctcctttctaattgcagatgagaatgtcctctaacagtcttctcaaactctaatgaacaaacgaatcacccagggcttctgattcagcatgtctggggtggagcttgtgatcctgcatttctgagaagctcccaggtgatgctgatgctactggtctgggaccacaggtcttatttctgacactctcctttctactagggttgtttttgaaggagcagttcaagccaaataacttggctaacagttcacacagccagccgactggcttctgattctaggccagtttgtcaggtcatcaggcattacacagaattcaaggagttcttagcatagagcacactgtcaaaaaattgtttttagatccccaagggttttcccctctctctggaaattcaaaatgataatgtctctaacatgtaaagttcctatttttttacattattgttatttttaacaataattatctggtaataattcaaataacaccttccctctgagaaattcaatgagctttactaaccttaattgtctaacagcaattcccaggtgaagataaagctgtctcaaagatcatagtaaatttaaaattgttccacttccctcgtttctttgccccaaatgtagtggtgagttagtggggacgggttactaattggcaaaggcccactatcataatttgaggcacagcaaatttcataaaaaggatacatctaagaaatatttagcagagaggtcattgtggggaatacaatgttagaaaaaaaagagttagaaagtgtaagataagaaaagagaaagcaaaatcaggactagctgatgacctccgatgagacatttaacctctaggtggctcagcttttctatctgcaaaaagaggaggttggttttatgatttttaaggtcccttaaaactctaatagtcccctgagaaggaagatgtgggaattaagtagctcatcaacctgttaaaccattaaacatgttaaggaagtctatttgacttttaactttttagctaattacccgaaacaaattcccaagtctacgtcaccagccccacctctctggaaagtggtgagaaaaccatttaatgaataaggcaccaaagacatcacggccagataaactaatcaggaacaccatcgtcagcttactgatgctgtgataactattttactttttaggttttagttccttaattaaccactagttaatacccatgtccataagaaacacctctgatggcttgaagacccctgggatggccctgccaacacaaggtggaatcacaatcccactgtttgtcacattaaatctatgttaattttctccatagagacctcttgattcctctttgacagttcataaactctgttaatataagttgcacatcccatgccatgagcgttagcattatcagatacagttgattcttgtttaaaataagagatcttttggatcagagtacatgtaaacacacacacccacacacccacacacacaatcatgaatttctggtattaatgaatctggcctggtgatgggaacccctctattatgtcaccggatactggaaccttcttatccagaaagcctgccacaggtcatgttaataagatcgttttaaactttgtaatgagaattctaacatgagcatgatttatgacacagcattttatttggtattatcagagtttcctataccttacctcttacagtgagtatgtgttctgaattaaccattatagtttgtggtaaatggaaaaaaaggtacagagaaacatcacagtggcattactccagataacacactctgtcactgttcccaaagtgaacatcatttccctcttcctgctcccatcacttcaatagtaactttggctattactgactaaatgcttaccgtgtggcaggcattgagccttttcacagataactttattttcttacaattactctttgaagttgggaattatattcccattttatagacgaaggaggtgaaactgatactcaggaaaggtacagttattggtcatcagtcatgaaggcagagggtagcaaagcagagttaagggccaggttctaaccacatgttctagagcttaacctataccaggctcacaatcaccaaaccactgatctgccttcattccactcctcttcatttgtgatccccaccattggcttaggctagattcttcttcatggctctctcatgtcttcttgaatatttcttgaaatttctcaaaaccttctacacttgatttatgttttccctccctgtattaataatttaatccaaaaactcattaacacttcttttcaacagactttatcaccccttttcttagctctcatactccttctaaattactcttttgaggcctcacatttgacatcagatgttccacacccagctattgaactcactttcccagaagcccaaggaacctattgttttcagctggttcattagtaggccccagttggccttaccagatgtatttgtccagtttgatcttgccccatgatcaaccatttcaacactgtcctcagtaaccatgcagatttccttccttttctaactttctatgtgcagtgcctccttttacattcatcaactgtgaatctgtatcaccattctccatttgctcccactctcagaacaaaaggctacacatgcatgctacctggacctatgctcctgcccactgtttccaggtacaacctatggcagtttttcttagtttgttctcctttatgaagtcccattctctttttcagttgatgagctagcatcctagtttaataaaaggatctacaccatgcagtgtggtaagcttattagctctcatctcctctaatatctctgaattttcattattttatttcctcaggatatatcttttcccatgttcccttcgtatcttgaaggttattctctctacttctctttatcttcctttggtttcatcagggatactttctctgtagctgatagcatatcaatttctaatagtactagattaatcatcaccacataccttttttttttttgtcccgcattcaactcctgcccttcaaaaatcttttcagatggtgtatcttaaagtgtgtttcatactggaacttcaagatgcatctcaaaaaaagttcctcagtcaagtaagtttaggaaacactgaaaactatatattctattttcaaactcgcaagtgtacacaggatattaaggtgctggaagcctaatctttgtccaggcttaccggattacagactcccccatccccctttttaatggaacacttatttaacctcagaatatgcttcgggaaaagatgctttaagggattcccctggttccaaactcttaagcctgggctcggaaattcactgactccctatcaaatgagtcctctcagatttcctttccattaatactccacatggtctaaactggttaacttatagggtgtcagaaagactaagcacatttctatctctgagctactgtatataccagtttggctgcttggaatacctttatcacctttcaaaaaattatataggacttttttctccttcagggtccatatataaaaatgtatcctttatgaaattttcccttgtgaagactgctttagcccataatgttttctgccactttttaagtacttcaataaatggttatggtttactgcctgtttgctatattattagcgagggtgtacatcctcttgggtaggaaccttgttttatacactacagagaccccagctttttgagcacagtaggatgttataaccatgtcatcggttaatataaacagaaatggatggcattaagacatgatggtttaaaacccaatttctgtagctattggaatagtttaagatgctaacagcccaggtgaaatgttccatcacaatattgggaagaaacactacccgccatcactgccattgccctgaaaatgataccatgtgtgtctaaggatgtggataaaggctagatacagaagagcaaaggcagctccgttcttaggtgaaagtaagaatttgcattagttaacaccaaatggcgataagattaaaataatctaggaacatcaagtgatccatgaaaggaatcactggaatataccaatggtaaaattaccattcataatcattaaatcatggtaacttgatgaaaagaaaaaggatattttcctacttaaggaagtcagggtaagtattgtctgaggttccactgtgtgctattgtgcctggtatacagaatgtgtagcaactatttacagaatctgctactgccttctagtcacattccaaattctatctctttgaatcagtctggagacacaatacattggtgaattcaaggcagcttggcaacgactggcacaacataaaaccccaaataatgaattccatctttcccataaagctcttttattgacacaacatacaacagcgcagggcaggttgtctcgggctagtgtgtaataactagatgttaaggggccctgagtttttcagattagatgttatctgaagttgggactcagcaggttccctaacagtgaatttttagtgggcctacgactagaagtttggtctcttgatgcttagtcagggagttttattatgtgagagagaaaagtatagctttctttcttaaaactgcagcaatttcatattttagcagaagagaaagtgcattttattagagtataacctgtggagtattttgctaccttcctggatataaagcggtatacaaacaaaaaatttaataaaaagctattttataaataagaatgtttacttgtgtttaccttaaaataggtatagcttgtattatttaacatgtgaaatagaaggataatggtaaaatttcataaatataaaattctgtgtccgtcttcagttaaaattcgtaacagtgtatcagagtgttggttattagtagtaatcaataataagtattttttaaattggaatttttattgcaggagattattgggtgggtgaagctaaatggcctagatgttttcctgtcatgtcaatacttaagaattgtctttctgggcaatttacacatgtgagagtgaaaatgaagggtggcctgcctattgggtgtgtaacaggccaccggggcaagactgctattttctgagagccatgggcagtttctgcaataaagtatctgagtttcttctttttgtagtaaaaataaatagtttacttttatgttctgggtgaagcctgagatctctggatctctttgctggatttcactcttggtgggggcagggagatactattggcaatgctttatatatattgacctagacatgttaaagattatgtggtactttcatgaacactctaaaaatgagttctccctatcatgagttgcatagatgaggagattgaggtggatggggtgaagaggaaggaaagggcagtttaagcgggctagctaatgagtagtagaacttaatctaaaaccaagattttcagcagaaaatgctttttttccccaaaaaatgccatggttgtcaacaagctttgtagcaaatctggggcagagcactagatggagaatcagaagatctgccttgtcttcctggatctggtaagaaccagccgtgtgaccatggccaagtcactaacttttgtgagtcttattgttctcacttataaagtcatgagcaaggaatcaatgaatggcataatacttgtaagctgtaaaatctctctcttgtaaaatggtattgacaataatgtatgctttgcctatcttataaagttgtgaggctaaaataagctgatccatgtggaagtgctttgtatagtgtggagtactgaatcaatgttgtctggaagatttaggaaagggtcccgaatgtgtgtgggaactgacagccagtccacttccattcaggttttaggagaagctataataaagcactggcagcagctcaaatcccactccatcctctcctctcccagcacgctgcagagaatcacttgaggaaagttacttgagtgggtgagccaaatgctcaagttccaacctttctgagtagaagccacagtgaatcctgagccacaacacaggtgacaatcactgttcctccaggtgtgtctgaaacactgggggaccctagggaaggaggtcagacgtcactgctcctgaggacccgttttctcctgtacacagctccagcccacatgatttcacctggcagccccaagagacaaaaaggatccagaattagcaggagcctcctctcctgataacctaagtgctctgattgaaaggcagagggtatcaggagaatggctgtaccgagtcggcattgatttctccagcctttgtctgtgtctggtttctgtctcgtttggaggtggttactgttactacaagcagcatgaatcatgtctctgttaaaaaacagagcttcaattgtcttacataacccctggtaactgaacgtctaataatagcaagccatttccaggtagggaatctgtctacctcccagacacacacacacacacacacacacacacacacacactactcccaatgcttcacagcacagtgagacagacagggaggagacagaaggagaaaggggacagcacaattgaatttttttgtgttttaaaatatattgaataatcatgcatcatgggatctgataaccaatatacttagctgagctagtttaataaactgtagaaaacaagaattcttctttaaagtatttgaaagtatcccaatccataccagacagacaccttctctaacactcttatactgcataaaaaccccaaacccccaaaacagagtggggtgaaaatttcactggattgtctgctagcttgtaccaactagcttcaactttcaaaggattttttttgtcctcttttttgtttgaccagagagtgatattccaaaggttcttggccgagatcatttcataaaattccagagagtgaaaggcaactgaaaacatggctgcagtgttccaccatgcagactatgtaatgtcaggcacttttgcccgagccactttctttgacggagatgactttccatctgaggacttacatttttcccatgagtacactctctggcttgtaatacatgatgaggtctttttatacttgatccccactcagctacccattaaggtggctactgaaataaaaaaaaataataggagaggctgaaaaatgatttttgaaaaatcacaaaggtaggattttctttaaactaccaatttgtttgagaacaaatacaaatgctggataggaagtttaaaagtttatggggaataataatataaatgtataacatatatacgtccatttcctcactgcttcaccttgcccatgctaggaaaaatcacttaaaggctgtattttttgagtgtgcattctcagagtgaagtagctgtacatatcatgtaaattggactggggaaggacttcgcagaaaattacagatggcaatcacatcctgccagtcatttggtctagaaccagagaagaaaaactttcttttctcttttgattgttcagtaacatgaaacagtggactagactagttcaaaccaaagaatgttttagggcacacccactttgaggaccagcacctggctatgctacatgctcttcaattgtttaggcatataaaaaggagtgatgagatggttatatgtcaaaatggctgttctccctccaaacaggatttgattggcttatttgcttttggagtactctccaaatccataaacaaaggagtattgaattgaagaagcaaacaggagaaagaaaaaggctaaaaaggaaaagagagaagaagaggaaggaaaaatactaatttctcagtattcctatctgcaaatctggctggatttgataacaaaactcctactactgttctctaatggtctttgctgcatgccatatggacatggcttctaaaggggatgaattctaggttttcctcacaaatatccaagcacagaacagcagggatcttgacgactaaatcatcctaactcacgacgaggatcacagaggtggaacatggctgttgggactagattcttctgcttatttcatgtgctttgtgaattaaattgttcgtagagttggaaagctggtggactaaatgttttaataaaaacagccatgagacacaacagttttcttcacaaaggctttcccccctagctactgtgaatatattgctgaatggttctgacttctggaagggcaggaggtttgcctcttctctttgcctcaaaaaccaggcttattctatgcatctgggagatgattatacttacccgaaatttcaggatactatgtcagacagttccttcacagtggtgtgtctggcacctaagcaaggacttggtgggccagacacatttaaaatgtaaaagtggatgattatattattttgcattgtaacaatgagagtatttctggattgtagctgacgtgtagatcatcataaccatatgtggcacaacaaaccacacaacattgcatcagaagcttgtagttaatatttttaaatgattgattattttgaaatagagaaatggtggatgcttttttcgacctctttaaataaccacttattgaatgtctattgtcagtgatggactctttcttcacagaagggagctgggctatgccagactctcaccatgttctttctcctctaacactgaacaaaatatcagtaaaacaccaagtacagctggttttgaacctagtaagaaatcagtctgtagtaatgggccatattggtaataattggaactggtgatatcgatagcagtgggaataactgacttacaaaggcacagcagttcaggaacgtctcagggactcagagtgggtaaatgcgtaaatctgctctcacctatttatatgctccaacaaatatctggaactctagaaacttcaagagtctaatatgatcaggccacgtttataggtattataggattcatataaaataaggaggcatacatgttgatctagtgagcgtctccatatttgtacaacactcaggatatgtctgagaacacattttaatttttagaatcagctatagaatctggcagttattataaagcaaacttcacttcaaaaaaattaactgagaagccagatgataatccagatatacaaaacaacattggtgggataagtcaaataattctctaaaatgattatggagaaactgaagaaatgaagggcacctatttatcatatgtgggtccccagccacgtttgtaatctgttgtgtgaccttgggcaagtcatgaaacttctctcgagtctcatttttctcatatataatgtgggagtgttagattagatggtttttaagattctttccagtaataacatttgatgattctaaagtaagaagagatgaaagagtaattcctctttcctcttgttttggtaaatacttgctttctcctgctccgtgcctatgcagtttgcagtgagtattaggtttctggactcaagaagtcaaatagtaaatactgaagctatttttccttgtacacatggacaaatcataggggaataatccttcctttctttgtatatcagtgtctcttctcaaatcagacttatgcctaaggtaatcacgatcattctggtactaataaagatttttcctcatccttcccacaaggccctcacccatgctcatgaaagcttatgtgattgggttatttctatatttatgtcttggctattttttctctttcaacttgtttatgaagtccctggtaagcataaagctgcaaaaacaaaaacaaacaaataaaacaaaacagctctgtttgaataatttacttcagttgaagcagtataagaaaacatcctaacgccgaggggaagaaaacaggtcataaaaataccctggtatcttagaaaagactaaataaaagcttatatcaataatagtttcatatgttattgtctttcattttcaaagagaatggtacatattggctttatagtctggtgtacagacgtggctatttttccccatagctctcaggtcagtgcatcctcaaagccaagaaggcccagagcctgccgagctagctttacataaacaaaggagctacacagaaaacccaatacccggagcttatatcatatcctgactaggcactctggttacccatgactcgctcttttccatctgtgccctgattctctgctggtttaattcccttcacctagaatgccctcagtttgcctccttttactgctcagaattccctctggacacaactcacgactagcataagccccatttccaagaagcagcttagtttgacccaacttagtttgacccagcgaaaattttcatggatagcaagtgaaaattagtccttgtgataactggagtcactgaaaccaggtatctaggaagcactcagagaataccagagaaaaactttcaagggttgcagtgtcctcataggaggaaaaaaaaaatcctagctttaagaacaagcccaatatagaagctgtggtatgtaagagaaaagttgtagccatgtacgggaggaattgtgttaaaacagtctgactttttttttccaataaaggagaagagatcctctgtttcttaaaagaagtttagtcattggatatagcaacatacagtgtcataaagtttaattgcattaattatgaagctaaaatgtctacattttagtagagagaacatggggcatagctaaatggcgaagacataggaatgtgtatacaatttgagtttcacttcctccaaatctctcagttagaggatccctctcagtctgacggtcttatcatcaacagcttcacaaactctgacaacacctggctgggtttaagggatgggccatgatatatcttgagagtaaaagatggaatgaaactcagaaatgctgaatgcttttatatatgtatacaattttatttatgtgtatatttatatatcaatatatacaaacatatatatttgtatgatgtttggcaacctcactcatggtattcctgtgaagtaggcatgtggtaaacataattagcccattaaacagatggtagggctctggcatatctcaccatattctaaaatggtggagctgtaagcagggactaaagagagtgtagtttgatacatggctaactgcaaatctctgtgaattgctactttcctaaagacaatctgggtaggctgcatttggctgagaactggggatagtttaggaagctttaaaaatatacaaagggacaacttttcacattcattcagatatagtatcttcatttttacttactagaggcatttttttttaaaaaacagctttttatcttaactcatctgtgttccaagcaaacttccaaattgctgagcagattaaaaaaaaaaaccctacatgccaagtagaaacactgggtaaatgttattttttaaaattgtcttaacaaagtgcacttttggaaaggataaagttgaaaagacgtttggtactgtaaacacttagctgtcattgtagcacagtgaccaaatacgtccaaaagcacatgtaatgaacttttatccgactgaattatatgaccatggcattgccactctatagtacagcaggcttcagagatcctgttattaaatattctagcctaattctttatcatttgaaataggatctagcagaagtgaaagagttactaaaattaagacttgaatttacaagtgtgtttgaactggcttcaggaagacatgaaacatcaatacatctggagaatagaacttgcaattgactgttctttaccatctggtctcaagaacattttctgcttggaagttgcataagcaatgaaaaaacacacaaacaacttcctgtaccatgtttttggtcacttataatgacgcattacaaagtaaaccagctaaatatgagcaactgcgccttactcgagatgacaacatacattatataactaagatcaatgaaaaagaacatctttattttaagagacctggacttaaaatattcaagaataaacatccttccttctaaggtgtttgtactccttctaaggtgtttgtactgagtagttttggctagacaggtttgtagagtcactactacaaaacaatccctatattttttcaaactgaaaaaggatataaaaaagcaagctatattgaggaataaaatgttccatatattttaaaatgttttttaatgacataaacttgcctttttaagcagtaaaatatattctacacatgtttttcatagaaaacttttacatatctttgttttcttaaacacagtatgttgatgtaatttaatttttttctatgatacagggtcatccttgtgactattcattgttcctgttttacaggaatacacttttcttacttgtggtgagaactggcctcatcccttggctcagcctaacggccacagactgagctatagcccactagccactgccatagccaactggcgtcactgtcccagtttttcagacccatcgcctctaaatcctctctgctaaatgtattttctaatgtgctttggattagaaaatcaaataaataagaactgtagagacaatactgcttgaatgcagggtttggtagaagatttgggggaaactcatttggacacttgaaggtcttcagttacttctttgctcagggttgtaactcagagatctgaactaccagaaagtggattttgaggtattattgtgtaacacagagtgaaacatttatgcacttttattgcaaggcttcttattttaaacagggttgtccagaaatccattcttgattactttacttgataggtctctgatccattatatttcactcccttgatttcctccagcaatgtaactaacataatgacaattgggaagtaaagaaatagcacatttttaggataaggtgagagagtcttggtaactgacttcatcatagtgatggaggcaaaaatatacagtcaagttagaaaacttccctggactgctaatgggaactctggcctgactagacactgggaaaacattaaaaactgtgaagttatttacattaattttcagtgttcagagaagtaacatctgatcatcttttttcctcttctccaaaaggagaagtcagaataattcgcaatctgtgataggatagggattgtatcgaaatttgcctttttattacctctgaaaataggatttctaagcaaactaataaccttaaaactgttgggaggaaggatgggggaaaccaaatgtaacctatatgaggggggggaaacatctttaactactttaacatacacacatctgataagttactgaaaattcttatttattttgaagttagtgctgaagaaactctatctgttaaaacttagaaatctcagttcaaagtacatggaaatattccatgatcacgttttcagctcattctagtcgtctgtctcccagtttatttgaactgatgaaattttacaaaataaacttctttagctttctagagttacgtttttacccatgtaatctatttgttaatttttgtagcatgcttatatgataaaaaatactatgtaagtactgagtttgcttgttatggattatttctggatacagagaatttgcaagaaacttcagtttacagcagccaaggttactgcagactaaagcagaagttcaggcataaacttgtcttctaccagttttccacaactttgctgttgacagcatctgaggacatggttgatgagttctgaaaatcattcacaacattgctaatgtttaggaatcttatagctttgccggacctttccataatcacgagagaaaacctttgacgaaattagaacaagtcctcataccctcccttcctttcttctagtgatttttttttttgtattggaacaatcgaaagattcaatgtttttaaattccatagaagactaacgattgaataattttctcacatctctgtttgcactttcgcagtctggttgcattgatttgtgtctcacaagtagacatttcctttgttggtcacaaatcaatgctacagaacaaacctgccagcacattccacccccacccccaattttttgcagtttaaaaacaaagcacatttatatactttttcttttaaaaattactttcattggttagtaatacactaaaagaagacaaagcctcagagttaaaaatccccgggagaaggagctcctctctagctggtctctgattctctcacactgcctggagcaaagaactgcctagtgggagagcagcgctcgtccgccgtccgctcctggtgtgctctgttaacccaattaaggtcctcgccttcatacatcacaaagctgcccaaagcaacacactgtgatgtcacagtcagatatgatttcatggcaggaaaaaaccaaaaaggcagaaaaggttgaacgtactctgcttttattcaaatcttctaagagggggaaaaagggaagacttttttttttttttttttttttttttttctgagagaaaaagagcacaagctttctgacgtgaatgtgaaaactccgttctgaagataccctggtgcttttaccccaagtggataagcatgaataaagaagcacaaagaaacactgtcatcaatcagaatgctcttgcctacacttagctacaggtggaaagcaagcaggcacgatttgatttacctagattaaaagagcaattttctatcttccttttttccttttaaaaatagccaatcgattttggcctagctattgctgactgtacaggtccattttaatacaccactgattaaacggtatgttcatggctgaaggcactacagcaggaacaaacagaagcagctgaaggaagggggtgggggacaggcgagagctccaaaaaacactccacgaaggccacaactactcggcacttcccccgtagacagttgatatagcacattttaggcttgaaccagctataattctgggagtttgaagcctggaattcatttagctttttaattctgaccttaagaataaaaaaaaatcaaagctatgttttttaaaaaacacaaatgagggaaatattgtgtcctaaactgcaatgacatctgaaatgaagatgtgcctcagaaagatgcttcttatgaaacacttgaaatttcataagttatagaattatctactgaaagaggacctagttgtttagagactttgtttagtgaaattgcatgtaaaagaaacagaaagaaaataggacttttatatagggtgactatatgttgggattcatcaggcagctctcagaagagggagaatatctctactagttctagaaaataaccatcttgattatcatgagaaagtatagcctttatcgaagtctgggtggcaggaaaaataaattagggagggaccttctcaggcaactcagagagagacccaacatccagcagatgtttcttctgagaaagacaaggtccatctaacaggtgagacatcagctgaacaatggatgccaggacatgggaagtggctctgagaatcagcgaactccatgtttaaaaagtcaacccactttttttttttctgtttgcttactgattccttgttcccttctctcctgttttctctctccaattatcatttacttaatttgaaattctggccttaatggggacagaaccgtatccagaggtactattaagataagaaaattcaggaagaaagatttaatgaggggcttaggagtttttggaagaggaaaaggacattagagagaaacgagggaaaaactaagaaattaaatatcagcctcagcacggtggctgtagaagaatagcttctgagagacacagatggtctgcattctccagaacaaaaacaaacaggaagtaacagggccagagccccctctccccttcattcctctctccagtgtaaattggaaaaaaactgaaatgtgttcacatcaaaaagttttccttcaaactctagcaagtgaccacagtaaaagaaacaagagagcgctggttccagcaggtaaaatgctgaaaggatgtcacatcgtgggggtgaggaagaaatcagggattaaatacatacagtttggagaaaaatcaggctctatagctaactaatgatgaatggagcagacaggtggcagatttgaggtccggaggagaggaagggctccattttgagccgcccattttctggaggagaggtggtggccgctgtggaaaatggctactcctggggtgcatagggagacaactgacttagtggagggaagggaagaaataaactagggagtcatccagggacacatcgagttagtgagggttttagtttggatgataacaagctcttaaaacatggctttgactcataaaaaatgtagctgggatggatggctacttacagggttaaaagcaaactgagagctcttctattcccaaatctgaatgctgaagtgctgcctagaacagcaaacatgtacatgcaaaatatcaaaaatacacaaagtgggggtgcagaggaggtgcaggatgcaccagtcacctccttccccacacccttcaacagcacagagctctggcagggtcatcaccagtaaaactggattcttacaagccattccacagagagaaaccatcccaggtcccccatggctccaggcatcagtgaggacagttttcatgttccaaaactaattggacagtaaggagtgtctgtaagaataaaagcgggtgggaatggaggatggaaataaaagggaaaaaaagtgtccttgttgaaagttttaaattacaggctcagtaaaaaactggcattccaccacatccggtctagttaccaaatggaaaaatagggtcattaacatgtttatttgaattacattagtccttctctttcatatttaatttattctgttagaaaaaaacacaacgctctgcatgctggtgaaaggcaggggtgtaatggatcagggagctgaaatacaatgatctttacccattatctaccctgctaaggcttttcagaacttactaggatcattcagggattcttccctcacaagggagggaagggtacagaaagatgtaaggtacagatgctactgagtttgttaaaataatattgaagcacatttaaattaaggagtggaaggacgattttaatatggaaagtttacaaaaagaagaaaagtttgggataaatgacctcttctgagactgaatgtccagatgcaaggttggtgctaggcttacggaacatctccacatgatatggaagttgtagaacattgtgttattagtattcggggtattaaaaggcgaagtctgcaggatgatctcatgaggcttgctgtcatccacaagaggtcagggcaacttcagtacaagcaagtataatgcagtacattcaggggaaaatgaaacaaggtatattttcaggaagatgtccagaaatgacctggctatctttgtggcggtgacatggaaaggacatagacttagtatcataaggccagtccctgctctacaacttactaacaccatttgcacaagtaattcaatcagttttcctcatccataaaatgggaacatgaacagttaccatagagttgtgaggatcaactgagacaatctatgtgaaagtgttctataaagcactgtacaaatgtaagacatttattttctgaagacagtggtgccaagtgtgagccaagcagtgtgccaaatatcctcagaaataggattggaaacaaagcagggaatgctctgacaaagctgaagaggacaaggatctcccatctcagtgtgactgggtgtatcgctcactcaaacctgaagggatttctcaccgggatgctgaccttgggttcatagactaactccacagtaggttgccacccactcataatgagtcatttaaagttcaaatcttacttcatgctagcgatgctagcacagaggcaagcagttttaggctttttttggtcacagatttctgctgccattgtcaaaacagtagccccaacctctaactgcaacctagggcagccagcccaacctagacttgattctggtcacttttagtggaacaaattggctcagaaaacatcgccttctacttcttctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttcaaaaaataaataaataaaaagaataggagaacgttcagtattaattaaaataatcatgacataagatgaagatttctatttataatgataaaatccaggcaaggatatggtaaatgtctataaagaaacaaaaggtctgggaaactgactatggatttctttttcaaattctagtatacgtgaactggaagtcatcttactacttttcaaaagaaacaatttatgacaaactaaagaactactttacacagtaggcaatcaacttataaaattcattaaaggtcgatgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaatggcagatttgggatttgaatttaggattatctacttctgaagctctgctaccacactgctgctgttttctgcccagtagcctgatgtattaacagcttaagatgactaatttaacctgttaaagcgatatgaagtcttgctcttcatttgccttgatatctaaactgtgtgtgcagtagcttcttgtcatcaaatcatgtgctcatctatggctttacattaaagatgtctccagctctcattaagagggaacaaaagaagcaaacagatcacgaggaggtaaaaggcatgctgctatggattattatagagtacctcagactataatgtatattaacagaaactcttctctatcaactaatctaaagactcattcttagttttcctaatctaaactcaggtactacaatagaagtaatatccaagaagtgaatgaatatgatgaattccaacaacctccttgctttggtgactctaatgttgaatgggatatcaaaatggaagatgagaaacacaagaaatagctgggttgggggagaagcacgatgaggagaagaaacattagagaagaatccggagtttactttcccagactctaatttaatctgaatgagctttgtttctccacattttgaagaaaatttaagtttagtaataggagattgtgtaatgcaagagtgttgctagcctaaaggctgtgataacatatcttaggagctctgtgtccctcataacaaaagtaacaaacctttcaaaattatttgtggccttgaaatataatacaaaatacctgtatcttaatttctatccttgtaaaatgggaaaagttatttttatatgaaacaacgaatacataaaatactatatatttatataaaatatataaaatataattataaaatatataaaatataaaatgctatatgatagtatataaaatactatatattttatataaaattattatatatgtttacatgtgaataggagctatttgtgagttttattaaaagtctaggtaaaagtaaagtcatctatactcctttctctggggttctcttccctttccttttgtatatttttgctcccctttctctgccgcccccccgcacccacccaggattttaaccacagatgtaatgggtttctgtaacactggcaactcatagctttcacaaatgttcccttggctagggaccacccaaatagtgaccaaatagtgactctcactggctaatgaaaaatcaatgtggtttgatatcattaggacaaggtcaaaataatcctctaagcagaatttccttacattccctcaacaccaatgtgacaatctcgctgcaaacaaggcatagggatgtggcactgctgaacctggtaaagctatgtcattgttaactgaactaaaggaactatcagtgccaaagaagaaagagagtaagagaaaaatgtcagaaatgactgtctagattcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaatttagggttaaatggagtggggccaagagagagcacggggcttgatactaatgcatctgaactcctgggcgaaataacttaaaacgtgggtctcactgacattgagtcagtggtatcaccatatagtagttgtgctacaagaacaatcttactattcagactctttgaatcacctgaaagtgttcttgccagtagcctcttcccaaaagagataaccaatcctgagagaattccctgattttaagattgcataaatagctcatcaaatccctacaacattcagttgggatatgaaaattacagatatttttttcctcttcacttttcacatggaaaaacagaagtctgcttccattgcagtcaccccatctcctacaggggtgggaaatgacttagccagtattacagattgagccactacctctttgtaaatactatagttgagcatagaatttgcccacgtatggtacacccagggatttaggtggcaatcacatgccagaattttgctttagataatgagaatcaagtcataaaagaacttgtgaaaataaaaattgagacacttaataatatcaaccacctgatcattgtggtcagacatatgataatttcaattccttagcaatacttaaaaaaaaaaaaaaaaacaactaactaaatagagggattagaacctggaagataaagaatcaaacattagaacaagtaaccttggatcataaatattctctgacattttcaatttgcttgcaacatacagggttttgttttgttttggttttgcttccatgagtgtattgtatcccccactttctccccttctagaagctggctaagtatagacgcagacggtgaaactcaatcgcagagtgctgacagagcttctcttagggtctacagaacagatctactgagtctcacatctcttggtcagcagcgacaggtaaacactagctttattttagcagctcagctgcagctccatgggcagctgtccttactgcacataatcagtccctcttttcagggggttataactcaactatcaaaataccaaaatatgctccggtttgaaacttggtgtatagagtcccaagcccaggaatgaatgtggtttacttccaaatttaagaaaatattgagttttgtaggtcatttatttactattttcaaatatgtttgaagaatcttttaaatgccataggaaaatgtactaaaaaggacacaccattttaatacctttggtgattcattctgaatttcagcacaccactgaaagaaccaaatggtggtggaaaaaaagagtttgttttattttcttaccaaatacagatgttttgaccacttgggtcctcatcagtgttcaaaatattagtgtgttgtaacataataaaataaaggcgttaacttctttgttttgttcttttcagtgatgtgcagaatggattaacgagttcttgtttctggccctcgtataactcaaaaactcgtttcaacttaaataaattaagtaagtaattagttcataatatggcctaatcacctctggtattttgaaacaaacaaaaacacaaaaatggctgttgcacatttgcacttaattacttccacagaaaacactcatgtggactttattacaggtgacataaatttcaaatctaagctttgtttgtgatagaaacctgggttatggtattgtgtagacttccacgaagattctgtaaccgtccctactattttccttaagaaaatgaaaccacagtctatgaaaccacattcttgcgctcttaattggcaaaagaaagtgctttatttcaaaaactctggagaatagtttacttcctacagaggctcaaaggacgttaatataaaaggtagtatcatttctggaatttctgcagtgttcaatttttgctcttggagtctgaacagttcttgtttgcatacacgtctatctgggaattgctcttagtgatcaggacagccttatggaaatccttccagatgaatatactcaatagagcaaaaaatcttgctctgtctttaatgtaaaggaaaaaaggacttttaaacaagtgtgtaattgtgagttctagccttaaaggaactttcttggcttggatttcttctaccctccccttcagatacttaataatcaaagtatatgccaagaaactaatgatgcaaaccagagtattgcacatgaacttggatcgctttcccattgtgtagtgtgtgtagtgaccaagattggacccaaaaagtcgatgatagaaaatagacaatgcaacataatcaaggtacgcccaccttgggtaaattcactaacccatttcctatccttcataaatgcatataatgattctcagtatagattctgaaacttctaggctaatctggccatcagctgtgaaaggaagaaggatcaaccttgattagtaaacttccaggtcatttgcttggcatgaacccactgatgtgttagctgcatacctcacaattctttaggtgttatctgatgttaccaagcattcctgatgccctttgaatttcaatacagaaatctaagtacaactaaacatttccccaagctgtgacagccttatggctattactcattttagaactgagaccaacttttcttctgacatttgacctgggagagtttcttctttagctttctgagtcatgcaaatttattcaaattctgtattgcaacccttgtcagttgtggccatacattcacttagtgatatcttacacacaataggctctcaataaacatttgctttccagaatgaaactagccttatcataagaaaaaatggaatagatttcaatagagttataaatgaactagaagaaagactaatagatcttgagtatattaaaaaaaaaaaaatcaagcagtgagaacagttgggttttgatacagtttcccaagggaagtagtagaagtttcattactcagggcattttaaagtagaatagacaaaacactagtggggtatgttgaaataaaatatgcgtagtccgtctgtgaattagtgtttactttcaatataattataagtgaagcaacactgtaatgggaatttttcatacacaggaaagctatggctactatgtttccacatcgaccatatgttgcacatattggttgctgtggatgtgtatccctactgccctctagtggatgaaatgtaagacctacctgattaaccagatctaacaagctactggtttgggggtatatcaatctttaatcatttagggtagaaagaaaatagctgtgttgatgcattttccatcaaattataaaattgaagggcattaaaaacaacagaatcaaactctgtaattaagactgccatttaatgtttgttcgcacacggtattcatttctgtgtatccctgccaaagatccattgtgtaatgttgtcctcacatgacattaaaaacaccagttccctggaaaatacaaaaaagaaaccgtgctgccttgaaatacacggagttcactttcagaaacataaaattaatacagacacagtaacataatttggaacacaaataatggctacaagaaacttgaaaaccaggactgctccttaactctgagcaagcgtattagcagtctatgggtgtgctggctggtagtcagaagagggcaagcaaaatgggtttcagaacagggaagctgatttgagaaaggactgactaaacacatagtaatagggcaggaaaataactctaaacacacatttggtactgtgggtatatatttaatgctgtcacattgaggctgcttttcaagtgtagcacccagatgctgtactcccaatgaagaaagatagggacctgtacagttctttggcattttgtcattaagacacaggacaaatctgaaggccatcctctttgtataattttaattattttacaggatttagactttaatcactaagttttagtctcacacttagcatataaaataattctcctaaaacaccaagaggaaacaattatacaatctacgttgccaaaacaactgacataccaaagagaataaatgaaatccgaaagaagagaaacataccgtgtgcatgctgagtgcaccagggcaatggcccttattatgaatgtgggaaataaattggctaaatctttaaatatcataaattgttcgaagctggtgatatgtgagtagatgtacacttgaggggaggggaactgggtgggcatggcccagatcgctctctgagttagtgacagtttttacagtacataatttggtaaaaaagtattggtttagtaatgaaaggtaggtcccaatggacttctccttgtaaacttaaaaagagcaacagacttatctagatagagctacaaagcaacatgaaaactctcattacctgagtgatctagaagaaaatctaacttgataaatatcctggaagcattgttttcatctcaactagatttactgtatagcaattagcatctctatagatagatatggggaagcccaggagagctgggggtaagcagtatgggccaaaaggaggaaatacagccaatttcctacttagcaccacggacagagctgtcagcagaaagaaacatccttggagttatccttggtgttaaagaaacacaaagaaatcagtgttgcattttaaagatgcttcttatccccattgcgactggcagtctgggttggaattatgttccagtgcttccctgtagggcacccattggagctgaacgaataaaaaggtgtcttgcccgcctgtgcacatacaggaaggaaaggttgatacaggagaatgatgtctccttgacttttgtctgactcttctctggtttttgaaaaatcatagcactctgaagaatactatccagtctttcccatgtcaagacaagtccctgtgcatttcagccttagggtctctagggcacagggattgctctggggcacaactagggaaagggaataagtaaagacaactctaaaaggaagtaaaatgccttctattccatctcatgttatagaagattacaaataagaccctcttcttcctctcagttctggcctttatgaggtggaagtcactattagactctataactgaataacagattctggaaaattagaactatctctcttgcacttgagaagtcagtgggtctccttttctgtcctgctgaagccagatacagacaaatctagagaaccagttttatgaaagaaagtagcctagcacaaattatttggcattaaaccataccatcatttgctaaagacttggagtcaaagcttttctcatttgattgttaataagaagcttatatttctaaaatatcttgattaccagggaacttgtgggttttggctttaatcaattcttagggcttttcctatcttttgtttcttagacctttatgtccacaggatagtctagagagttgaaatttactttttgccagctcactatgcatgttcaccaaatggtaaagttctcactttaaagcccagcaagacaagatgagctctgtctgcccagcagcctttcagaggcattaagggtaagagagaaggtaagtaattcactatgcgtccccatttctataatggggaaggacgtcttgatacatttacaatactcctctggggatatttcatcagttatacctaaactctaatggacaataattgatttgaactttccacttagcacagagctgtaaacagcttcactgcagacggcagcaatgagccgacgttttgtaaagtggagagagattcagaaaacttttgtactgggtcatgccgtagcctaacagcttttgaatccagggaagaaacagtttgtcctcctggttttaatagctgggctaatcgagtttcaagcctgcagtaggtataggttatcttttgaaggcattccattttaacccctcactattatgatgggtttataacctagccataaaaatgtactcctgatttagacatacatcaggacacattcaaaaacataactttctgaatgttaatttcctggtgaaggaaaaaataagacattaaagtcattttaagactacagattttttttttttttaactctgcgtgggtggtgagcctttcagggaaaatattccctctcctccagtgtccctcatctggttgacaccaccctgtctctccctctcactcaacatcactttgtttcgggctgtatcttagtgcaatctcccatggaatggccccaaagactaatctgctacaaggcatgaaacaagcacaagtatagctctgttccatgactttcttttatagcctccctccagccccgttgaacacacaagtagatgaagtttagaagaattctttcactatttaaatcagctcttctgtctcactacggcatgatagagggtaaaatgaagagaaatgaaagactaactacattttacttagaccactacatcgtctgctcagtctatagctttcctattttgttccacactcctggaattctcacaatgggattcaaagctcacctagaagccactcttagacaacaaaggacacagtcccctttggagttgttgctgccacttctcttgtgtcaaagatctacaaaccttgtggctgtgaagtaggactttatgaacacacagcaagaaagtatattttgtgaatatactgcaaccggacgttacccgccttacatgaatttgacatggaatatgaattttccctcaattcagctgataagattgtaagagcaaaggcataccactgtcagaaaatagatttaccctgcacccccaattgtaattccctttctagaaatctacagaaaaaataggatataatcagacattttgtaagatgttgtccagattctgaaatgcattaaaatcaaactgaacataacttgttccacttggtcctgaaaattacattctgtagcttctagacatcaaacttagttctggttttgatgtaaccgctgattatttaggtaacactaagcaaggtactgaaccttacagagcctcaatttttccatttctcatttggggagaatgacacctgtgtgttcttatttattgatggatgagatgaaattatatcataagctactgaaaaaaatggtgttatatatattttgggtcagtcacctttacctttacagcagcatgaccaatgattggcaaagtagtcaaagtctacttcacccctcctgggtagaaggcaacatggaaagggtattttccatcatttggcagtaagggcctagctctacccatgttcttccccaggcaagcccttttctcccataatcaaagggcaacattttaatatttaatctttaaatcaaatatggcattctcaaatttgatttaaccaatgtctaaacttcactgagctttcagttgagccactaactccctctttcactgtcaagcttccatggaacactctttaaccacaaaattttgtacaatggtacctagtgagctcaaatgactttctcactgatcaacaattattagtctgtaaggagtttatactacagaacatcactctggtgtgtcaggctcagctctcatagacttaactaagcataaaatgtgctttacaaataaaatgcttataaaagttaacaaagaagttaacaaaagttaacaaagaagtggatgacttacattcaccctgtgttttataccttggaattcaaagttccatacttaatggaaatggggaaagcttagcaagggttcagagcaaaggccaaagaaccttccttccttgtttgcccaaaatattaaagagataatttgataatggtcattagtaagatgatgtgttaatagatgttccttacctataactcagattaaacatttaaaaagggggtttatgaagtatgagggattgagttgagttataaaattattacatacttcaggagatgttaaatcctcatatgaaatactctgatgttccagtgtaagttttatgaaatacatttgatccctatttatctgtgacaatttagttaacatgctactagagggcaggacaggtgaaccagaagagttctaggctttggcatctcataaaagttaaaaatgatctgtagagcttatcttgaaatactctttcataaaatgtatgtgtatgattcaatgactgagccatcccacatgctaagttgactacggtcatagggaaccaacctcatgtgaactgtttgatcccattattgaccagtctttatcaatgcttggcagaggtcaaggaagtaaatctaacacctataaaacaaataagcgatttccttgtttgcttttgaaaatgccacttactgattttatttttctttacagttgttagcagctgtacacggtcatattataattgtcacataacaaccttaattcagggacacatcttttgaaacaatgtattattcagcaactttgggtaaacatgcaatttaggagtggaaaagatgcacacagacacaagtaatcatagatacaaagcatggtgaatttctgtgccatgcacttcacaccccaactcatctcgcagggaaactagagaaggggcagaaccatttctattatgataattcacaaagggaggccatatagatatgcatgcaaagtctctccccacctctccatttacatgccaggatttcaactctgcgacactgagtcccttcatttagccaattagtccttccagcttcatgtaatgcacgccaaaaagaaggagaaatagaagtgctgacgttcactgctttgaaagttgctattctaatgccaaagctgcctcttgagcaatttccagaatgtattaacatgggagcaaagcgctattcctaaagacagggatcacattatgcaggggagccccgtttaacgtgtcacaattgcacagaacctccatcccctgcacgatcttacagttgtagtttgcatgggctcaagtttacggtctttacttaggtgaaacttaggaggtcttcctaaagaaaagaagcaatttaaaaatatctagtaagcaaggcatggcacatcttttgtaccatggcattgaccaagtccttttactgtcattctgaagaaagctggtcaaggtgtaaagcaaaccggcctctcagtttaggacagagtgaaggattcttcagtttctttctttctttctttttttaaatcaattaagtctaggttcaattttaattattttaatttggcagacatccctagaattttccctccatattaaggaccaagttgaaaaccattacataattgtgtagctgtgtatctgaatgccctcttatgcacgtgattctgatacttagtaggcaacaaggtgtcgctctgaaatttgaaaaaccattaattcttcagctgaccaccctgtttacagctgaagcagtgatagagattttaatatcgccttctcccttactcttggcaatggatttacaaaagccagtttgtgtcagcctggccctctacaaatttagctgttctttgcttaaatcatgacatttgcaagagatgactggacaagtcccccactgaggcagcatagcagaggtgaaggggcacttgaagtcctatttcttctacacgttgtctctgcttacttcgaccacatctgtcttctaggtctccttttcccaatacacaaaatttgaatactgactgagacgatcctgcagggttccttctagcccttttttgcttttttaccctaaaacgctcaaaatgatttctttctatgtctttggcttctataatttataatcttggctcaatcttctcccttcatttatttcctcaatattaccttttgtaactcttaaatatgctgtccctcaaagaactatcttaaggccatagttttttcttcttatactcatgcatctgaagggctgatgcactcatccatcttttctcataatctacctcttttagttagggttaactaagttagttaacttagataacactttctcttcagaatatctctacttagatggctgctagcccctcaaaacccaaataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaaaaaaaaaaaaaaaaattgcctcctcactccaaacatattctcaatggtttgactgtcacagttccctctttagtcctccagtggctttctaccctacttcagatcaattgtgaattatagactcccagcactgaaagccccctccctgtaggtctgcttgtctaacctgtcagcatccggtgccactaaggcccaccttaatccacacagcaagtcgcttttgtcttctggcttccttccgctgagaatacaccctctccatctctgaactttttccacataagcctgcatctacggaataatccctcatgcactgaagaacatctttccttcattcagatgataacttaaacctcacttatgccagagagatttccaagatgattaccagccaactgttaaccctctaaaacaaggtaagaaccactccacccacctttccacacatttcagaaaaaaattatatttttaattgtgtattgtagttgtttataaattattttgatggcagcaaaatatggtatttaatacagtttatttattgccttgcaacttttaagtcttgatttcaaattggtataaaaaacaaaaatgaaaaaagtcccattttgttactttaatatatataaagccatttaagtctcatgctttttgagatctgtcaaccgctatgcacatgataggtatcactaaacacacacttgttgaattgaattgaggaggaaccatcttaaacagtttactcacagaggaggaaggaatcagaagactatgaacataaatattccatagcagcatctgagtgtaacaagaaataataccaaaatgagagtttcccaaatttctctcaccctcttgattgtttaatattatattcataaaactatatttttaaaaacagctttgattttaaaacgttaaatttacacaccaagaagtagacactagcaaagtctcatagtctgatttatttctctgtaatatatctgtcttgagaacatcagcaggaatacaccaaagaaatatgtccctcacgggatcaactatataaaaagacagaacacatcatcagcacaaaaatcattatccatctaatttctcccattctagatggctccagtgagcccctcgatcattactgactagggttaagatagagcttaatggattaattaagccaaagcaggactgcaatgcagaccgaagaggagaaggtcctgacacagatgagacaacaactctgttcctcttttattcaaatgtgcaagacttgcccacccccaagtactacacatttatactgtaaatagtctccaaaaataagatttggtgtctgctgtctgggtcttcccctcagcactcaccaacatctaatacttgggtgttaatcaaaatgtatcgtgtaataagaaattaaatgttaagactttctttttcttcagaaacgtggagaatgattgttaacagaggtaaagcagtagaggcagagcactcgttttggcaatcaaggagcaccaactaagggagaggttattgtttgaatgtcaatgtgactctgagagagggccagggacacagaatattcacaaagagctgaaaggaagaagtgcccacagccataaagtcacggggactggggggcatgcccaaaggcatctgtcgtaatagaaaccttgagatttgttcatttaaaggggattttgaaattcaaatgtaaaaagagaacaagataatccaaagggcacaatttggggcctttttcttcttgtaaaaagaagagaaaatagagagaatcccccataccccccaacaaagtactgtaccatagtggcagtttactctcacttttacgaaccaaatcaacatattaatgacttaaaaaccacgttcacaatggggacaatcagactctatcagacacaacattaaatacgcaggtattaaaagaaaaaaatgcaaactaccaagaaatacctcactccggaaatggtaaggctgacgaaagcagactatgtcattaataccaagcacaccagaaaggcatctatggagctagactgggagggacaggcctcatttgcaccaaagaggaagtgccctgaaggggcccagaagtggggaactgggtagattttagtctttttctttttttggtaggtggggggaatgacagaaacctggcaggctcctgtggaggtctggctgcccccaccatgttgagtcccagtgtctaagtaagtaaagaaatgaaaagacacctatctcaatggttgtcctgaaacagttttaaaagcaagtacaagtccccagcccctagtagaatacaaataatttcatttgtgattcttgcatcaaggaaaaaacttgtgctaagttcaaacaataggatacctctcaaaaagatatgacttctcactagagagaaagaatcaaattctggagtgggaagtgttttttaccttagtgatcttttagtcattttgtaaatgaggaaactgaggacttgccaatggtcacagaagttaattctgtagttggcaattctagcagtaatgaatttacagatagatttggggctatgaggaatccagtggaattgggtccttcaaggccttttatttaaacaattatacatatatatacaaaaaaagatacagggggagagatctatagatatagataagtctgtataaaatatattgctgggtagtaaaaagaggaccggtgttgtagcattttcactaccatggtcaagaagccacggactagattcatttgttcagtgaacaaacagttactgaactctgtgtgcaagtattataaaagtaaaaaagtacgattagacatagtttgtgctgtttcaaaaagagttaacagtatagttgttttatatctacaatacaacctcttaaataatcaagtagtcaaactaattcctattggattaatacaaatcataatcattaattttgaatcttgagagaaggcataaactctgcattatattttagttagacactggaaataatctggaatgtttctggtaccccacatctaaagattggatttcagctattcggtgcatttggatgtttttttccctttagaatccatcctaaattcaatgccctaactcggtagctcagaaacagagctctctaggcattgctgctctccttctgcccagtctctgagagggtattgaggttgaggatggggatgaaactaagaataaggcagagaacgttgctaagtcatgcttctttcagatctaacacatttgtagtcagacctctggccctccgtatccatgggttctatatccgcaaatggaaaatatttggaaaaaaaaaacctccaataaaaaataatgataccacaatgaaaaataacacaaacaaagaaacagtgcagtataacagctatttacatagaccttacattgcattaggtattataagtaatttagagatgatttaaagtacacggaaggatgtgcatgggttatatgcaaatactatcccattttatattagggacttgagcatttgttgatttcggtatctgtgtggtgggctggggtgggatggggtgtcctggaaccagtgccctgctgattggatatcaagggatgactgtacttaatctccaagtcatttcccttacagttatattttagtatatggcaaagcacaatgatttcctttgagatgaacaaaaattgagtagctaaaacctaatgaatacaattagtttaagtaatctggttatggagaaaaatcactagtagtaaagaagtgatcatattacccaagcatttctcttaaaaagaagaaaggagaaagataacatgtgagtgcctactacatttcagtactatgctaggttctttacacaaattagctcatttaattctcataaacatctcccagagcagagattgtttccatttcttctggtaaagaaactgaggcacagcaagattgtgttttgagcagacatacaaagctagaaagtaatttatggcactcatatttggatccaagtttgtccatctacaaagcctataagcctgctaagggagaaacccaaaaatgaaacaacaatgaatgccactggcagtctttttattggatatctactatatgatgctaagttatgtgcccaattaattcgaatataaacacacattttctgccaccttgatgtttaaatatatgagcatgagcaaactaacatttggatccaccatagaatattgatgtagaaaattcaaatcactcatgtatttttttaattttagaagacaatttacctgatgttgcaaagttatcatgcaaaaattaatgctaaaaacataaaaaataccctataaactctttcagtgccagggaacatcatgcactgctcctacaaaaacctggcacagtgaattccctgttaactgccagtagatagggttttatccttaaaaatatttaaaggtgagcacatagtctgcttcatttttactccagggttggcattctcactgcctctacttaccttgttttctgtaaagtgtggaaaggaaaacaagtgaatttttctctcatatatgaaggcctagatgtggggaaaggttgtttaaatgaaaacatggagtttctcctcgtgctaagctggggcatttggagagtcccctcctccctgtgcccctccatccacacaaacatacaccccagttcacgttctagtttcacgcgggataggaaaagaaaacgaaaaacagaaaaagcaggaaaaagtacagaagaagaaggaggaaggataggaagagggtctaaggaagtagtgtagtcttccagagtgctccagaaagtgaaacgatgaaaagggtgagcctcaagagcaaggcacctcccagctctccatggatgaagagtctctatcagctccagaactaaaaccctcagtaggcaggatggtgctaaaagaagaaaaactctggaagggggtcagagacggatattgcagagctttctagccccttctacattacgtataaaaacgattattcaagaaataatgtaattttccagagcatgttcaaatgcaagaaaaaggtgcattctaagattaaatgtactacgacagctaatgattcattatgttaaagttatttattatttacaattattttctatttatgacattgtagtctttcattgacacttgataatcaagagttgacaaaataccatttgaactgctttgctaaagaacaaaaaaagagggattaaggtagacaggaagtgcgtccaccaacaataaaaaggacacatgactcataccccaatattaatgacaaaaatatctacagtgagatcctaaagttctgggtatttgtctaatttttccacaatcagaaccaaaggtaaaaacagcattgacagctactgcagtttggtctgtttaacagaccaaatgctgggatttcaaagattcatggctgggattccaaagatttgtccatgttggaaacagcattcacagtagcttttcggtcaagtggcacaaaggagtgaaaaggtagaaaaggaaacattagcaccaaaaatctctagtcatcttttaccaccttaacatgggttagctgaaggccatggagaataacggatgtgcagttgtctctttcttatacagacagcagagagaggggggaaaaccacacacttatattttgctaatgtaaaagtcccagtggaaacattagcactcaaagacattaatgtggatttgggacactccctgaaggattttgattccattagaaaaaaaaaaaaagacagtgacagatataatcctgctttgatatgtttaatgccatttaaagagaaactgtacccatttacctcaggccaggacaccaagagttcaaaaagtgaaataccatttctcagtgcaaagaaaaagcttggaaaatattatgtgaaaattaatttggcatgcttctttgaaattttagatttctgggatgagcaaatgggtacagttttcttttaactgtttttgaacaccatgtgttgagaagaaaacaacagaatggcaattgctcatccaaaatgctaacttgtggcatggcacagtcaagatggcctgccacagccaaaaagcaggtgtgtgctatgcctctcacttcagtagcatgcacgccacatgtccctgcattcggcaacctcttgcatttgcttttggaacctttctgagggggacagtaaacatgactcaacagaatgtctagctgaggagggactggctctctgagcctgctgtgagacagactttttgaggaagaaccaaaggaaaactggaataatgtatttattttggaattctttggtatcacttcctgtgacctaacaccaagacgactggttccagatcattttgtgtggatgaaatttagcatctaatcaggtcggagagtaatggtgaagcttttgtgtgactggagaggacacattaaatcagctacctcatttggactgaggtcaaggttaatgtagctggtacagatcatacgaacctaacctaaaagcttagagtaataaactcctcacccctcaggtccatggataagcttgaaacagggtgtacaaaaccatttggtgtgctgggatgccaaagcttcttcaatctgacattatgaatctgttattatgttactctaggaattaaaatagttttacgtagatataggtccttttcaactatacaacagtcctatgagggagacgaggaaacagaaaaaaaagattttccttctgccctgtaagaagcctgataaagaggccaagttaaaagtcatgaccacgtctaagctcaagtcaggaaccacttggaatgaaatcccaggatatctgtgctgtaggaatagacaaggtctgaagataaagaagtagatgaaaatcaaaattactattttagaagacaggagtgggacacctctactttattctatacttttaataaatacatcaataataatttattaaaaacctactatgtgcaaatgtcaagagtggggaagaatgaaacctataagtaataaactggaaagaaaaaacatccttaagcttttctgatgtaactgagtgatgttctctgcttctgagtagaaatttatggattcagaaaaggtaatttctttccaaacactcacatgccattgttaatttcactcattcaaatcacaacatttactactataccttttatttctgatggcacattctaggtgttgagggggatacaactgtgtgtaagtacagtctctgtatttattaagcttactgtgcagtggcaggaggaatgagacatataaacatgctctagtataagacagtatgtaatcagtgccacaggagacatacaaataagtgctttagcagttcggaagaagcaagtcctcctggctatagaaccacccctccatagacatactgaaatgactcaatgcacagaaaggaaggatctgtacaactttaagtcaacttacaattgatgtgcattaggggattggagggttagctaggctgtgaggggagggatgtgctcactgtgtccacagctcctctcacactgggtcaccccataattaatgtttatcaaaaacatgcatggataaaagtggaagtcaattgaatgatagaccaggtcaatgggtctgtgttagttctagatattttagatgattattaacaccctgctagaagttggcattataagaacatcattttcttcccacactagtgtaaaaagttcagttttttacccattccagagtgatgggaagtaaaattcagggcttcagtcttccaaatgagggaaatacttggcctgtgcaaaatgctctcggtaggggtatcaaaatgtctttcaaaacagcaaaaaatacatttcctgatagcccctaaggagtatgagttggaatccatgttctctagatgtgacgatggagttcgggagaggcaggtatgctaggatccatataagatcgtatttcccatggtagtgggaaatagaatttgaatgtcctggcttctaggtctgggttcttcctacagaaacatctttttcattttgtattcctcttggacactctagtcctttacctcatgaagagtagccttctgcaattggggtgtgtgtgtgtgtgtttgtgtgtgtgtgtgtgtgtatctttctaagagagaggatagccttactgatgtgcttttgtaaaggattcaaggttgtctggatcctcaaataatgcaattgaaaaaatacggtttctttgattcaatggtgcttacatttgagcagcgttttctttttccattctcaaacacagtatttgagactatctgccaacaataaaaaggtttagagcatcaaaagtgtaggcgaaccaaatcagaattaatctctgtgaaaaccgagattcaggcgcatggaaaaagtttaggaaaaaatccaggtgggaggcaatcccatagaaaggtgtctggcatctttcctgattcaaagtgaggtgtagtaggacacatgtggaagagagatgagcggttctagctattcatatgatccattgtctcaccaatgctcacacaacttgggactgtgttatcagggggccatttgatttatcatgtagtccatgtatcctattgtatgtatgatccggagagaggttaataaagggaagtctaagcttaactgggactaaaatgaggtggcaaacagccattcactcaaacaagactcaccagattaatctgtggagtatccagcagcatttccttttattatcatatgaaaagctgtgcattttattggaaaataattaactctttaaaaaaaaaaacttgcacaccatagcagcaaaagggaggaagataacagtgatcacttctgaacacctggtacacgtttggcactgtttttctttatgcatggatttctttacatatgttatctcatttgatcttcataccaactacgaatgattgatattttgcccattttttttgtataagaatcctaaggttcagagaagttacgtaaatatcctttggtcacacagctagtagggactaagctggaattcaaattggagcagtaggacacaaagcctgtgctcctcaccatgccttgccaggccagacttcatgtgcttttcatggcatgaaatcagtgttgggggaattctgcccagcatctctggttagcagagtgaattgcttttatcatttgccaacatgtcacagaaaaaaacaaaacaacaaaaaaattaaaactcctggctctagatttcctatcaacctgaagtttggcttggttacatattatttgaatatctgacaatcttataaaaagtctaacgagaataaaaaaattcttcatttatgctagctcctatgttagctaaaaatctcctattcctacataacaatgtgcctggggaactctctcactgccagaaactcatctgaaaatgctgaaaagtcagaatttggggcctatatactgactaatgttaccagctgtgagtcagcttgaacatcagtaatatgatatttcccgctacaatttgatttggttaaaatgtgtttgaagttcacccttttattaactggaattaccacctcctgtaactggagggcctctgagaacaggctgctggtgcaatccaccttcccacccgccaacggtgcatttcctggcaacaaatactattaaattgataactacagaaataggtcaaaatgtcttttcaatagttgctaatatttctctaatgctccatagcctccctttgattcttgtgctgacatttttttttgatgagtgcaggagcaacaactgttaaagagaaatgaccagaagaaaggaaagctggctggggtggatggaggtgctcttaggagttcccgtatcagacagaaaagctagatctccctagaggcccaagggccccaaactcagctctgctgttgagtttggtgacccagaagaaaacctgtgtcccatctgagcctcaatactctcatctgtaaaaagaggagactcgagatgactgattattcaaatttgcaaaatgcccagagttcacaggaggtagaagccctgacttatcacaaaacatttgggttttaaatttgtttatagtactcttataatgttacctgttaaggccttggctatccaagatagaaacttattttcatacaaaaaaagtaatattgtgttatattttcgtaagagagaccctttgctatcatactgggttttattcactatgtaaacctatattccctccctctctttcctccaggaacaaagtttgcttttctgagttcacatcacatgtgtgattacagcaaagacagaagtttgaggctgcagtgagccatgattgtggcactatactccagcctgggtgattgagccagacttcaacccttaaaaaacaaaaaagaaaggggtggggtgggtatagtcacattgggaacatagctgattgtgagcctgcaagaagaaaagtccccttgctaaaaaaggttttccagcacttcttctgagatgcaaacataccacggaggggtcaagccattcatgccttcatgctataaccacttcaactccaagagagttatctcagtgtaaagcagttttgaactggagctggagggagggatagggataattctggaacaggggaaggtgaaggaagcaatcagattaactaacacaaggaccctaggctctgctggcagaggagaagatgaagtgggtgacaaggactgaaaagaacccagtctctattgcagtttttgcccagggccttgtctggagctggtgaaccactaaaaaaatcccttgagagatgtcatggtttatcaaaaatgcctttggctcttctgttgctccatggttgtgctgttgctcaacaggcggtcagcaaactacagcctacttggttgaggtgagagtagcttaatctcatataatttaaactcacaaagactatctctccatcagatcccttctgttttccttcctttcctagagcagggaggaaaaaatgtgtgaaagtaagggcaaagaaggaggaggaagaggtagaagaaattaacctttcctcagcttccaagtgagttaggctttgtgttaggtaagcatctctctagatccttccaacagccctgaagatattattagtaataggaagtattttatagggttgaagcagctaactagagctcaaggtggccagtcaggctccttgttacacagcactcttttctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttttgagtaagaagaataaaaggattgatctgagctgaaagcagaagggaagatgaggggaaggccacagaacacatagctagcagtggcattggtgggggtctgagagaggcagaagcccagggccagagctgagagatcagcttgtttttagcatacacggatgtgtttgatcacatgatggttgggaggtacctaggctaagataatcttaatgttaggtgctcattttaaaacatcaatttaatgactgaagcctattttaatgatccaataaaggccaaagccctcactactatgatacaactatttctccctagtattcactccttgccaaaaaaaaacaaaaaaaaccaaaaaaaaacaaaacaaaacttggctgagacagctatagagtttctgattacaaaacaagatcaccttgatcataatcatctcaaggtgcttggaggaaagaaggagagatgagttcttctgaaccacattatgtggacagaaatcttcaaagagtttaatggaggaattaacttttgaggaattgaaaaaggtatcattttcagtaagagaaaaaatgactgatactttcaattggtatgctagggaaagataaattctaggcaagaccagctctataatttgtggggctcaaggaaaaataaaaaaagtagggctccttattaaaaaattattaagaatttcaggacagcaacagaagcacatcaagccaggcatagggcccgtccaaacatgggaccttgtgcaactgcacaggttgtatacccatgaagctggccctagttttagttattgtttttaccaaggtattccagtcccagagctacccagacccaaatggaaaagcacataccacaactctcaaaactctcagttaaccctgtcttcctacggtaaggacacaactgaattctgcaacaaggatcagaaaatcctggggtctgccaacatatttgatagattgcaactgcactggcttctgcgacatttgtcacagtcactaatccgtgtttctgtcacaacctaaggatgcccaggatatcaatgtctgggaattcaaacatattttctaaaaacacaaatttatttaaaaacaacaacaaaacaagcagaagtcactaaaaagaagctgagtcccctggatgaaagtctgctcttaatctctttctggctttaccttgagtaggtcttgggtgtatgcacacaggttcagaagtgcaggtgaattaccacaataactcttttcagttagagaaaaaatagcagaaacagaagaatctggtcatagcctagcagaaactccctcatttcaccaacagtatgctttctccctttcttattatgctaagttgaagcgatgacttcactctccatggaagctaagtttctctttcctggatgcttggaatgggcctggtgaaaagctattggagggtaacatcatgtctaaaaaatgtatgtatgtatgaagaaagtagagatttaaagagctcagaccaacatcaaaagaataacagcagtccaaagtgaaatgaatgtggcctcttttccaatgaccttagggactttatatatacttagcctacttcttgagtggatagaccagtagcttggcagatgcctaggatgtctgtacaggttgaaacttaattccgtcctttctatacatctttgtcccattaaagaaaaatatctaatatagagaaccagttcactcctacagccagaattatactttgacactagaccaattgctacatccttgatttaggattttttaaaagatatctattggcaaagctaatcttttatttggcttaataggtttgtactgctgctctgcataaggccattagggtccataagtagatggaaatgtgtttgaatctctataatcatgcttagatttcaaaagtcttccatttcacagaggtgatgtaggctcagccatcattttcaagtgttttaacaaatggtaatcagcagagaaggtcttacttttttttttttaaaaagtgactgaccttcacaatggatgcacacataaaactctgattcatttattttaaaaccattctcccctgctgtaaatagatagctacgatatatacattaatatatgtgtgcacaatcagccttagcaatactgctgtgaagtagatgaggatagatggttttctatttatttgacaaatacactattacacagataggttaagcgatttgtcctgtaaggaagggtggagctgggggaaaaaaaaatcctcccacatctgctcttacatgataccactatggaattgggtatcctttattgtttttgagtgacttgatctaaataatgggtaatgtaattttcctgaaaaaaatttcactatttctctcattccctcttactttcttcttctctctgcttctcctctgagattattataaactattgataaatgtggttgctctaaatttacacttgctcttcatgggctttgatgggtttcagcttctaaagagagcataggggagaaaaaagcttatttctaaaaggttttaaaaggatagataacgctgggacagtttatttgaattaatgtcactataaagtggatactggtacgagtactgtcttggacccttctctcgcaagagctagtccaaaggctctgaagtgataccatgggaaggaagagctttttggaggcagaacctgctcatcaacactctgctattctcctgggatatcagacaaaagccagagctttctgtgcaccttcctgttgaactgctttaacttggaactattctctacattagggctgtcctctctgagtccctgaccttagatggtctttctctattttggcacatatttgcatatcagttacggtgacatatttgataaataatgggcctcactgttttttggccagtgaaaaactattttgctattattttaactctttattatctcttttgtcgattatttgtgtgactaaaaagatttcttgtctcttatcatgcttctggttactgtttctcaatgtcatctggtaaatgcttagaaaatacaattttattttgataaattctaaacaaaacataattatgaagaaaaaccaacagagacaagtatataatgaattttgaagctaaatataataaatagttctgaattttctgccactccggctcatttagaatgtaacattgctgacaaattagttattcatgctgttttttaaaaatcaggggcaaaattataagtttcaattctcctaataggagttataacccctgcagcatgaaagcacttgagtaatgtttgctatgtgaaactggcttcggtgatttctcctgaaggaaactgcactatcaaaaccttcatcaaggctgcttctgtttaagacccactgcactacgaatgtccctgtacccgtcagaaccttggctggctgtcatcccatcaagcacctcatctgcagttgccactcagacatgtaaagcgtgtgtttggggacgacgcgcggtggaatgagaagggatacagagctctgttgtaccactacatttattgtaagcaaccacttacacggcaactgctttgctcttttatattctaggcaacacaccggtgaatataattcataatgaacatattcaacattttttccatcagttcaatacattattcataaatattagagatggaaagacctggaagattacagagtccaaacctcctttttgtaactccctttcccctaactgttgatggtagctcaaaaaatccaaaccaaaaccaaaacaaaaaaaaccaccaacaaaacaaaataaaccaaacaaacaaataaaatacaaacacacaaggaaagcaacaaatttacaaattttataagtaaagtgaaaagctccaaagctcgtgtttggtgggggttgttgggggcaggatttacactgatggagctcgctgaagactaggagtatggatgactctttgctttgaagacaggccaagggagggaaatgtcagtttcccccttttagataacaattcaaggtaaagcccaagaggcaataccaagttcttggccaagtgttaactatccatctctacagcctgttgtggactcaggactcaggcactcttctcttcatttagaacttgagatattaatgctaatgataaaaagaaaatgtataaatgaatagagagtgaaaactactagagaatgctccctgggattatctgtactatcaagataggaaaactttgcagatgctactgtctctctagaggaataaatgcttgcattttaatattctcagcagctggttcctgttgaatgccatcaggatgattcagccacccaccaggaacaccagtaacagcaagtgcacacacagaaatctgcaaaactttcttctcttgatgccaacaccattactctggcaaagtcaaaatcctttattgaattatcagttctactaaatgtgaccttgttcccctcacaaataccagcttattctcaaataaatggaacttctggctgattaaaatgtaacattccttctgacttgagcacaccctgctgtcagtctctcttctgccatgttcatgtgatctacctctttttcgttttcttgctatccactgaaaccttgaaggactggcaagatccatacatactcagagtccactttgtatgttgctctgcttgctaaacccatacatttaatgttatatctctacccttacatgtctcaagttatttcatcatttccattttttagacattttctatttccacagaatgtgtttgtatgtctggaaaaacagaaatgtgtagctgaactgcatttaccattgacctcattaatacagaattaccatgccatattcaagctagataaaaatgctatacttgccctcttcttcaaatttagaccagattacacactaaagggaagaaaatgccaaagatgacagctagctatcaaaaagatctcactgtctcattttcaggtctccaaagtaaaatctaaggacattcaacacagattcaggtgctctcaacagccatgaaaatatatggctgaagagggaatctataaatgtaatgaatacacaattggcttataacagatgcaaccaaaattaaattcgatatcttgacctgctctccaaagtgaaagtttctagtttaggctacagacagaggtgtaacaagctcattaatcacatgaaccagaaatataagctgacacttctggggatgctgcaaagagcagtcttaagctgttgggggtctgtggggaacctgaaaaatcatgtggctctgacagtccacagcaagcaacaccactgcattttacaatgtatgtgggtcaggcactggccataaccaccactattttaaacttccaggacaggatttaaggatctttgtagggaaataataggtccaatatggacttttataaaaagattcaatatatttttattaggttcctgttacacaaaaatcattgtgttcattgcatgagaagacaatgaattaggtcaatctatgacctcgagaagtatataaatgggaaagaatcagaggcaggggaatattaataagtaatagtagcaataacaataacaacaatgatgagtgataaccttgagctagtcattctgctaagcactttatatactacatttcatggaattcttatagtatcctaggaaggcagatatcgtttttctctttacagacgtggaacgtgaggcccagtaaaattaagtacattgcctaaaattatgtagacctgttctttacattacaaataaatacataaatagcttgcatataaaatgaaatatggcaaggctcattaaaagatacaaagtgttgtagaaataaaggaggcagaatgtgtttctatttgggaatactaggagaaaaggaacatggatgggaaaatgtggtgtgtgcttaggaaacaaggattgttccagtttgtaatgttataaacctgttgaatcatcaatgtctcattagaactcatactttgataagatagtaaaatataccaatctgtacaggaatatttctacaaagaaatacttctttccaaaagatcttctgactacaatttctcaaaacttttcttgttatttattttttggtggcgatagagggagaaaaaatgtgagatacaaggctatggaggtctgggcagcagtgttaactccagagtctctagggagtacaatgcatttgggtgcattttccttcattcctcagaatgccttatcctcatcacacatatttgtccctgccacatccgaggtgaggttactggcatagaaatagaaaccctgagggtctggtttcttccacttcttcaaagtgggatatcacttactttttatttttataaattagttttagtggtcagccttttggcataggagtacatcaagaaaacgtgagttagaaaacttgagttctggtcccagttttgccttgctcatcttgaaagcattttatctcttctctgtgtttaagttttcttattggcaaaatgagtagtttaagcctgaatatcatttcttaatctgttggacaaccccctcatcaaattttttttgataaaaataaaaccttgttttaatgtagatccttctattcttctctatttaaaattcctggttcacagaatgcaatatatagtaccattagtccagataattttgtagagctttactttctctattttgttaagtttttctcgtaaattttgttttccaaatataaaacattgtaatatatatgtattttcaaattctacatggtcctcgaccagatattccaatattccattctgaagagttggttaacccactcacccatattgagatatctaaagccccttcaagctccaagatacagtgattatgatgctctgatgctgacatttgctttgtcaacgcttaaagcagagcttttaaacttcaaacaatagcataacaagttgctataacaattacacttacataaatctttaagcagatgtgcataacagctctttacatctactatcacactggacaaccaaagcttatgatgttgttataaatccttgcaatagtaaattctacagttaattataacctataggaaaaagtactgtccatatttagaattgattgactcttattttccacatctgttaattttgcacccagctatagggctttaaatagctcccataactttaatcattagcccccactcagtcatgacttctatgtctcacccttctgaccttgcccactgagttcactcttactgatgtaatcaaacatgtttcattgtagttgcattcgtcacagtgctcattagaattatcatcattcctacagcacctcagtgcaatgaaattgtgtgcctatgcaatttgttgttattttaagttcttcagctggaattttaaaaatctagatggacaattttattttatctgatcgataaatatatatccagttaagtgcctctgaaaaattggtaagaaaattatttattagagcaaaatcttaagtctagagagatttttgtaaacttggacagcagcattcactgaccttgaatccacaggttcaaaatttattagtgtcaagttagtcttttaaagcaatccattaaagcaataagtataaaatatatatggtttacatttatgtatgtgttgaatttaataaattagtcaggagtcaaggtatttttaaagaaatattaaatctgttctatattgatcaattaactgactttctaacttaaaatattcttttgctgtagttaaaacctttttttctttttaaaacaaacagagtacataaactgtaaggtggcaatgtagttcactgcgacaatctatatattccttaacgtttgttctttttatggtcatggtatgtagaaacaaataaatgtataatagtttaagtccaggagtttttgcctgactaaattctaaacacatagcttaaataaagggttgaaagcctggcatctcatcattactgtttatatgttataaggtttgcagggccaccttataaaatatatagttgtttattttcatgttcaataaataagtagtgtggggtttcagactgagaatggattacagattgttctctcctggttatttttggctttaagtatattgatcattttatcattttcttgttttaaactactttaaacacagcacaaatgttattctcatcatgccagaaatgggtttggaattgattctgagtttccatcaattttactctttgctctttgtgagaagttttgcactgcttaaattcgaaaggatagttttgtttaaaagatgtcacagtacaacatttagagaaccttagctgcccagaaaaactcagattttctgctttacaaaagaataaaaatcatcgaatttattaccctggactttattgaaatcagtgaagaatattcatacaaatacagtttcacgaacttcctctctctctttcttcatgtaagtgtttgacaaaagcatgtatcttctgagaagccggcctgattggtccaggttggcactgtttcagtgtttggcctacggcggctgcttaggaataatttcatctcatcctctctattttcctggactgtatcaaactcagacacgtggtatgcaaaggaaatccaagtcttttaaaaatgctatttcttttggtactaaagccaagaccagttctactttggccaaatgatcttatcaagatttaacaagagatattcagtaatatctccaatctgtgagaagacattccactaaggaagataatttattacatacagtgtacatatatttctccacttggtaccaggaagagacatgatcaaacttattctattggtactgaaaacaatgtaacactgacaaaaattctgtggcaattattcatttcaattaatttaaaaagaaataaacaagtagctcttcccccattaaaacagatactggaaatctattttcagttattgctgaaaatattttggcttccacaaaggcaccttactaacacactactttgccctccactgtgctgtcacaattcagaacttgtaacattttattcaggtactctagactaattagatgaaacaactgcattacagtattaagatgcttttgtagaattaaatgaaaggagatctgcacagttcagatagcttggaagatttgcaatgaatatcaccaaaatcctgcatgtgcaatatatttttctacatttacaaattagctaatgaataagtgtattccacaataactgctaggatttaatttcacacttaagaatatcaacaaacacagagagaaatttagataggtaaactccatttcccttcccaccccaccctagtgctcccctgcactgtttgcatttcagaacaaatgcttcatgtctcttgaaaagcgccaggaaatctcttctctagctatgcaggcctcaattttatgtgtgtagtatgacacaccttaaaagagagagccccacaaactagagtgggacgttaatttaaatacagacttaaggagaagagctccatctactgaatcagttagatcatagtgtgtaccctatagttatcccattcactactttcaaccacttagaggctctggagggaacaggaaagttatagacctgagcaaccatgaaaaacagctttgagcctaatgccatttgggatatttctcggataccctgagcccctttcctttgcccctccaatttcaaagctttccatgttgcaatataaaataaaaatggatgttttgctatatgaaccatcccttggaagtagaaagtcattggttgttgaaggaaatgtctcagacagttgaagagaaagctacagaaagaaaatctctagctggcaggttgggcagcctaggtaagaagggaaaagaagagtagcctacttactcctcctgccttgcaccattgctggggaagcctgcagccacccaggatcagctcttctggcctctccccggctgcacagtattgttgtggcattgggaatttgctgtggcttcgtaagattatggggatgtgcttcagcaagccaaaaaagtcacaaacaaaattcaagaggaaaaaaaaaaagtataaaaacagctgatcttactggagaagctcttggcattttcctacatatgccacaattttctctggtatttcctggttctgtgatcagaaaaattatcgtatcatatttattactgttgtttttttcagggttgctggtggtgacgggtggtacagtgagggcaaacagatggatcaaggagaagcaaagtaaagattacttctcccacttgtttgaaagctttccaagagattgcaggttaaaaaatctcttcttcagaatactgaagatgtatagatatcacatataggaaaagatggccatactctttctagattgggaaagaaaaaaacttctaacacagtaacagattcggaacaaagcaaattgtatcagaaaaaacttaaacgttcatatagctgcataaaattcagcagcatataagacttataaaaatacttcataaattaagataaaatatttgaatataaatgggtgttaagtatatatataattggatgaaagcaatagttcagtgaattttttattacagaaaaataaaatataatgaattaacaaaagttttacagtaatgctaaccttttctcttgtaggttaaaatagaattaatgtaactgtaaagtggattcatgtttccctgtgggtgtgaatgtatatatatacctgcccaggtattactgactgacactgaaaggtgatatgttgcaaagaaattcaaactttgagcattattttaaattgggtatttaaaatatcagtattaacctggcaggtttctttctttttctttctttctttttaatacatttaattttcagggtctgttttaaagcacgaaaagaaaaacagattagaaaagcattgcacatcaataagtattttgtaaaataatccatttgcatttattagaatattcagttctcaaaaaacggctaattggattttcttcaagccttttcaagacaagttcagttctgtgtcaaggataactatgagaaatttcacctcaaaaggtaatttgtttggttagttataaaagcctgaaaaacaagattatctccaccataactataacaaaacagctaatgagtaagtacattctggtaagaatcgataagaatggcaaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagctttaaaaaaaaaaaaaaaaaaaggttgcacaaaagatacatgtgttccttttctggtattattacaggcccacctagatttagctttcgattccagatgagatcaggcatgttcagactagcacatctttgctctgtaagcacagagctgctatcatttcactggcaaattctcgtatccccaaatttatgcacaatagataccctttaaaatctgcaaattttctatttcagtgaaataactgattgagttaattttttttcttaatttacgctgctcgtattaagctgaaaagttaaggcaggcaactcctataaaaaaggaaagttgaacagtacttaccctaagtgtaatgtgcaagccttaatggggcaatttacttttgctctatgatatttagaaaggtgtccaggtctaaactcagctctcgcctttttcccttctggaaaactgagtagactcacagaaggtgcctctgcgaaagatcatacaaatcaacagccttacctgtggccattcagaagactgcactttggtgtgtgtttaaaactatgaataaagtcagatacagcgcatgctcagcaggcaatttaaaaatatttataacattgttgtttcaaaaacaaatttcctcaaacaaagcaaaactcaaatttttttatccatgccaagtttaacgttctgagacaaagctgttttggagttttccgctgaaggaaaaaaggcttttaaaattttttgttgaacgaaaaatagttctctcttcccttttgggtacgcttaaaggggtggaataaatttttctccaagtttcaacaaaattcacctctggctatgataaggcattacaaatttaaggtctgtaaaaaataattttagagaaactaacaagaaactaaaaactatgggtttaaagaatgtaatggtcatctgaactttcaaggcagtcttgcatgtaactatacaaaaattatatcctgatacaaacaggatatattatatgtagataagaataatgtgtatacaaccatatgcatacctagagaagttttatttttcttttgctaactaaaatcagaactctctaaagccgaaaaagaaatacaacaaaaatttaggagaaacccagtaataacatcggcacaattcatctgtttttcatagcaagcgtggaaaagaaggcaatcataccaattgattaaattttgagatatataaaataaaaatttgataaaagaaggtttttaaagtatgaattgcagtagaaatgcctgtttcgttcctggttgaaaatttctttctcttccttgaatatccctaagcattccattttaccatctatcaccaaaccctgaacagctcacagatctcacagatcttatttaaatctcttacttaattcttaagtctctgaatgaatttcagctcctgctctactttccaagggtgctcagctggcctcacaaaagctccacagacacatcgttcactatctctgatgctttcaagcttaacagaggatgccaaaaaaaaaaaaaaaatcaacgattaaaaaaagtttattaaagtgaaactaggagtgcaaatttgaagaagttgcttctacttttatttctctctcaactcagcacaggtgtttcctaacttatactgctgtgcatgctgatgaaggggagggttaaattaaggtgagggagtgggccaagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctcaggtcagatccacgaagaatcccagaatgacagctatcacctgtcactgtactcttggcggcacaactagctgataggagctgcctgagttgggatcaagaagagctagtgcagctttcagtaacagcctgttatcccagtccctctgcccctttcaaagatccccttggtcacatcaaaaacagaccaaaaagaaaaagaaaaaagaaaaaaaagggggggtaccaaatgaaaaattaaaaatgcagggacaacagcccacagcaacaaaagaattcagggagaaaaaatagaacacaagcaaaaaggaaaaaagcaaaaccaaaacaactcttgtcttcaatataaaactttttaaagactgagtttctcttatttggatgacattctttttaaaagtatttttctccttaagcactattaaaagcattaaaaaattctacaaaaatacagaaaagtctgaaagcaattcaagaatattcctaaagaaaacatgtaagtgtaagaagtgagttaccctggaaaattctggatttgccaaaagttcccctacttctaatatctttcagtgagttcaagtgctaacactggccacctagtacttgttttttatctgaggatcattactgaggcaacacatacatagtaaggtttcccgaaaagactccttgttatcaagttacttcaaacataaggcactcacacctcccagccaggagggttttttgatgagcatcacactctgccctgatatgtattacacccttaagaagcagttacataaatgcattctataattatggaaaatgtatatatctatattttcccctacattttccctccccagggatatgaatagattttattttcagttaatagaaaaaaaaagaaaagagtttctgattcttgaaacaactgttgtagctgttttctacttagcaaaacagttatctgtagttaggaatggtacataatatatatttaaggatttttgtagagcttgagaattgttccccttgtttagtttcgtgtctataatgtaccttaaaaagatttctaagtgacaatcaacatataaatgcattaagaggagaactttaagaaagaaaacattatcttgggtttacaaatccaggatattagcataaagatataaatgtacagcatatataaaagataaaattgtttactacattttacacatacagctcacatctgatttctttttgcttttgttggagcattaatttgaaaatgataagcattctgaaatgtttgctacaacacaaattcatggtaaaaatatacatgcataggcaaaaattgaaatggagaacacaaagctacgtggcaatcagaatcgttgacaaaatctccatctagactatattttgcatgaactagtgtatcatagaaggggcaagaaatctctctgggggttttgtcatttacataattagaaacaaaaataaaatacaaatatctgctcccttactaccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtgagtagaaaaaaaatagcataaagtgagcataagaacagttggatttggaaagattaaaagaggagaaaagagcaacatatgcaacttaactagtctttttctttttaattttttcatgtacatatatgtatatattgggatgatggggagaaaagataactggatttcttttgaatgtctttgtgtctttatagagtgaatgttctgttcctgtctctttctttttaggcgaaaaactaataaaaatagaaaaacatatatcagacattaagctcactccccccccccccacccttccctttgtaaagaactctttgttctctagtgaaaatgctgaaaaatccccgggcagctactccctgaaacaagtgcaaaacacttagaggcttttgggctggctgggagccagaaaccctcccgctgtctggttagaagaggaaaaaaagaagagagagggagagggagagaggggaagagggatggggggcagagagagaggaagagagagaggaagagagaggaaaagagaagggagagagagagagagagagagagagagagagagagaaattggagcttcctttaatagacataggaagcagcgtttttttctttcttttttttcaaaactggcggtcaagcgttaagtaactcccgtctaaatccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaacaacaaacacagcaaaatacatgctccctcggtctcctaaaaaaaaaaaaaggcttttccatctcggttgcgacacagtgataaggggtagcgaacatctcatacctggtgtgaatgctaatcagtcaggagttctccttttcccaagacagggaactgtttccttccaaatttattagaacctcctccactgcctctttgaaaaaccttctttgtcaccctctcccaagtcccgatacttctttaaaaaaaaaatggcttcggagctccttctattcttgatattgattctctctctctccccccacccctcctcctctctcctgtctgtgtctcttctgagtggtctattgataagtccctggaggcactgggtcagcctgcccgtaggaaaccagacacaatgcacaaatctccgagtgccattctgccatcagcaagcagaccacgtttaggagagagagagaggaaaaaaaaacagtagagcaagagacagagagagagagagagagagagagacaccaaccgagggagggagagagagactgagagagaggaagagagagggggaagagagagaggggggggagagagagagagagagggagagagaggagagacggagagagagagtgtgtgagaaaaagactgattggaacaggagggagagagagagaaaaggagaaggagagagagcgcgagagggagagcggcactgccagtcaggttaatcatccctactttaattagctgttcggcttagacataaaacaattgaatttgaatgatctgtcagcaggctcggctgaaccaaaggggaaaagcgaatattacaaaaagactgttggtgtgttctgataagcaatactgctcgtactgacaaatcctcaaagggggaactattaaaacttacaactaaacaaaaagtgcaaatacaaatggcactagatagaggtctttaaaaaatggagttttctcctctagttttatgaaccatagatatttatgtgcaggtgccaacatattaggggttttcgtgtaatgtgtgaaagtttattaacgatggtctaggagtgtagcagacagatgctgcagagaacaagacaggtacagtcagatgccgaatctagatcttggagggagaaggatgctggaagaagaggcaccgtggcaagagatcagcacagacaaagtcagtgggcagataggcagacagattttaggcacggcacgatctcatctaaaaaggcaaaagttctgatgcaatattaggtacaaaacaatccatccatcctcctctcccgggtgcactccaaggtacagttaaaatggattaatctttgtgacaaacagagctggcaaggcagacactgaaggcgatttgcagacccagagaatacagagctagaaaaagccccagagatcaatctctccccctcccaatttagtagagaggaaactgaggcccagagtcgacactagacactaggactccaggagcccaccaggccagtgctctttccaccacaccagctaacctagagtattctttgaagatctggcccaacaggtatgaaaatcacccttacctcccaaataagaagattactccacctatatagttagtgcacaaacctccaatttctcaaaatgtttaaatagccaaatggaaatataattacatatataaatacatttccactttatatatatgtgtgtttatgtatatatatatatatggagagagagagagagagaccattttgaatgctaggaacaagggatttaagtctttaattcattctaggagaaaagcagaaaaatataatattgtagaggcctcgtctcagcaagatataacttgtgtcacattttcaagctaatgaaggctagtggtttgatctacaaagacctcaccctgaatttacaattcgctctatgaacatcatctgctatatatcaccaagtgagaagatgtggtttttctcatacacctcgtttctaaaatataggcacattgtgggtgaaagagattgagtctttcagcatactatgtagttttaaagcactgatgagattttccacctggagaattaggtatgtacaacctttccaatatatttcaattgaaaatgagctactaaaaaggggaaactatattttccgcccatgaaagtgatggtatctttttcgggacacatatgatcatgttcactaaggattcccttttgacaatgggtaattgaaggtccagtttttaaatggtgaaagaggtgcttatgaagagaacagtgccatcagatgttactggagagattaagtttcttgccctaaaacaagactcaggatgtgtatgaaaccgaaaactatctctcagtcatgcttcagcaacaacattgctacttagggagaaagaagaaaaccgaaagaaatgtcaggcacgtgggagcccactcaaagacaagtaatctgagagaagtcatagccagagtaatttagtttatttgcacaccaacctctttaacaatggctgctatgccatgcctaaaacacacggcctacagttgactgatttggaaagggggaaggaatcagtgattttgataatggcagatcctttggcaagccccaaaatacctgataggccagagcccagaagaaagcagtggagtgcttagtaaatgtctgttggtgaactgagaaaaaagaacaagagctttggagcaaacacatatttatatataacactgcaaaagtcacagctactctgaaagcctcagttttcctttctgtaaaaggtgatgatattggtcccatagagttgtcttaaggatgacatgaggaaacatataaagtacacagctagtcattacacggtagttattatggaggaaggtgtgtaaacaaaagtgtatattatggatgtgctgagtgtgttatattcaaagcatgtaggttcaagacatgaaagcatatagcaaagcaaggatctaatatacagatctctactagaaaggattggcagtagagattataaagtttagaactaaattcctaaaatctaaacttcaaggatgttaggtcatctggggttgtattatttctttgttcccagattttactatatttcctggctcataataataatgatggccaacatattactaattggcttgccctaagcagtctgctaaggactttacattttaaaatcatactttagcatcacaagaatcctatgaatgaggtactaccaatatccgcatttcatagaaaagaaaactgaggtatagaaagattgtgtaacttgctcaagatcacacgcctagcaagtgaggagctgggaattaaatccagccaatctgattttaaagcccgcattctcagccatggtactaaactggcacacagtaggtattcagtcaatgtgtgttgaatgaataagcaaataaaaaaaacactagaatttttatttcattggagatcagtaataatctgtgcaaaaccacttgagagaatcttgttttcgaattatagaatctgtccttcttctgtagctcacttcaggtgtagtcctttgtcagaaaccagggtgagccatgtccctgcatggtgctgaaaatggatgaagggaagagtgctgaccatgaccacccagggcatttaaatatctgacggcattttcagcactttgaggacagtgttagcacaagggttattaattggcttaattccagttcggataattacatcgtgtctctttaattttcccccgactatgccattcttcacttcctgtcacaaatgtgctctttaaaaaagcatacgaatacacacaaacatatagttatatttaaggtttgcataatcatttagggtgcttttttttctaaatgatcagtgtatagtagctatgtaataaatgaatgggcaaaagaattaaagtcattgtaaaataaagataactagttgaagctttttgtttggcaatgaaacagatttttaaaacatttccttggtgacagaattccaatcacatttttttctcatgggcagatatttccagagctgatgacctgctcatgataagctgattttcttacactatgtagtttccagtataaaaaaataccaatgaaaacttcgatattttagagtagaaaatgagactaagtcctgagtggtagagcatactgaacgtacgggttttcagtgaattattaacccatttattagctctgacttacttgacaggttttttttttttatctccaaacatatcactagaataatcttcaaattatgaaagaaaaggacaacatatcctaatttaataagcttaggaaagtttgacagtcataaacagacacaactccttttcctttttccaaagaattcttggcctttgaaatactgtgcctgcattatactaaagaaacactcccagaaaaatatgcttaaaacatgtacacaaataggtaaatgcacccatggtagaccatagtttattaggcctttttagtgtacatttgtatgaataagtcatcaaatatagggagtgtggaaaataagagaataaagggttaatttatttattatgcaggaaggtttctagatctttgctccttcagcttttagttcaaaattccatgcatattctgcacataataataaatgccataattcaacgtatctcataatttgatttactttcaagcacctttttttctggttcagctcttgaagccttccttcttataaacttcctccaagttattttttgtagcgctctgtaaaatatcatttaaagttggtgttcataagataaccctcatgctatagagagatttgtatcaaactagtccatatttccttttgagaaccagtggtcaagtcccatgctcttatctgagaacaagccacaataaatatataaaacagccctttcccacctgtttgacccctgtaataatgatagcagtctctcagtgactgccctctggttagttactcattccttaagactgagctcttccaggacaaggtctttccattctaccttgtatatttaatgtattgtccagcatcacacctgccatggtggtagatgatctcccagaaaagctggaagcaacaaattttaattccctttgttcttcatgagtaaatacaaatttttctctctgtgtgtcaagttttcaacatgtaaaaggggcatactttatcctaagattagtgatttgatgttcagaaaataatattggagggtatagtatttaagaattagctagtgaaaagcacttgttttggttattttcatagtatcgccactatttttatagcaagaagtacttagaaaacatgttttaaattcaaaatttaggtgaattttgaattcaaaagaaaagtggacaagatttatcctgaatattagagatagtaagcacttggtttttaaatgccatttaggaacagcctgacagattttatacaagcagaaggtatttaggaaattctctggttctctcagtttacagagaagagctgagtggcagagatattttatctgacaagcttaaggtaaaaaaacttggtagaagtgaactagtgctggaacccagtctgtctgtccctggttccacactcttctcactcatactttgaaagatggcttttatactcttgactccagatcccctcttttttggacatattttactgacggaactcttaaattctggtgctgataaaggggtacaatattcctaatgtagtctgataaacacactacaaaggaactatagtaggctgaggaatggccccccccaaaagatatccatgtcctaatccccagaacctttgaatgttaccttacgtggcaaaggggtcttgcaaatatgattaaattaaggctattaaaatgaggagattatcctggattttctaggtggactctaactgtaatcacaaaggttcttataagagagaggcaggaggatcagagttagcagatgtgatgacagaaacaagaggttggggttatttgaagaaggggtcatgcaccaaggagtgcagggtcctccaaaagatagaaaaggcaaataaatggatcctcctttatagccgctaaaaggaaccagccctcccaacacctttactttagtacagtgaaactgatttgagacttctggtttcagaactgtaagagaatacatttgcattgttttaaaccaccaagcttgtggtaatttgttataacagccataggaaattaacacagggaccatcagctaccttgatctggacataatctttcaacacagttgaaatatttcttagctctttaaaaaattattttagcagatatattaccttactggttcaaactgagcttgtgatacaagaacccttaccagtcttcagaaaaatattgactaggataagtcaaggagggtcttttctcctgacactaagagcttccttctaagttgacataaagcaatcaatctaatgattattggttaattgatcagttggctgcagatccatctaatcacatttgcccacctcctgtcttatagtaactcttcactggtggtttggcaattgtatctccaagttaatctacaacagtagttctagttagaagcaaagagaagggtttcagtgtccatttcttgagtgccagagacctgaactcattcagaagtgagtgctctcttgctagacccccaccccacatttttttctgagctttcttaacagaggtcagaaaaaagaagcatgaggcagcttaggcaaaaaacaaacaaaacaatctcctcccccccccctctttttttttgagacagggtcttgctctgtcaccgaggctggagtgcactggtggtgtgatcacagctcactgcaacctcaaccacctgagctcaaggaatcctccagcctcagcatccagagtagctgggtgtgaccacaggtgtgtgccaccatgccaggctaatttttaaatttttgtagtgatgaggttttgctatgttgctcaggctggtctcaaactcctggcctcaaatggtcctcccacttgggcctcctaaagtgctggattacaggtgtgagccactgcgcccagcccctatccaaactttaataagactcttttgccatagtgtatcattgccattcagttaccgcttacattctataggatagtgctcctaaaagagtagtccttgggccagcagcatcagcattgcctagaaacttgttagacacgtaacttattgtgtcttattctagacctactgaatcagatgctcagaggtggatgtctgagtgtgtatattttaacaagccctttaggtaattctaaagcctagctgagaacaattgtcataggacaaatctgtgaggctcatcaaggctaatgaaaaaacacgttggactcagagtgagatcacctgctaatctaggtgtcatggtgactctgtcatttgccagctatgtgactttagattatgttcttagtctatttgtctcatctgtaagatggaaataataataattaataataataataaattgctttatgtgaaaagttaatgtagaagttaacaagatcatgcatatgaaaacactttacaacctcagggttattattgtagaagaaacatcaatttggattgcaagtatcctaggaccacattgttggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatctgctggcattattagtctctagaaccaagtgctaaatttcttgatttgaaagtctacctttctatttatcaggtagcagaatttagtgacagctttgaattctgtatgccagtgaaagtctatggcttgtgggattcagaaccacaattttttatcaatttccaatgacactcagttttagtaaagtggcccatgatctcttgcatttccataccatattctcaaataagtaagaagctccagggagctcgctcaacaattgattatggtcacatattttttcaatagaaaatatgtatatcctggtaggtgggaaggatggtcctgatcaggactgagatctttttagaggttcaagtccaaactcttagtaggttgaagggaactcagatgcaaccagattagacacaactatgattttcatggaaaatcatcagaattttatccaatctctgagtaatgaaaatttgcagtatttctcaacagctctatatatgtggagaaaaccacctcataagaaagctaaccatgtcttttccttctttcatgaaataatagtgacgtatgcctcttggcctgaggactcgtccttcctctgaagactaatgtctgcacgtcaccttttggcaacccctctgtgccttgcaggacagttgtgtagcaaagattctgtttgggttgctgtttcctctgagccagtcacactggtgcatcaggagatgcagctgcaccttttaagagctctgtgtccttaagcaagtcatctgtccttttacatttcatagatttttcatttgtaaaatatgaataatatgtgccttaccaatcttacaaattgttctgaagatcaaaatggatgatgtatccaaaatgctttgtaaactaagaatctcattcggttggtgttactgatgttgttattatttactctttagcaggagagtaaagatatatacagacatattgggtacggtagcttgaatatttttagacatctacgttgtatatgcctccaaggtttccccctgaacttacattaatccctttttcaggttacagctaaggtggtaactaaggatgttaatttcctttaggtccctataggatctctattttgatcatgattagtttatacatgaaatagacactgctgcagaatttacaatgtttccattctggccaactcaactttgaacatattccctaagtaagaacaaattcagtactataacactgaagaaaacatagcatccgaagctggtattgagggagtgaaaatatcttcaaaggctttttcttgattgcttaatataaaaaatctgcttagaaatgtccactagttcaacaagcattcctgaaggaaatctgtaacaaagctactgtgcattaacatttaaaagaacaggaacatgtagtctacctcaaaacaaattattattgcttgaattgcccaaactttgttaaccaaaattgaatttcgcctaagttgaattcatgtgaagagctcataatgcattgttgctatttagatagttgtcatagtatgtggtactcagtaagtcctctaaaatggaagggaaattaactacatggtataatttcaacataagtcattaatataattgtgcgaagaatatctctgaatatattgaactgctatttgaatctttaattgtgcatacaattctaccttttctgctatgcatccttaactagactatatgctccctgaggacaattcctgatttacacatctccaaatttcccgctgccttcagtacagtggtttacaagtagcatttgctttcaaactatctgctgtttaattatattcactttttattggcttttcttggggggcaatttatgcacataaagtgtccatagataaatgcatcattatcactgaggtgaaagttgtgattcttaatttttttaaaaaaacatatacattgggccacttatttttcctgtgtgacactcaatctaattatagaagtgaatagaaaaacatgatctcttttaaaaggcgcactttacgtgaaacaattttaggaattcagcttatgtgtcaagtacagtcattctgcacagtgatggtgatggggaggctctatgtactatggttttgacagaaaatattttaacttaaagccagctacccataaaattacgtaaacataaatatgcactctcccacaaacacatttgcacatctttaaacttagattaatgcaaagaaaagatatattcttttgttctagtggaatacaaatgataaagactaataaatgaataaataaagctctaggtaaccaaatcaatgtctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaaaaagccagttgtaaaatctgtaatataattaattatttccataggtaagagatattttattttttataaaacctggtctgactggtaagtttgttctagattaaggatttagctacagtttggtgagtgtttgttctctgttaggcttggtgcatattaattcgtacatattttaacatttcactactgtattaaattattaataatttgaaatcattagcttgtactgacaccatttttctgaaacagtaccacctgtttcttctaagtttggtccagaacaaaagtctgaaatctaatttgtcaagaaaacaaatgtgtagttcagaaaaaggataggggccaggtgcggtggctcatgcctgtaatcccagcactttgggaggccgaggcgggtggatcacctgaggtcaggaattcaagaccagcctggccaatatgatgaaaccccgtttctactaaaaatacaaaaattagccaggcatggtggcacacgcctgtaatcccagctactcaggagtctgaggcaggagaatcgcttgaacccaggagccggaggttgcagtgagccgagatcgcaccattgcactccagcctgagtgacagagtgagattctgtcttaaaaaaaaaaaagaaagaaagaaaagaaagggataggaatcaccaaaagaaggaggtccaaagtccaatgttaggatgattatgctcatgacacggccatttaatctttaaaacaaatataaaagacaggtattccctgtggcagagctgagctttacctcaggtctgtgtgacagagtctcatctcttctcttatacatcctcaatcttcagacatttaaggtctctgagtatccaggatttcctttgcgacaataattaacaaatacatgtatgtacatttgtgtgtgtgcattatgttttaagcatatatatatatatgcaggaaactcacatctggagtaccagagtctacaggccaggactagatacttagatctctagggaagtgatccaaatatctagttgcagctatgtagatttcaagaatgcagtgaggggagaaagagtatacttaatatatgagtacatatacactatatatatcccatatatgtatgacatatgtaactaataatagtcaaccctcactaacacaatgtgcctaatattattgtaagcacttcacaccccgttactttgttctcataacatctaaggtaggcatcattattattatcatctagttttacagatgagacaagcaaggcacacaactaataagtggcacagtccaagttcctatctgtgatcctgtctttttcatggaccttttcctatctgttgcctccatgagaacatatctgaactttggcctattcttttttaagactttgctccctcttaggagataacaagtagcagaactcacatgttacccagccaatagtgtacttagcttgggaacaaaagactaaatttgtggaaattcctcacatttgtacaagagaacgtcccaaagcaagatactatggcctggaaaatggaagagatagtttgggcaggtggatgttttgggtctcccaaatcacaacacatgtgcaatgcgcaaccatcaatacataaatccaatttaattcagtatatatttaataagcacctgctgtgagcaagggactctgctaggacctaagctctagaaagtagctacaaagattagaagcaataatcctaatatttagaacatgggagaaaagaaataccacataactaaaacacgatgcaaataagttaataccgtaaagcgttgctaaaaaaaatctgtaggtttcagtgacttgaggaatatcatttgctattcagcggtggacactgacaaagttacctgaagcaggcagtgtttgagatggactttggaatgtgggaaaattccaacaattagaaattggagagataggttttaggcaagggaaacagaaagagtcaaagcaagggataggaaagcacaaactgtgtctggggtcaatttgactagcttctagactactcaaaggatagcagtaggagtttgagatgttgtgggtgaaacatgtggaaatgtccattgagcagcaggaaacccacatgtgcagtaccagagtctacaggccaggactagatacttagatctctagggaagtgctccaaacatctagttgaagctatgtggatttcatgaaactgtccacagatttcaagaatgcagtgaggagagaaagacagacaaacttacattttgtgggcagataaagggaggatggatgaaagatcattcagatgaacaggagaaccataaaaacagacgctatagagtgtaaaggtgaagaatgcttcaaatgcttcaagaattagagatagatagtcaaaacaatcaaatcataaacaggatacctaggattgctgtgaggaagaggtatatttaagagctagagtcttcatcactgtactcatctttgaaaggaccacctcttattgctttctaccctttccctaaactcaagcatgcatacaatcacacacataaacaaacattattttttcctaggaaaaatgttggcattattaactctgaagcaaaactatatctggaagtttttagagtagttagcaagatccaaactttatggtttgattttaattcaaaagataactgaatttttatatgcaggttaattattccttggtgggaatgtgaatttatttgtattttattcaggaagtatttttgagcatttcctaactccaaggtattgtgctaaacgctgggatcagaaaaatttccataaatgcttggatggcttttacctgggagcactccttcctatggttggcaaaaagctgacgcctttgtgatgatgagtttcagtcctagcctctaagagtttttgtggtcatgttattaagtgcaatgtttatgtgtattttttctgttccaagattttttttaaagttttgaatatttttttatgtcaccaaaaggtgctttagaagaacaaactaactcaaagccaacacagaaactggttctcttgctttgccaaagtggcagtgtagcatgtgggcaagtaagaatacttttctcaagtatttaaaacaactacagaaatcttattcttcattgtattctctaaagaataaaggtaagaaggaaaatcaggttttgatagagaattaaaaaatagctttagcatatgttcaaaccattaggtcaaaagggactaacaaagccctgtagaaggggacccacaaaagctgcccttgggacttacttattcacttatttgtttatattttttgtatatgtacatatttttctgatactgctttgacacatcactttagctctttttctatatgtatgaatattcttctcctacaacataggaatcttgatgtatacatagtttagtaatctgcattcattctttcaagataaacatttttaatcctacatggtattctattctaaggatataccagcataaaatacaatttaaacaatcacctatttttggacattttggttgcattctgacttttattcttttcaataattctttgtccagtatcattgggcatagtctttgcaatgctattatttaatgaaaagaaaattttggaaactttaacaggtaataccacaagcgaggaaacttaatacaacgaccacaagcaatgaaagaaaagtcaaatgcctcaaggagccagggtggaagagcaaatgagtgaagtaggtgtggcataaaatatggggtgatagggactttgtcaaactggagagaacatggtttgtctgaagtgagcagctgctactcagttccagatattggtgccacatgtggatgcagatctaatgttgtcagatctccaatttttcaagagaagcaaaaaaaaaaaaaaaaaaaaaaaaatctagtttttttttggtgtgaaatctctttaaccttaaaggttggctcaaattattttaaatattctgtggaccaaacatacattttaaaaaattctatctgctagctagatgcagctcataggccactgatttgtaactttctaattaaagaaagggcaagacggtgtttggaaatatatttctaggtagagagttaagcaaataaagttttacttcaagttttcctagtcacaaggaatgtaatgtggagagactgaacctcaatgtgcaaatcttgaaagatgggtaaatactgctccccacttaacacccatgaagaatttaatagaagaggggtctaaaatgcttttaatttcacaaagaaacatgctttaatgatataaaactctaacccagtgcactgtatgatgatatctaatgataatttcccttcatttcccatctgaacaaacatttcccattaacatccacctgcactacttcctttcataaagaggaggtggtatttggctatgttctggttctgattcatgagaaatcagcccaagcccaacatttctgttcttaacagattttggtttttaaatctgtagaacacaatgtttccctgggctgagttctagcatgccaagttttggctggccacagactttgacatctgagtgaaaaatctttcaacaatggcatttaaactgaagaatcaacagacctttaattataacactgcttgtaattccctccctctcttatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctcaagatttagattaaaaacaatatttccacttggaaattaagcattaaagatatagaaaaagggagtctctttttagtgagatttcactaaatacctctggtatctctccataaaatgttaggtgatcatttcttaacagctttttaaaaatgacacagtctcagattaccctatgtttcccttatataataacaaaagacacttttatactactaaagtacattaggaatcctttgaaagtttctgttttagaaactgatgttgaaaaagtacttaatttatatttaacctgcctatctgaatatacttagtggaaaaattagggttaaaaatgtaaatgtggaaaatgtttatttccatgttttatagtagttagttttttatttgcttttaaatatagatcttggttatatgtggaagacaggcataatttcagctcctttttcatcttgaagagaaacctggctctcaatttccaggaaatatatttatttagacctaacaatataccagaattttatgcattatttctaatcttcataataagtctacaagttgggtgtcattaatctgttactgataaggaaattgaaactcaaataaatttaatgcttttaccaaggtgatttagttagtgtctttttgtccatggattttaagtggtagaatttgcatgcaaacccagatatgactccaacggctctgctttctcctttagaagaaaaaaactccttcctgaaatactaacatcttttctttgtgtaattgaccatcctttcttaatacaattggttatcagagctatcatattcttaattatcagtattaccttacgactctaaaattcatctttgtccagtgtatagaattcacatcctaaggttagatataggagattaagtctctgatctcctggagcagacctggtttcaaatcttgtcttttattatccccataaatatgcatgtatttataaaattatgtcctaagtctttgttcagaaaatatgtagtgtctgacattattttgtgtataaaatgctgaaaaggtcacatccaggaaactagtcctgaccagcatacaacactcaagaaaggttctccaaggtagaatcaggggagaatcccaattgaagttgttgaggggagtaaagataataaataatattaacaataataactccatgcattgaactcttaatattcttcatcctatctatatatcatatttaatttttacactactcccattttgcgtgtgagaaaacagaggcttagagatggtaaataactagttcaaggtcacatgactagtggcattttactccagagctttgctttttgtactttgctaaactctctcccagaatatgggaacaaaatctaaagaggtaaattcaaagatcaatattaagatgataaatacaagatgcagccaggaatcaggaattggagtgggaacagatgaggaaacaaggtggtgggtccagcagggttgcatggttgaagtcagcaaatgtctgatatatgggggtgtcatgtcacattgaaagtacagctacatcagggaggtggagcgactgagagaatatgtagagggtgacagatataggactgcttggctgatttcatgtttttcctttacaaatgtaaataaaacattgtgtgttggaggtcagagggcaaaggagatataactgaggactctactcaaaaaaacatctcgcttcatgtgtcattaactgaacaggggaaagaaactcagttgtctaacaagatatttttaaaatatttatttctccaagagggttaaacctcatttacaccttggagtaaattactttaataaggttaccagatcacctaactgaatgtaactaaagtcaagaagctgcagtttgaatggggaaaggaaatggataactgtggaactgaagggtgggagaaggggatgatagtgacacaagcaaggataaaaaggatttccttaggcgaataggagggcaccaaagataattttatgaaaagacagttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgcgcagtggctcatgcctttaatctcagcactttgggaggccaaggcgggcacatcacctgaggtcaggtgttcaagatcagcctgaccaacttggtgaaaccccgtctttactaaatataaaacttagccgggcgtggtggtgcaggcctgtaatcctagctgcttcggaggctgaggcaggagaattgcttgaacctgggaggtggaggttgcagtgagccgagattgtgccattgcactccagcctggacaacaagagcgaaactccatctcagaagaaaaaaaaaaaagatacctcactgctctccttcccttctgtgtggcccaatacagcatgctgttgaccctggggaagcttcagaatgtatgatctaggaaagctgaggcaatgctgtaataacaagagctatgtgaaaggtaaagtatgaaatgtatgatggaaaccaaaccaaagagggtatgttaaagataagcccattaaggaaatagctcacctgttggactggaatctcaactggctcttttatttcacgctaaacctgtgctgagtctgcacagaaggacttctgaaatgcttatatatacaacctgacaggtacaatcagaaacagtacaaggactgcgtgcctcaacaagaatagccagagcactgaaatcaattgcagagcacagacatacttcaactgtggctatgcagacagtccccaggtatggctggtgaacagcacgctttatgtgtgctatgtcccagacttcctggctttcttcccttccgtcctaccccttcggcacacactacatatctttcacattttataaaatcacaggagatttccaaattattgtgtctttcaaatactttaaaaatatattgtcctcctaatataaaggagagaggtggagtatttagctgatgaactgaatttgaaagtaagtttgcatttttgatatatttccttccttatgagtgagtcatgaaaaatgcatattttgtctaaatattgataaagctttagaatataagagctggagtgaacctaagaggttttgtagcccggcaatttccaacccaggatgtgtctcagaatcacatagagaggtttcagattcccagccaggcacagtggaatgtggctgtagtcctggtgactgggaaggctgaggcaggaggatcactggacccccagagtttgaggccagcctggggcaacatggtgagacccctgtctctaaaaaataaaaagtaagtagaaaatacaaatcacagattcctgggccttttccttcccctgccttccccaagtgattctaattctatgtcagttttggctgcttgcaaccagttatggagaccagggatcttgatcaatctcttcatctatctgatgaggaatctgagacccagagaagtaagaggtacagtgatttctctaaggttacacagtgtatgagtccatttgcacactgctgataaatacatacccaagattgggaagaaaaagaggtttaatggactcacagttccatgtggctggagaggcctcacaatcatggcagaaggcaaggaggagcaagtcacatcttacatggtggcagagaagagagagcttatgcagggaaactccccttttcaaaaccatcagatctcttgagacttattcactatcatgagaatagcacaggaaagacaagccccctgattcaattacctccctctgggtctctcccacatgtgggaattgtgggagatacaattcaagaggaggtttgggtgggggtacagccaaaccatatcccacaggaatatgttacaagtgaagatagtctatggacactgtaaaattgaccccattagctatatcccaaactagttcattattttagaatctattttgtgtgtttgcatgcatacagcaatgcttcacatatctgcacaccacttatgtggcattccaaatatggttaagaacaaacaaagtgaaaaagacctgcaagcagccaaaattggtactaaataaaccacacataatcctccaagtctttttaaaagcctcttctcttgcttctctatctagtgaggcataggtgactcaaaatctttatctccaagcccggcccttctgctgcactatagtgtcgtgtctccaaaagcctagtggaccactcacagatacccagtcggcaccttcactcagtgtgttcaaaattaaacgtgtgctttcccctcccaacccttctcctgctttgctgctctgtttatgactctactaaggttcaaaatcatagagatgtgtttggtgtcttcctctcccttgctccccaaatataatggattaattctcccgccacatttcataaatcagtttgccatctctgttcattccctctgcccctgccctagttagtgccttcattgcctttcacctggactattgtaatagtctcctgcctgatcttgtgtcctctggtctctccctactccaatccattttactcactgttgccagattaatcttcctgaggcacagctctgattatgttactctcctactaaaaactttcaatagctccccactgtctcctgaataaagtccaaattccttgccctaataatcaagtcctttcactttctggtcccaatatacttttaccgctttatttcccactacttatcttcacacattccatgctcaagttaaactcaattacttctttgcagaatctttaccctttgattcttccatgcttttctcatgatagagtaatgttctttccttctatctctgtatgctcaaatcctgcttgtttttcaaagcccaaatccagtgtcatcttttctgatgaagccctcagttagccctcctctgagctccaagaataccttatctgtactacttttatagagcatttcacttttcactattaattctagcaaagtagacacatgtctcagctccgttgctagattaaaacttctagggcaagacatgtcttatctgtgtatcctctccagtgccaagtatacaagtgcacgactcacaatatttgtcaagtgaatgagttcatgtatgtactttacacacaatcaaaacatgtttttttgttttattgtctaaagaagattagaaataatgcatcagagaaggaatgaggatcttagagacttgcacaacagaaagtaacttaatagctaaagaagaaaaataaaaactacgaaaagaaggcatgagaactaaagatatagcagtcagagggtaaagaaacacagaagcaaataatcttatagaataaggaccaaatggttaattgagaagcttggaaaccataaaataacattcaaatatgtagcattatttttatacttccacaccctcatcaatagaaacaaatttgaattgtagttcaagataacaaccctgaatcatttagaaaagtttgaattatggtaagtatattcttttttttgagatggagtcttactctgtgaggctaggtaaataagctgcctttattaatgaagaaattcatatttttctgaatattagagaaatattaatttttcccaattaagatatgttcatgatatacaatttagaaaatataggagagtaataaaaaatcttaaaaatcctaaaaaaggtgggattataccatatgtattactatgtatgctgccttttaacttaatatatagtataaatagttcatactattataggttcttcataaacatttactggctcaaaattctatctaatagatatgtcgtactatacttaacacagcactctagagttgaacatctagcttatttccagttttataatacaaatatgtctaacaagatttaccatgggctgacaactgttgaagcagagtgaggaactcatgagagttcactatgatattcttcctacttttgtatatgtttgaaatatctagaacaaaaaggtaaaaaagcatatttatgtcttaattcatttgtgttgctgtaacagaatattataaactggctaatttaaaaagaaaaaatatatttctcacagttctggaggttgggatgtctagtatgaaggtactggcatctggtgagggccttcttgctagatcatcccatggtggaaggcagagggcaagagagcacaaaagccagagagcaagaaggagccaaactcacttctataatgaacccactctcatgataactaatgcacacactcctgcagtggtggcattcattcattcatgaaggcagagccctcatgactgaatcacctcttattaggccccaccttccaacactgttgcatcagagattaagtgtccaacacaagaacttttggagacacagtcaagccacagccatatgataaatatcttgtgcataatggcttttgtttacttgtaattattttcttaggttgcagtttagggctagactgcctggatcaaagtcttaccccatcattacctagttatctaaccttgggcaagctgctgatgctttctcagcttcagttttctcatttgaaaaatgggtataatggtaacttataggggctgttctaaggatcataagagaagatgtgcttctaatcccttccacagtacctagaacactgttagtgtgcaataaatgtcacctttgaaaaagcaaaatactggttgcataattatgcgttgtgcttataaagaaacatcacatataaactgaaaaacatacctgaaataacatgcttaagtgtgcaccatttctatctccaggctaaatgcttatttcaaagatacgaccactgctaaaataatttagatccataattaccattacgaagcattttctatgtggttgatattggccttactgggctacatgtttgatgtgtactatctcatttaatcatcataagagttttctgattactttatagataaagaaactgatgcttaaaggtgaattaatgtgcccaaaaggacacagggtctgttttcaaacacaggattgaacctctggaattcatctctaagctactgaaaatgacctttgttccctgcactttttttttttttttttttttttgagatggagtttcgctcttgttgcccaggctggagttcaatggcacgatctcagctcaccgcaacctctgcctcctcggttcaagcgattctcctgcctcagcctcccgagtatctgggattacaggcgcccaacaccacgcctggctaattttgtatttttagtagagacggggtttttccatgttggtcatgctgggcttgaactcctgacctcaggtgatccgcctgcctcagccttccaaagtgctggcattacaggcatgagccaccgcgcccggtccgtaccctgcactcttttgcatagacttcagtctttctttctttcttttcttttttcttttctctctctcttcttccttccttccttttttctttctttctttctttcttctttccttctttctttctttctctgtctctctctctctctctctccctcccaccctccctctctctctctctctctctttctttcttttttttgaggcagagtttcattcttgttgcccaggctgcagtgcaatggcgcgatcttggctcaccgcaacccctgcctcctgggttcatgagttctcctgagtagctgggattacaggcatgcgccaccacggctggctaattttgtattcttagtagagacagagtttctccatgttggtcaggctggtctcgaactcctgacctcaggtgatccgcctgcctcggcctcccaaagtgctgggattacaggcgtgagccaccacacccagcctagacttcagtgtttctaatctttattcctcagaggcagatatgaattttggacaaagttttggtccaattttggatgtttaactggacctttgggtaaagtacctttctccttcccattcactttaatcagaattatttatttaacaaattttattctagcaaacaattttagagaagaaaaagtagtactccataacaagctgctcttaaaaatgcatatctcattctggaaaaactaatagctatcatggttttaaacaataattttccattggtttgattatcttatgtccactgtgaaacaacagttcattattaaacaattcattatcaaacacacaaacacatatacacatttaataactttaaaacagtccatatttacatattttactttaaatatgtaatctgaaatgtgtatgcatatgtgtatgtgtgagagtaagacatagaccccggaagtctgaatttggaaaaaccctgtgaaagtctgaaaaaggtggttttctacaaaccttatgaaaaattaagtcatagaaggtcacaattttaaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacataatttgttttgttttgaaaaactgctcagcaaatgcatacaggtcataatggcaggtaacagaccatttattgaagtgctgaaacaaatagaaaacaaagtccaggacaccatcacagagcagtacttcccttgtgagatactctcagctaagtaagaattgagtgagacaacaataaaacaaatacccataggcttttcaaacagtaacaacccgctcagggttagcagcatttctagaccttgatggtacaatgatgttctcaacctttgctttcagacactggatcactgcttaagtagcctttatcttttccccctaatttttgttgaagatgcccttgaaattagattatatttgttcctaacaaagcatatgtatattgtggcatcactcttaaaaccaacaattgggcttagttttatgaagaaaaaaaatccaccaacctttcatgctgagatttctcatgctagttctcagcacagaagtgattttttttttttaagttgcataaagcctagcaaggtttaagttttcccagcaaggagaaagtgtttttcagctgttaaatttttcagatgctttttttgaatttggataaaactcaaaaacatgtttgttttaaaatgtaaaccttttcatgtacagaggtttgcatatagagaaatgctattactatgtttaaagatacttgcttttgaaataaggaggtcacatgcatttaaaaataacaaactgcatgttgctttatgaatgtcctattaagccctaacgtaaatatgatgttctggaggagcactgatgcacacgtttgctgataggatcacttacaacactgcttgtggatgtatttccatgtgagagcaaagggtggtcaggtttgaactgaagaacatccatatagtcagctaatatgctttttaaagaccttttacctcagttgcaacacacttctttgtcctaaacctgctggattactcaacttgttggctggactaaagctgacacaatacatatttcaagcacaaaaatgatgaggaacacatagggatgtcagcaaagaggcaaagaggatggtaagtcatcggaaggctggtcatttttttttttttaaacagttcaatgtctttactgttttctgtaatattatcattttccatttttcaaacaatggaaagaacaacaattagtttcatttttaaaattattagatcataaaggacaagtttaggaatattgtttctagcatactaatagatgaagttagttgtaaatcaatagtcttatttctctgttttaaaaaaatagcaaaatacagtattctgaggaaagttctgacagattggagtgttacaggatagtctgaaatctgtttcattatagaagtttggccaatatagagataatatattttaaatggcttaagtatatattttttgtggattgcacattctgtaagacggtttgagtgccttgagatccaagtctttaggtcaagactgaactctagaaatggccccatcgaatctacaaaaggatacattaaaaaaaaaaaaaacctcatttcctgtaagctgctgatgctactcaacagagttgaaactcaggtcacacgcatcctactactctagtgctgccccatttactaatccaaacgaggataaaccctgagagatccgttatgtttctacataaggagtgtacaagcttctcttgaaaatcattgcattgggagagacacagagaaataacagaggtgagaatccctccccgatttgcttgctaaatccgtattcattcctgaagatccagatcaaataccacctgactgttaggccttctctgagaaactctattttgcaggcaagtattggaacgactctatgcgcatctccagtcccaatgcatcctttaaataatctgtttcctctctgtttcttgctgcattacagacatctgtgttacacatccatccttccctaatagtcagtggactcttttaggtgaaggactgtgtctctatgtccctatgctgaaaggacaatgggaagagatggtgctattgatgcccagaggcctgggtcaccagggaagctggagtcacagcaggtttgttcagagggagtaaaccacaaaggaaatgtggctggtgatgatgatgatgcaaagaacggtgggggaaatctctggcctatgccttctactgaccctcttgccactcacaagtgtctcacaagcaccaaatccaacttggaatctagctgacatgggtcagccactgttgtagagcaagggtagggtgagggttgggtctgagggtaaacacatccacaatgtgggagcaggaagatgtctttgcaggggggtgtctaggactatggacttaagataacctcacagggtcaccatgccccagcatgacccagaagggcccagagcaaggaagacatgacaaaggagcctgaagacttgaggaggccttggagctgggacaaggaagacacatcagggatctacatggacaggaaactaaagatgaggtgggctctcagacatctcagggaatttgagctcagaagacaacactgagaagaccagacaccatagtgagtagactgtatctaactgctctccaccctcactttcatattgcatttggatggcactccaaggaaggggagaggagaccacctagcagaatggaggccaaatctgagttacctcatagataaggaaagaaggcctgtgatttttaatgggtcagtcactcttaaattttaagcaaactgtagattttctgaataggagaagatattatcttaatctacacaaattttttgttgtttttttggcagggtttaaaatatttttattcatgacttatagtagaaactacattttatattgtgacccagtaactgtttacacacatacatggatgtatgtgtgtgttctggaggtagaaagtaaccaatctgctcaaattttaaatattaagattattcataattctttaagtagtttattgtttggaaagttatagaccaaggtctagaaattcagcagacctctaacctctaatcaaggacttttaaaaattaagaacagtacctgattttctgatttagtctttgaaatgccagtgctattcattctttgccttattcactcataattatttattcattctccaaacatttattgagagcttactgtatgctttatactatagacctgcagcacaaatataggcctattacttcacagctgctttaggatttatagcagtactggtcagatagttcttaaaaaggaaaagttttcagagtgcaacaacctgttcacaataattcctatgtagcagtgaagagccttgacagcatctcttttactttctcattgtggttctagtttaataacataagtctatttttacttttcatatttaactttaattaaacatgctatgagtgcaatcatgagattttaataaattagactatttgaaaataattttcccataatgatgtcttcctcatatctttcatgatacacaaaaagaatatttgtacaaatattttgttgcttcaaatatgcagaaaactgaccattatttacagtgattttgaaaataaatgagtgaaagcatgcgaacttataaggagagtaaataagcagcacaccattaccatctgagacagcatggctgctcccctcttggtgagggcagtataggtacagcaagcagaagacagatcataagtatttactatcagaccttctttaagtgaatatgtcctattccagtagaaagtatcatataagcatacggcctgaatccaattcaattatttacatggctctaccagtaaatggttaacactgtagaccagaaatttagaaaatgcagaagactgaacgatatgtaagtgactgagaacatgagtctctctcctcatcatgtaggacatgggtcgaggtcatagacttaattggtaggagttgctactttcgaagagtgaaatgctttgaggcttttaagagaattttaagttgattaactttttatttgggggaattatgatgtgagctttattaaaatatcacaattcggcattgtttcataaacataattataggccaccttttcaaaaattgcaagagtagtactaagaaggtcctttgaactaaggttcaaaggaccttcttagtaactcttgtaatttttatgggtacagttagttgtctgcataaagtcattccattttccaaagctgcttactctttgcacaaatgacaaattggcacatgcacaatggcacaggaaaagaagtaactgctaaggtcacatatgtgaggacgttgcagcctttaagtactggaggccaaagttaccagaaacatgggcagacagattaaaattttcccttcttatgtttgtgcattgtttctatatggaaaattacatttttctgagagtatatgtgtaaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccctggaccacagacaaaggtaacagtagctgatctagaagtaatccccatataataatataatagctcaggtcttaaaaggaactttgatcttttaaatttgccaatgccgattgttgagacaggaaataaaggattgatttggtagcttttggaagatggtaaggactcctgcatacagccagtcctgactctgcccctcctgggtcactcagtctattttccctggatccgcatgctggtctgaaagtcaatgcagtctgccaaagtggtatactgttcccatgaaataatccaactgtggtatggagaaatctttttttcttagaccaagttatttttacaaaaatacttttgcgaagaaatgagaggaaactaaaaccctacacaatcctagaagtggattactgtctagagtgcatgttttttattccatcttataaagcctaactcattttagggtggctagtgcagttaaggtgcagacatctcttggttgtttttctggtgcttttacttgcatgctttcctgtttccaaatctgcatccatattgggggttacccacagagagctgttgtctcctctctgaagaacatctccatcttttggtcactacttgagtagagatgagtgatgcttaatgaaatatcattttattacaacggtcaaaaattatggattcatttcttattagattatatgctctgaatgttcaccaccccccaattcacatgttgaaacttaattgcccatgtgatagtattaagaggtggagtctttaggaagtgattaaatcatgaaggcagagccctcatgaatggatttgtgcccttatataaaaggtgtgaaggagctgtctctctcccttttcctcttccaccctttgccatatgaagatacagcaagaggtgcgatcttggaagcagagaggacttcaccagataccaaatttgcaggtgcctcaatcttgaatttcctagtctctgtaactatgaaaaataagtttctgttgtttataaattacccagtctcaggtattttgttatagcagcaaaaatggactaacacattaggtacaagcatttatttgacatttaaatgtaatccctcattttctaagaaggaataagccagaatccaacatcaaaatgtttcaaaaggaatacttcaaagtgttttagctgtagttctttgtcgattaaataaaaaaaaattccaaataatggtggtcagtaagagtgtgtgtgtgtgtgtgtggggggggggggcggtgtatgaattcctgtgctaagattcagatctttgaaactgttttctagaatgttatcctacatgtctaaaactttttttctaagtgtatcagagatttgggatggagtggtaaacacataggttactaggaggtggcttgcctctgtacccattctagatgagtaatgttaatgactgatgataatgtaatgatgaaaaaattggttctttttaagtaaatagatagtctacagacaccctgtcaacagatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaaggttaattttaaattagaggtgagaattattcttcatgtatcaaaaagcctagaaatttaccagggattaaaggtagaacccattttagcctatcgaagtgtgagaggtaaggtgacctgtttagatgaatatcttgaaatgattctctggagcatgcctgatctgttctcaatacccacacattagaagaaatgaagaataatatagagactacacaaagagaccatgtaaaagaagaaccctgataaaagaaaaaaaactcttaattttatcactgcaaagacttcttgtacaagatgcctctgcaagtgtcctagtagcatgactccttaaacaagtaggatgcgtgtatgtggaagatatatatatgtatatataacatttaaaatctccctcgaaccccagcttctgagtataaactatgttacagaagcatgtggataatatgtgaagctttctaggagcatcattaagaaaatgagacatttgacactctgagccctaggtacactgagtcagtggcatggtctccaagggcactgctggcagcactaaagcctggctcataaccatatgtgcacacctcaagaggtgtttgactgttcaggtagaggataagccatttcctaggcctggttccttccattctccttagcttgtagttggcctgaagggacttcctagactctaacatgtttgcctctcttttgcttcctttctggacactgtctaaggatttaaaacacacatgactttcatgtccacaattttctgccaaagagggggaaaaatgccccagagcatgtcatcccttaccatctgcaaatgaacttctgtggtcaaggaatgctccaattaccacccagaacagctttgtacaactcctgaccctcgggaagactcgaggaactcactcccagaacccagatgctccctgtcccagaacacagggaagacgccctgtcatcacagtttgcacggcagaggcggaggtgatgctgttagtgtggtatttccaattctctagcgtctttcactttccctgaagttgctgaagaatattccatttcattaagtatgtagtaatacacatgggaatcagagagcggggaaagatggaggacgttgatgacatggcctctagcactttatttatgagaacatccagaaatctctatctacatctgggagaagaataatgtcaatcctgccctggagacatggatcaggcaatgttgccagtgtgtatttttcccttcccaataatttactgattctggagtctaaggcagagcgctgatgataatttttacattcatgtgagtgagcctggccctttgagggctggtgatgccaaataaacataaatgtatgtaaccaggtgaatacttaccacctcccaacccagaaatgtcataggtctctggtggtgctttgcttcccacaacactcccctgaagggcggtgagggtaggtgttgccatcagagcataagaagcagagcttgaggtggccttggaggacttcagggagcactgcctttgcagtaaagaatgagactaagcaaacaaacctgttagacggctcatttgtcttttccaatttttttattgtgttattcatcctttcatcattgatttatagctattcttaaaatattagggatatatcacaaatatttttcctagtttaaaaaatgattttctaccatagtaatttttattttcatgtaataaaatttaaaatacatgtattttttaaaaagttttcaggctttggttttatgcctggaaaatgcatctcatacctccagtatgaaaatattcatgtatatggcaaaaattatcactgaaaattacagaattagtgaggatgcagagaaatgggcagtctctttttttgttggtgaagatattaaccaatgctagaggacagtttagtaatgcattttacttttgcagttccactataattaattgatcctaaggaaataatcatgtaagtgtacaaacatgtgtacatatgcatgtgcatataaagacagttattgtggcattgtttagtaagaagaaagttccaaattcccaactgtccatcaataagtgattgagtcaataaattatgcatatactgaagtgcaacgttgttgtcaaaagataatgtagatctatatttattaacatggtaaatgactattacaatgttaagtgaaaagaatagaatacaaaacagcaagtaacttctcctttcagtctggaaagagaaagacaaagagaaagaaaaagagaaagataaacaggactgtatggaaatataatatttcctaagttattaatagtgattatctctgggctgtgagatttcaaaggaatttaaccttgctctttataaatactatcaatgaaacaaattcaagcaaaactaaatgtatacttttttagaattaaaaattagaacttttattttgggggaaaaagaacttacctaaaacctgcaataaatacttaaaaattccaatatgatcttcagtcattagcaattactaactagctctcttagtagggtgacatcaatgtctgcctcaagtttcccccaagtttgacactttgagatgtacatcatagttcttcccttaaagaattttaaaatataaaatttcaagtagtgaatataacccaaatatttttatctagggcatggttaggtaaattctgggggctttatgtgatattattcagatgttatagtgctatttataaagagtttttaattataccaggaagtatttattatataatattgaattaaaatgggatacaactgtatacatgcaatgtatgctcaggcatgttaaaatctagagaagacactagaaggtgatctaaaaaattattaataatagttggttctgtgtagtggaattatggatgtttcccctttactctatactttctaaatatttcacaataagtgtgaattatagaatcataaaaaaagtaaatattaaaaaaaagctgttttgctcgacagctgccaaattttaccccagatgtatcagcaatttagcttttagtcaaatgaccctaacatcatttcctaaagggaatatcacagaatggaatgtgcccaaataaagataagccatcacggccaccacctctttctaagctatcattttataatgcttaaaataaatctgagtaagggatctttcttctgttggaagttataaacttccacctccttcagaccctctccatatcttctcttgcattaccagcacctggaatttataattaacctatagtaccctggtacgtttctaggtctggaagctgtttttggaggctgatggtgtagatcaccattagggatggaggattatttattcattttaaatgggagttcccttgaataacaaacagggatgagctgctatataagatcttgtgtagttaatatgctttcttacccttcttatatatatatttattgattgattgattttttgagatggagtctcacactgtcgcctgagctggtgtgcagtggtgcgatctcggcttgctgcaatccctgcctcctgggttcaagagattctcctgcctcatcctcccgagtagctaggattacaagcacccgccactatgcccggctaattttttgtatttttagtagagatggagtttcactgtgttggccaggctggtctcgaactcttgacctcgtgatctgcctgcctcggcctcccaaagtgttgggattacaggcgtgagatcccgtgcccggcccgcttccttcctcttctttccatccctcccttctttcttcccttgttccctctctcacctgtctacactcctgtctccagccctcttaaataaatagcttttctgtagtgttagatgccagctcttaacatttagagacaattcacactataccaataccatacttcaagtagatgatctaattgtttctaaatcatcatattttagcaaaaagataatgggagaaatcaaagttgtctctcacatatgtatgatgcatactagaggcttggcaataaggcagagagtagatattttttgagaaagtaaataacaaaacaaaacaaaaagccaaaacacaaaaacaaactgggtattgtgaggacagggcagagggaaggagcaggcataagaaagaaaaggaatgacatcggtctcctggtccttgcaaaggttattcaagtccctgttcctggtgttttggaccagatatcagcctacaaaccaccctggactgtgagctatttgaaggcatagatggtgtcttactcacctctgtattttctgtaccaaacacagtgcctgatacaatatactcaacagatgcctggagaatttaactaagccctttcactgccctttcttactggcctcagctagaaccaaaacaagaagctaaaactcctaatgccacaaatgctaggtgaaaccctatcctaattcaaactcatttcttctgattttgcaccttggtccccaaactgctggagaaaatcccatgacagagcagataggtatcaacatcaacccaccagactcacctgcaccttccacactgccaaggagagtcctactgtatttctctggtcaacttgctgtcccatttgtctcaagaacgatttcaaatctctactttccttaaatctcttccccgcttattcttagcaggaccttgcccctcagtgcccatcacttgggaaacctcttaacctttcagtaccaaatctacacgtgggcttgcatctgctcctttcctttactcctcctttcttacaaaaatagaagatgtgtccctccttccatctctccacttgtactcaggattccatctctctggccttatcagtaatcttatactgccagtcatcctatgctcttctctcttctgcacattggatctctcctctctacggtattcttcccatgaaaatacaaaaaatactagtgtttccatgcttttccaaccttcttttgacctcacttcccccctcaagatattgcagtagctcattttcctttccttcatagcaaaacttctgagtggcccacatttgctgtttcttcacttctcattctctcctcatcccattacaaacacgttattgttttgaccacttcaacaaaacagcttttgctgaggtcaacaataagctcaaaattaatataagcaatatatatttgttagtctttaacctacttgattgctcagtaacatgtcacatcactgaccactacctttgaggcactctcttggcttctgtgcctatgttttctgattttcctgccaccttcttggtggctccttctgagggtattttatggcctcatttttttctaccagcggattaaatattaagagctcttcaagtctcagtttaggtcttcttctcaatctaaccctgtccctaggcaatgttattcatgccaacagattcatttaccactatatgtcgattaccctgaattcatgtctccagccttcatgttacttctgaattccagttttatgtatataaatacctgtgcaatatgctcactatgtatctatccaaagtacctcacactcaacatctcaaaaacagaacttacaaacttctctccactccagtcctcctttggtgtttcatgtaactgtgaatggtattatccttcatatagtttgataagccccaaaccaggagtcattgttgccacttctctcttttatttcacataaccaaccatgaaaaagtccaggaatattttacttctgaattatctctcagttccatcaatttcctcccatttccactgtcaatactctagtctgcctcttatgtggtctactggaatagctccctcactggtttcctcatatccatttttgatccttccaaattatttaccaaagttaagctaccttgatatatatttttaaatttttaatttcaagataattttagattaacgtgcagttgtaagagataatacagagagatttgttattctttttacccagttttgcccaaatggtaacattttatataactgtagtacaatatcacaatcaggaaattaacattggtgcaatccatctgccttactcaggtttcatcagttttatatgcacatgagtatgtgagtgtatatttagttctgagcaattttattacatccatacactcatgaatactaccacagtcaagctacaggacagttccatcacaaaagatcccttgcgttatcctttatagcaacactcacctccatttctatcccaactccctaactttgtcatccacaagtatgttctcaatccttacatatttttttcatttcaagagtgctatatagataagaatcgtaacagtacatcatcttgagattagctttttcacccaatgtaatacccttgtgattaaaaccagttattgtatgcatcaataatttattctgcttagtgctgagaggtattccatggtatagatataacagtttgcttaaccactgacccactgaagaaaatgtgggttgtttccagttttgggctattacaaataaagctgctatgtacattggtgtaacataatgtacaggtgttgtacagttatgtttccatctctctgggataaatgccccaaagtttacccttttaaaaaacaacaatgatcatgccacagtccttcttaagtttgctcctctactgtccttaggataaacacaaaaatccttaacatggcctaccaaggacctgttatcatcaggccttacgtatctcttcaacctcaacctgggctgctagtcacctttttctctctgtgcagctctcttcagggacttcatgctgttccctctgcctggaatcctcttccaccatccatccttactttttgtttttaaccttcaggtgtcatctcaaatgttactatttcagagaagcttctcctgaatttccagactcagttaaatcttcttcttttatttgcccttagagcacatggtacttttattatatagtggtaagcacaatttgtaattacaagttatattgtgagaccatttgcttagtatctgtcttacattccccagattataagctccagaaggagagagactatgttaatattcctttattatatatacctttagtatttagtagacactcaactttgtgtccagtaaaatttggctgaggcttttaagacatagtcctggaatcaagttctatctctaccatttattagatgttcttataaaataaatcaaacatgttaaatctcagttttctgatctgcacaattaggattatagtagcatctacttaatagggtagttttgaaggttaaatcagatagccatgaaaagtatttagtccagtatctaaagcaaggcaagcactcaataggtatttcttattgttattattagttgaacaagaaactagagtttttgtattttttttcctaactaggcttttgtccattatcttcatttcttgcctgttcccccaggttctgattcttgtaacttttgagactctgaaaaggggcccttagtttagatcttggataaccagtaggactactggttcttaccccaggtatatgctctcagaccagatgtggctctggttcccattttcatctcactcagtacttcctcctcttgttttccagtctatggatgtcagtgtgggtaagaatgcctcttccctactcctagtttccagatgttttctaaacactgctttcctcttgtctcattccttataattccccatggaggcaaagtatcccattggtgggaaagcccttggtctatatttctcaggtaggtagaactgatctatccaaatttgtaagcacaggagtttaacctctttgtccttccttttctactgagactatcgggaggtgatgacctggaaagtgttgctcatatgcagatccacattttcctgtaagagagcttttgaaaggtttgactgaagggaagagagtcagcaaacccatttcctctttacactaagctatgctcttcaaccaacctttataaaaattttggttccctagctatcagttcttttgtcttatttttcaataggtttagaattcaagtggggaaaagtgatgctatttatgggccccctcgaagattccaacactttggtatatgattttgcttggaatatgattctgtttctcttcatcttttttacattttagccagttttcaagactcagctgaatcagttttacatgaaactttctagcctgcaaggctctttcatgaatgaaaccctatggtacttcctggactgtatcattccttttggaacttagtcatttattatcttatgtgcatacacaacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagaggttgtcgcagtgcagtggtgaaagaaagaaaaggttactatgggcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagagggaggtaatattcctggctatagtcgattggtgttcagagtgttttgattctctgaatgagtcaaaagattgaaaaaaaaatagccactcttatcactaggaaaagaaatgaggaggaagggtcctgaaaatggtgtctgagcaatgaaagacagtgaatattttaaagatcacaaaatttaatttattcaacctaaatgcataaaagtacaggtggggacattatttatgcaggtatatgcaaatcactttataaaataggcaaagcccttctgctttttataagttgccaaggtggttcctgatattttaaaagctatgcacctttaatgtaatttcctaagagttggaatccctctgtcgaaatcatagtcattgtcagagcaagttgatttttttttttcctatcctctgggacatttacaaggatcttataaccatcacaaaaagagtggtttccacagagatgtgactggaaaaatcccttggaaattgctgaggagcaagtcacagtgttcaaagcaaagaacataggctttgaaaacatgaacccatctgacctcttgaatttagtacagtgaattcctgagctctgaaacatggggcccggctgtgcatgccatattggtgctataagactggcagtaggttggctgtggcatggtctatttcaaactccttcacagtgcccagtgttgcatgttcccagatgacatttggttggcagaagctgggcttccaaagctggcagcctggaatgcagcccactgtgttttgacaaacacataattgaccatctgatcaccagcctacgttctgcactcaggtcactgggggacctgggctttcaataggtccctactcctcgtcttgttcatcttcccaaacctttctccagaaagcaatatagagaaggcttaaacacacccacgcatatcctcccatttgcaaaagagaacatagtacatgaaacataagctgttgaaaatttcctttaaattgtcctggcagcccaaagtgaacaagagaaaagcacacttatggtgaactctaattcagagagaaggaatgaatacactgaattgtttcaacacccggctgtgcataagttgcaattcagttcaatggtttggaaattttgcttagaaaaagggagcaatgagaaaatgataggaaattggggcattgattgactttaggggggcattatttagaaactgtttcattttcaggtgaaagaagagacaagcaggacactgggaatgtcttctccttatctgcctgctcctccctcacacccactatgggcagtaggaggcacgcgagcctggtgaccagggggcagtagctcaaagtgaggtcatattcaaattgaggtctttgctgaagatcccataaggatgtattttggtctgaaatttgactccacacaatgtttcagcctttctcctagaaggcaaagattatgcaataggccaagatatgctggaattacacaaaggttaatgtctatttcaacactaccaaatagcctctccctccatcctacccctactgcacagttcaggcctttggcttttacctttgacctggtctccctattctgagtcagcctctccactttcaccaagtgctctttctaaaacatacatctgcttacaattcttcaaagcctccttgagcctgcaggatcaagtccaaactcctctgcacggcatacaaggtcctccgtatggcaggcaaggtcccctgcctgctttccagcccaatctcatactactctttcaaccaccatgtttcaatcacactgaactattcactcctctgaatctcgctgctacttaacgcctcctgattttgtaaatgctcttacatttttcttgattatgatccccttttctttctgctctttcatatctacctggtaaactgcaatttactcttctgactttaagacccagcctggtcaccttaccacatccaagtgggcactcctccttcattcctcttactacgtcttgtatatacctgcatttcagtgcctatcatatgctatagtctttattcacttatgtatctcccctatcagactgagatttctaacaaaagaaagcatttcttatttatcccggagtttccagaaccaagcacagtgactagctttccataaatgtttgttgaatgaaaactaaataaagagctgtacatgataattaatcaaaacgaagccaagtagtagtgttagcttttataagcatagtaggagcccattagcaatctaatgaaggcagaagatcccagcagtaaggcactttctgatgggtatggcaggggctggtgactggctggggtgacagtaagagtgagggataaattctgtgatggaggaaggtctttttaacagagactgccactaaggctgtaaattaacacccttttcaagacttaatattcaatactgaaagatattgtcctgagaataaatctgaatctgaattgtatagagacctaacttataagaaccaagtttcccaaataaggtaagtctgtgctacctgcttcaaggtagcatggcagattatggagggttcctctttgtttctgctaaacagtaatggaatgggaaattcttgggggaacatctgagagctcttcagttcctattgaaatccaggtcaaatacagattgtgatactggactaaatgcactgctaagagaagatcgaacaagcagaattctgtacctgtttagaggaggccattgaagaggcacttggagtcaaagcactggggagataatgttctgatctgttctcaagggacattggacatttcttttccttttgtcgagcctctggggcaccactctggagccatcaaccatcaactgtgtctatgggatacttgaggacagtaggactgtcataagcccggtcaccctgctgatatgagggcagcttcaagatttggaacaagccaagcaaacatgaagcctggcccagggatggcacaaggtcatgggtatatgaacggattatctgctcattataggtcactcccccagccttatgtgtggttaaaaaataggatatctctagaagctatgcaactgatggctgatgtagcatagaatcagatttgcattttcctatgagccagagacagcctttcaactacactttttatctcaaaagtctcccccttgattcctaattggtgacacaggtcccctgtactgcttgtgtctgaggctcgccctatagcactgacgtcacaatagctgagccgtgcgggcaggagtgcactgtgctgactcatcccggtgatgtgaggattaatgccttgtctaacacagagctattatgtgaactgtttttacacaaaagaactgtaacaaaaatgatttgccagtcagaggactagaaatatgcagtgctaggtaactgaggggagggctgtgcagatataaagtggtaaccataagcatgcatattgacatcctccaaagcatttacagacccactctatcaacactgaaatagagaataacaagacttgtcagggacaggtaggacccacccctgttgtataaatgcattacacacagctccagtctttggggagtttaatcaatctcctttctctgtcaaataaactgtcacgttacactttagccttagcatcctttggaggattctgcctccctaaatatatttgccactatcttctaggaatgttagtggaaggcacgcataaacaaaatagccatgggaacctccattctgtgcaaatgattataatacaagaaataccttggagtgaagagtcagtgaagcaagatataatgttgtgaataaggaacagagctcaccagagagtgagaagcagccagaggataccgataattatttatcacattaggtgactatcactacctgtaggatcttttgggtggtgtctcttataagtgactttgattatttgggttcattggcctagaatctttttcaagcagttcaaaataaaatttatttaaacccattcagtgcagcctggtttgaattttaaataatgaacgttctcttttttttcatataaaatcgtgtttttttttccccccgaatacctttccatcttttctaaaaaagagtggtacctttataaaccttctggcacacgtgaatctgggatttctttttttcccctgtagacttcataattttgcacaaaagtttagtctatttattttacagtcttgtacttcttagtaaagggatattagaaattttgtcaataaatgaaagctctgatctagaagttaaaattaaaaactattggacctagggatgggtacataactgaagaatacataattgcccaatgattgacaggggagcaaaagcccaactgttgctggtatttggctgaataatgtaagctatactttaaaagagcagtgacttttgcaaacagcagctgcagccaagtaaagggcagcctttatagaagtacagtatctgggccactggtattttctgcaccctcatggatagcaacttagtattaccaccaacagcatacactccaaacgcaaaagaaactaatacacactacagaagcactagaaaccacaacaaagtcaactaggaaatatgccagtgaaaaccacaatttcctaaatctgacacttttttttttaaaggtaaagaaatcacttttacttacgtaaagagaaggggcaggtcacagactgatggtcaaagatctgaaaatcaaagaaaaaataaggaattaaaagcaaaccgatatatgatgcaaaaccaatatataaaagcaaaatgatacagtgggaagaaagaaagcaaatctaggcatagatgggactggttgttcctaaaggagcctattttgtcacttctagcctcaaaataaaggagacccagcttcataaaaactttctaaaggtatgaccccctgctatgatgaccaagacagtacttcccagcacaaggagtgcaaagacctttctttgttcatttcattctaatctgtatcatataggatttggtagagctatgttaccatttaacaaaatagccactagccacatttgtctatttaaatttaaattatttaacatttaataaaaagctaaacatttagttcctcagtcttgccagcttcatttcaagtgctcaatacccacatgtggctggtgactgccttactggatagcacagatagaaaatgtttctattattgtagaaacttctattgggcagcactgactagaataggtaaaagctttactatacagtacatgaccaattttagctaattttgacaaagatgagtcaaaccctgataaactttgtctcttttaaggtatatttagtatgtttaatgtccagaagttcctctgaacaaattcaatacattcgtgtgtagctaagaactcagtcctaagtttgccccggacttgccttctaaaactgcctctaccccttctcaccagcctagaatgtcccctctatggtggaaaataatctgataaagtgattttaaacaaagcttctctcccaccaaacacaactctgtttggtgatgaaaatttcagatgaaatgatgaaaattttagattttggagaagctgaccctaacagtgttcttgttctatgtttaaaatctgatatttcactctttaaattacaagccaggctaggcgcggtggctcacgcctgtaaatcccagcactttgggaggccaaggtgggtggatcacttgaggtcaggagttcgagaccagcctggccaaaatggtggaaccctgtttctactaaaactacaaaaattagccaggcatggtggcgggcgcctgtaatcccagctacttgggaggccgaggcaggagaattgcttgaacctgggaggcggaggttgcagtgagcccacatcacgccactgcactccagcctgggtgacaagagcaaaactccgtcaaaaaaaaaaaaatcacaggccaaaaaaaaaaaaaactattataggactggtctgcccatcattgtgctttgtttttttttctttcttttttttttttttttgagatgaactctccctctgtcacccaggctggagtgcagtggcacgatcttggctcactgcaacctctgcctcctgagtttaagcgattctcctgcttcagcctcctgagtagctgggactacaggcacgcaccaccacacccagctaatttttgtagttttagtagaaatggggtttgccatattggccaggctggtctcaaactcctgaactcaggtgatccacccaccttggcctcccaaagtgctggaattacaagtgtgagccaccgtgcccagacccatcagtgttttgatagcttctcttagaaggataaaactgaagtaggaggagagccatgacaaattaataaaccaaaaaaagatactgagaaaacaaagcaggtccccctacctctagcccacttaaatatatcaagaatttaatacagggtgattcaatcttgcctctctgacaccatgattttaacaacttcacataaggcctccagaaatatgcaaaacaaacttcactaaaggagatcaagtagaaggacctgattaagtatctttgcattgaaaaggctaaagcagaaaaccagcaattaaagacatcacccttcctggaaagtttctgggacaactgcactattgtagagatttcttcaaagaaatgatttccctttgtggtcaatgtgaaaccttgctcaagtacatgcaggtgtacttgatgcaggatggtgacaagacgagttaagatgaaaatctccagcctggattattataatgctaatacaagagaggctggagatctccaatgctttcaaattgtttcacaaaattcatgagtttaatgaaaattttaggcaagagaattagattatgtatgattcattgaaagcacatacaaatttgaaatatatatataacactgactagtcttcaaagattttaaagctctaagttttgctatattctagtcttctctgcaagccaggatattagactatggcacaggggcatattttcttaccattttcctccctccctctctcctttcttccttccctccctccctccctcctttcttacattcctctctctctatttctctttctttctttccctctccttttttgaacttgctgtcttctctaaccttggggagaagaagaaaatattattagcaattttctatgaaatatgttcaatgatcatttttctgttgcatgttataaacccaataactctcaacaatattatgctcttctaaaattatacctagtgtttatgttcttatatctaaacacataactttcttttctaaatttcaaggtgcatttattcataaaattagttaaaattaaatttttgatgtgatcaaaagagatcaatgtaagttgtacccaaattgactaacacatccaatgtctggaatgaaaaactatctttcctggatgtcaaatgacacacaggatggctgtcaatgataggaatccaaaatggagagaaaaattacagtgtgtatgtcacagtctaaaacaaattaaagccaagttagatggaagttttattggatataattgttgtacttatatgttaatataaaatgataatatgatcccaaacttaatagtatggctaaaaatttaatctcagagttcttacacaattcataaatgttcataggcatcaaaagacacctacttcttgactgaattataatctgctatgtaattctgagaatatgtattaatctacatagatttatatttgctcaattcaaattgttatttcattgatacatgctctttccacctaagtgatattcaccttatatgtctataagttgtttttatctgaaatgcaaagaattatctataaaagtttcacagaggattaaaaacatttgcattaagcacactttgttcaaagcataaatatatctagcaaagagtataaaactgtaaagcccaagtaattcaggacgttaaaatatcagggtggaaggtgggggatgagcagagagagggggatgacgaggggtgaagtttaatcttcgtattataatgtctgagtggaaattattatatagtgtcaatctccaagaatcaaaaatattattaattataactttaaagtcaattctagtgtagtttatgtaaagttctacagcagtggttttcaacattttgaagtgataccgatccctatgagaatctctttctccagaaaactcctcaaaaacaccaagtttcaaggaactcctagactccatgaaggccattcatgaatcccaggttaggaacccctggcctaggcagacaggggagaaaaaccctctttcaatcccatagctactcacctctacagagttttcatgaaatgctataaactaaagccagcagcaaagaaaatgtataaaaaagagttctaagtgggtaagggtatgtggttagagccacacaggcttctttgaaggcctgccagactcctaccttcctagtcctttataatttcttttttaaaaaaatctacaaagccttagcaacaatggagtagaggagtaccgagcagagagatgataatgatataagaatcactatctactgagtccttcaggtaccttgagaaataaatccttcccaaatttggatatgagtatacccaggaatgtgagcagtgtaacgggagtagaaaaagccacaaaataaatagtaaatacatggctgtcttcctggagggtcagtattccttgtgggcaagtaatttaaagtcttatttgcacacgtgttcatttatccaataactacttcttcaatgttataccaaaaagaaaacagatactgttcttgtcctcatggaacttccggttgagtgaaacaaacaagaatatattgaggagctgaaaggaaaatctgtgtatatattttttgggtgaaacctgagacttcactgaaaagtcttgtttgtggcagactacttcaagcaatgtcctggcaggcacccttagtattggatcactcactctaacttgaggatcacccaagtggaagagtttgagaagcatggttagcagtgtatcatttaatccccactacaagagaaaatactgttacttccaatttactagagaaaaaagagaaatttgagaaattaggaaacagctcagatcataccgctgctggcgtctgaataagtgtgtgccattccaaaatctacatatttttaaccactaaattacactacctttaggagtttcccactttatgtttccccttgaatctgggctcattcaggattacgcaggctagtttaagcttctctttggaagcagacaggtttggcttgatttgcattctaaatatttcacagtggtaagcgaaagctattattatacccattttatggtgaggaagctgaaccacttgccagctgaggtatctggctgggttaaaaacagaatctgggtcgtcagactctcattcctcttgactaactccaagcctaggcactattactgtccatgggcttttctgaacatgagattcacactgggtgataaagagtgagacaaattctgctaagagaaaacaataatagtgcaattgaaaaaaagggaaaataagtaatcataactcacaccaaaattggttactttcagcattgtgaatagaaaagggagagattattcatcacaaatgagtcagaaaattagaatgtgtcactgcactgatgacagagctgaggaatttggatgaactgaagtttgacacttatccttctagctgaagagggtaaatggtgtgacaacaggacagaaatgacctcttatttccaatcttaattaatatttccaatcttttttccttaactactctgtctaaaagttagatgggtttatatgtttgttttctatcggtagagataatgttttaacatccctttaacgttctagaagtattgcgttaattaattcttatgtgggagtcattccaaatagtaggatgatgatttttaccttattgattttcctaatacctttctggtttccagtgttttcaaaggatgaggcactattagatttttagatttatatgtctctcaaaattaagtgcctgtcaactgatattccatctttactctggatacatgatttcctttatctgacagattcaaaaaaatttgtactagatttaatgacatttcatgcatcttgaatttgggagtttttaattctctattttctatttggcaaaaggtttacaggagaaagccagatgcaagggtatttatatgtgcatacagaacctgtgccatcactctctaggtactttggggtttcctgcaggacagattcttgatgtattttcattccttttggtcaggaagaagaagactataaatgccacaaatggtcatacatatcttggggtctgctttccaaaacgcatattattttggatccgtctcaagaagaacaataagagaatgatactgagatctttttttcttaagatgctatgataacaatcctaaaaaatggcctgccttcaaaattttgatgatgaaataaggttataatcaataaagagagaagattttaaagttcagcaattaggtctgggactgcttctgcgcctgagacattgccaagatacaatgtaacactccatcccaccccatatgaatctccctgttccttcttgattcttacggggatagggtctgacagactagaatgaaatgaaagcagtagtgctgggaggggtggcaaggaccgaatttgtttaatacatttaggatggttttttattgctgctaaactagacacaattccttagcatgatgacattcaggaatcctttacaatctgattccaaagaactttctcttctatatcttaaactactgaaattgtagctctataaattccaaagggattgatgtaccaggacctttgacttatagtaaactgatcttaagggatgctgaaaaggtttggcactgctatcatgtggtctaatcatttagacttgtcactaccaactatttgcttaagagcctccaagacctttcacaatctggccccggcccacctctctacttttaataaaaaattttcccactgctgcttctttatatacggtgacagcctatttgctcttccctgaacatggcctgggacatctatgtctctgagtcagctaacggttcacacttgaatctcccaagcctagcatagtgtgtgaaacacagcacgacactccaatgtttgttgaataaatgctgtccgtctattttaggagacagagatgacagaagaaagttgttaaatcagtaaataaatagcaccagagagaggtcaaggaaaagttaattttagtgcattttaggagtgggggcaagatgagcttgaagattaggaaaactgatgctctttattcttgggtctagccaatgctatgagtcagttactttttcgggaacaagtttaaacctcaaggttaaatgaacacaaatgccctgtccatcagcatataatgaaaaagttgtggctatttccacatcagcacagtgaaattaaaatatgcagtgcctctctaagaggcatcacatatgacagagcttttaaaaatagtcccctttgccactcaggtatagaaagagctatagaaacaaaagcaaatgtttgaaaaactgagataatttagcttagggaagaaagagctgaggtgtgtctttatggttttttgactataagaaaagttgttacaaagaggataatgatcagcatttttgtcctagggcaaaatgacattaaaccgtccagtgcagaatttaagacttaaagatgaacattctaaatatgcaagtggtaaataatcaaatagattgctaagagcagttctgaaatttctttcttcctgactctcttaaaataggaaaaatcttcatctattttggataaaataaatgcagctctgcctccagtcaggagaatgaattcaataacttttctagtcttgtttaactctgtatgattctataaaattctataaaatgttcaccctaaaaattatacagaatcacaatacagttgagtaaaatacattctacagtttaaaaagaaataagcaatacagatagttgataagttattacattcaaaatagtaatatatggtgctcacgttttttattcaatttgccaagtgcatataacacaaataaaattgggaaaaatgtacttgaatctactaaggctttaacatagcgattatctagagtaaaacagtctaacaattaattctttcatgtctaagaaatttgctgaatatttcataaacctcatattgaatatgtatataaactcaatttccaattaaagaaaaagttttttgaaggtccagaaagtaatatatgaactcactattattatttcctggaccatcttcaaagacaacaggagaaccactaaacaattcctttaaatgaccaaaatgtgccccatatgattaagaatgtaaatctaataacagactcacagataaggtctaacaggggtggcaagttactggctttctttgtctatttaccttttagctttggagctcagcagaagtgtccattacatacagcacagggttagatgaacagctccaatgaccttgtctgaaccaaattcatttaaagcagtttgccacttttcttaaatagaagatgagtccattctatctatggcccagatttggactggatcactgaactattgcccaactcttataagcaaagcactaacatgtaccaatcaacaggcgaaggcatcaggaaggtaaaaatacacatacataagaaactggcagtagattaaagaagaaagctatatctaaagatggactttggcttttaaagcctttgagtgttattcgaatcttgttaacaaaaacaaaaacaaaatctgcattccaatgtaacttgtagagaagatccagtaaaaaaatgaattcaagagagagagagaaagaaatgtagttttattttgcaacccattatttccataagaacatgaatcaaagagtcagctatgccaatttcttcatagctgactagttataggatattgttctagtcttcactaatgacttcttgaggttggttattactgtgatcaggagttgggaggatagaggtctaagacctttcaaaagaaacgttttgtttagtatcactacagaaaataaagtcagcattaagctaactttgacaacctaactaggataatggttggtgcatgtagccattgcttatgctgcttcataatgaatggaacagtaaaggtgtcaagttaaccagcaacttgaattttgaaaagctgtggcacaataagctgataacataggttgttagaattagcaaaacttactttctgcttcccccaccttctagtcctacttatttccacatccacattcctatcaccaggcagttaaagaaacagaaacaaatgcggctgagactgcttctttggggatactcttagtgagctctccatctccccaaccacaacttgctctcagtttgctaaaaatatattcatttaattgttttaatgcctctacttaggggaatttgcattttcttaactgttgatacaagatctacattcagtttttttcacaggtaataagcaaagtatttggggagtgtgtgtgtgtgtggtggtggtggtggtggtggtggtggtggcaaattccgtcctagatgcttcgagttttccaagtatactgctaaaaggggtcatttgcttccccacctcaagaagccaattgtgcttatagttttacttcaaataaagatatatacctataaatgcacacatcatacgtgcacacacacatattcttcttctcaaaagtcataaacatttggtgactctctgtatactccatgaagtgctgttactactaaagtcagagtaatttaggcagaaacataagaaaccccaaatggtttgcactgaaattttattaacatatttgtcagtgttttcctcatggataatctccattggttcctggctccttgtcagcatatgctccaggagcctctcacaatatctttctgccctagaaatcctggcctgtgagatttccttgtaaatatctgaattcttgtattcacctattaatgatccagggatcgaggatgttttctatctgctccttaacctcccacttcaaggattagattgtaaacaacctagtgggaacccttcaggccaaaccacagctgaacgaatctcagcaggcagggaacccgcagcagtctgtgaaataccgtgaaacacaattacgaaaatataaagtattcacccatactttggggaagaaattatgttgtttccaagatgagacctcaaaaataaggctagtatcctaattgagaaagacatgattttaaaaagtgtcagcagaggtaaatttttaaaagtaccagatttgccaggtccttctcaaaccatagattcattttcagtatatgacagtggcctgagccgacacttcaagggaagtccattcatctctgaccaatgaagcccaaagtactcactgcatgaaagggttcctttcttgtttccaaaggcaatcaatttttgtcctagagtctgaaggttcatgggctttcttttaattttgtcagtctgcacatgcatggttcctcctgcatgatttggtctggaggaagtgacccacccacaacgccacagagctaattaaccccacactgagcttttttttttttctcatttcacacatccactcaatgctttaaatgacccagcagcagcatgatcatatgatttcttccccctcagtgaggaaagcatggtgatgggaggagcagggatatatctgccctaatcaaaacagcagtgtgatcctaaaatattatctaattgcattgcatccgagggtgcaaaatactaagaaatccctgaacgaatctctttcatgtcattcatttaacttcttgcagtgtccatttgaagtagcaaataatacataagaaacactgaggtagagaagtttgatctatactcagaatgtttaaaaaacatccgatcttacagggggtaaaagaccgagagctccttccctatcccgaatagcttcaagagaagggccttttttccatttgaaggaacagactcatgtttttccagatttattttttccaaagggaatgccttgaaaactctaagatgatcactgttttctaacttttcaaaaaagaaaaaaaaaagtgaacatgatggtggtgggtgatttaatggaatcagcttgtcaacatgatgaaactgaaaaaagcttttatagactctgtccacatgctaaaaaaaaaaaaaaaaggcaacctttaaagttatgtgtatagtatagagtggtttttgtcatggcaaagaaaagaaatataattatcttatgcagtaaatgtaaggctctgctaagaatctcattggataaatcatagaaatacatcctggccagataaatggagccagacaagttctaggtcttgtaagaagctttcaaaagaatcatcatattgtaagtctgtcatctctgtaagtgacaagaaaaattctaggctatttccctcggttctactagtaacatggcttcagagttttaaagatttagacttaaatggacaagaaaatgacttctgaatatcccatcttaggcaaactatcggatttctctcattcttacaagtaagtgtagcaaattggttcaccttggaaggacttggttagagatcatatatgtcttatgtgaacttttaacctctctttcctttgcaaagtgatttatgcatacactattaaatacacaggaattctataattcttagttcagtgaacagttagtacaagggaaaatctatctaatattttaaatttttgtttagtgtcttaaatcctacactttagaactggagaccttatagataagttctataaggtcttcagtgtgctgaaaaacacatttgctactgctccctaagcttctcttaggtaaggctgccaactggggtaaattgatggataaaactagctcaataggcaaaaaacaaaggtccagtgaagcacagtttatttttatttatactggtcagaaatatcacagttaacaaatagcctaaatcaagctcttatatctagggctccagcctttggctgaagtgtctcatctggtaattctgaaaaaaatagggttgttgtgatttcaaagactctcctgcccagtagactttttcaggctcactgatgcttaggattctaaagcctttactatggtctgttagaccaatacagtatgtcccttactatttctctgacttcatctcctaacattttcatgcaaaattggtccaacagacaataaaatagacagggataggaatatgaatggggactaaaaggaactaattaataaaaattagttgctttatgtccttgttaaatatcaactctttcatgacagcctaataaagtttctgaacttatcttgagagttggttaagataggggagaatatacaaagtatttccaacaccatgcattcattcattaattcaacaaatagttttcccgagtctattattgattactctgccaactggattctacttctgccctcaaggaccttccactctaatgtatgttttggagagtttctgtctctattatcactgacaggttattagcccactttagacaagttataaatataaccacctgccatgatgattcctcttcttgttctttatttgtttttattcatttgccctgtaacatccattaacctttcatgaatgacctgatcctttgtgagctatactatcaacacagctaatttttatataaatgagaaaccccttctccactcccaactaacttttctttctcaaacagccatgaaaatataaaagtctacccagaattatttaagtttttgaaatgagtccttacaatctgatctgaagcaccatttttttcctttcttttttgaaagagggaatggagcctcagcccctaagatacatatctcaagttacaggcaaattacacacaagttactggtctcccagacgtagtactcactactctctggggtagaacaatttctgcattgaacagaggaccataatctagctcaagtaatctcaatctcagagaacagttaaccaagtgcatatttctggtccctatattctcttataaggagttaccctctccactatattttggtattttctgaacctggctaccttaggtaaatgacagtggacatggtaaaaagaacactaactcttcctcaatttgttaaacttgtttttcctcctcatatgctttataaacaaaaatgggagaatttaatgtatgtatagagcagcaaatgttctctctgttgctttcagacatttttatcttatataaacagtggtgatgaaattataaataccattattccacctctatgttaatactcttattatcttgcatcaacagacgtgaacaaatacgtacatgacaccaatcaatcccttttctaaaaatgcagtttttgtatttctaaacagtggaggaagaattttatgaattcaacatgtagtttacctatttatattttgaattttaataaagtaaaaccaaattatcgcttatgttctttcacacttacatcagccattaacactctccatgctggcatggggtagggggtgtgtagaactaatggcaatgggtccaagtcccctgggtcaggtggttaggggcttggcaggctggagaggatgtttagatgctggggcaggatatttcaacctgcttgacaggtaagagatattttctggcagtaagaggaatattttttatggaacaaattgctagggagaggtcattttggggcactaggtgagagaaatatcaaaaccaaacctaaaagcagtctaagggaactcgggaaaagaaaatcactactttttcaatctcctcactggtttcccttattccatagtgtgccttctccttccatcttctagcacttcatactcttttctcctccatttcttcaggttttctttctcctacctctttattataacaaaaaaaagcatttaggaagaattctaggagacagggagacaaaaaaaaaaaagaatttagagaagacataataacatactgcataaatatgtatgtatgtatgtatgtgtttatgtatgtgtatatgtatgtatatataacagatattcgatttaccaagaaggataaactgggacttttgagatttaaaaaattcatggtatgtctggtcatattaatctccaaaccagcttgtttttagcattgctagagctataacagaatcaggagtagaaaacaaaaggaaaaaaataaaatttaacaaaggatttatatttgcaaaggaaagaggacttatttagagttgtttattgaaattcccccaaagctattttttgaacttatatattgacaacatcaagagaaggagcttaggaattctcatagggtttaggaactactaaaccttgtatattatgttcatctcagtccactcaagcaagtaaaggataactagaggatggtatctcacagtgcataacatggttggttactttgctaggctgacatatggagacagggcccataggagcagagcttttcttacgaataccagagagagacacccaggttcatctaaatgtatagggcatgagggattagtggtacagtgttatctgcaaagtacctaaaagtgttttctaaacaagcactaacttcttagcccagtcttcttggggattaaacaaaatccaatagtaagtaatggggaatactttatttggtcactgggttggggagggttgctgagacatatgacaacattcaatccattaagataggaggaaatgaggagaaagagaaaacaaagaaagggagagcgagggccagaaaagaagagtgtcacctctgtagactctctaacagaataaatcgataatcttaagaaaagtaaaagagcatgcctagagggaaacctcagcacacttttggaatccaaggcaaaaaataaaacaatttgcttcttgtcaagtttattgccattgacccatgggaggttcctatttattctgctcttacatgcacaggtatttcttctactcttacattcttttcctaaggattagcattctgtgataatggtggtaatgacagctgccttaaattagtggcaagttaggaatgaaacactgaccaccaggctatgttcttgaatccagtctatgccctgtaatgtgttcattctactttctgcattttctctgagacctgtcgcataagacttgttttgtaaggccgggctccttacggggacacatatggctccagaaaacaagtactctactttctcaccctgactttttggttttcttgttttttcctcttttctcccagactattattttccagtttcttctctaccagtctggacgcccatggttgttaactttagagatacccaccagctccatcaattccctcatctacagttctcaactgtatttacctagttctggagctcagatgaacccacatgtatgttctcctcagcttccaggctgctgatccttgctggagaaaaagcacaaaactgtacagcttgatgctcctgcagaattacggtttccagcataagttcgaatttcagaattagtttgcaattttaaaatttgctcctagtcagtttcctttttcactccacagtttcattcattactctatttaactggttataacccatcccctacccttcactctcagctagtaaccttgcctccttttgcatagagaaaacagaggccatcaaatggcacttcctatcactccacctttgccaccaatgaatccgcctgtaacatttcagagatctttctgcctagcactgataacctcatccaggatcttattatatcagttacttttcctttcttttgtattttcaattttcctactgcctgccaacatgctttagctgtcttcatttaaggtaacaacaataacaatgataataaactaacaaacaacaaaccatcttttgcagactttatctttccctcttttgtgccaccttcaagcttcctaagctcccgtttattcctcaaaccattacaatctggtttctctagctgtgtttctaattaaacaatttttttttttttttttgccaaagtcaccaaacacttctgaattgttagcttccaaaatccattcttcaacctcattgttttctttcttttaaaggtcaggttcactgaggtataatttacatacaataaaattcatccttgctatactcatttaccattcaataagttttgccttatatgttggaggcctgtaaaatgaagcccaacccccaagccgctttgcttcatatacaaatccctttggcacctctcagcagtcttccccacataacccattgtctggtgacaccacactactcagcattcaaggatatatgccatgtacattcatgccccttgtactttctttatgtttcctctctataaacatatatgtcttggtataacacagtaaatgctatttaatattaccacatcaatttccatatagaatcataaatctatacgttattttgagaagctgaggttttccaaatagaagtcatccatcaaaatgctactacctgaagatctctattattttagtattatgggttgattatgttcccttaaaattcatatgttgacattctggcccccaattctttagaatatgaatagatgtgtgaatagggtcattgaagatgtgattaagatgaggtcatgctgtagagtgggcctgcaatccaatatgactagtgtacttataaaaaagagaaacttaaacacagacatgcacacagggagaacatcatgtgacgatgacggcagagattggggctgatgcttctataagccaaggaacaccaaagattgccaggaaaccaccagaagctgggtgggagtcacggaactcacagccttagaaggagccgaccctgttgatactttaatcttgaacatctagcttctataactgtgagacaaaaaatttctgttgtttaagccactcagtttgtggtagttcgttacaaagccccagaaaactgatatactcagtaaaagaaaaaatcttcagtatattggaatcagttctttcactcatcaggtacttactgagtgcctactatgtgctaggaactgctctaggatattgaatgaatgactaagaacttcatcacgttactgcattttttgttcactaataagtaatcaatctatcaatcaatatattaatagatgaaatgcctatcatttattttatcagcaaacatttgttgagtatctcctatgtgtcagacatcgttctaggcacagaggataacattattggcagatcaagttctccaccttgtatagtttaaattccagtagagggaacatatattaaacaagaaaataagtaaataagatatgtaattttactctgtttctgacactgagagtcataggcatttatcctctaaatcactgaacaaagcttggaactagatagcgaacatgttacttcacagtttacaaagtaataaggaagacaatgaggtctcatactagaggcacgttaaaccacaggcagtgtgcaggcttaaagtgtttgggaaggacatcccaaaagctaggtttcttagtcagttcgtcagtcaatcaacacatatttcttttttttttttttgaccaaatttctctctgttgcccaggctgaagtgctgtgacacgatctcggctcactgcaccctctgcctcccgggttcaagcaattctctgcctcagcctccctagtagctgggattacaggcacctgctaccatgcccggctaatttttgtatttttagtagagatgggatttcaccatcttggccaggttggtcttgaattcctgacctcatgatccacccgcctcggcctcccaaagtgctaggattacaggtgtgagccactgcacccagccatttgacatgtattttttaagcgcttactgtataccaggccctatgctgaagatagtagaactgtggacagagccaacatggtactattacccactgagctcacattctaaggggaaaaatttgaacaacaaatctcacagtccgttctttatcatatatcctcataagaatacataaagggggttaggagatcacctgggtcagaggactggcccatgaggggtttccaaggggccttccttgaagatgtggtgcccggacactgctttagggctggggtatgggtattggtttgagcagggtcatgaagttttcggtttcttcttcctcatcccctttcaaccatgtacacacatttcaaatacttaaaagcattcttcaaatatactaagaacaccaagaactaaacacaagagaaggactctccagaggaaaggggccaaaaatagaagagaaaaaaaacccctaatctcaccatttgttttgaaaacacccaaaatgattaaaacatattataaactaaaacatatgaactaatcacttgccaagtttcatttttaaatcaaagccgttttgaggttcataaactgaaaaaagaatcttcaaatatgaacttgtgtttttcttttcttggccctcagttggcttgaagcatttgctgttatgctgtgtggagggaaggggaacctgctagttaggaacatgtggcatgcatgtactagaaggtaagctccacaagatcatgactcttcacagtggtatccctggtaagtagaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaagcctcattgcttcatcctcattcccttcaagacctaatagaactgcccccactctaaggcaggctcagagagagccaattttgccttttgtcctccctgggtcaacaatgcaattgctagggaaatcatctgaaaaagtctgtctctacaatgcaagtaaataatttttacagtacattggtaatttccctgagcttacctaagcatatatactaatttagtaaaattctcttgtttacaaactagtcatgtatctgcaggaaaaaaaaatctcctcaagttcaaccagtttatccatgtctgctcaggatcagtacatgactctagctttattcatgataaataagatcaacttcaagaattccatcaaaccccagtaatgtgcctttagagagactgggcttatagcatttcctctgccaccctccttgccctgcatattaaaatacaggtatctgattccagtttcaatggggaaacttctgtcgtgccagaggagggcatgcgctgatttccccactctgatggttgctctagtaatcttggtgttgtggcatgtttcccagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatgaaaaagaaaaagaaaaaaagaataaagatggaaatagaaagaataaagatgacttctctctcactgtttaacaggagtctctttaaatatctcaataatttgacattatatcagttgaatatgatgtaccccccacacaaaaatcagacaaaaacacttaaagggggtgataaatagggggacgtcattaacaatgcaaattgactcattccatagtttcttagagtaatgagtcaactgactacgtgatctcatgtacataattttgttcggcatgagattttgaggtatacaattactacagaaatcaaggtatacctgcaatgtaaagggtaaatcgtaggcattttaaatgaaagctggggataggatgtgtgttggtttgagggatgagtgggagtggatttaagagaaaatcagtctaggaaaatatcacataagtgtttgtaagttccttgatattcaggtctgtatcttgtaatgctttattaaacatatttcagactaatatgtccattgcctactggacattcatatctccctgtttttaaatacctttcaaatctgtatcttgagccattacttatctcttgacctctaaccctttatatcaaatgaattactagacaattacaattagatattccaaaagcatcctaaattcaacatgtcaaagctgaactcatcttttccttcaaactttctcttcctcctatgttccctatgtgagtaaatattaatagtattaccattcacccatctgccaaagttccatacctaggaagaatcatggttgcttttatctcaccttcaaataatcacccgtgcatatagatgtgcaatcctaataaccaaaggaggccttttttgaatagaaagcaatatttacagttaattgggttttgaactaatattaatttattaaacttacaaattttaaaagcctagttttctttacacctttacctgttaaaaacacacatatatttttctatgtcttaatatagcaatttttgcataaaataagaaaaattactttcaggaagggtgagattactagacaaaaaaatttgggacctcaaactatttcaactgtcagtcagaatgttaaaagaatgagagttagggtctgatctgggaacacctttcaaatgattttgccaaggtcaccagtagacacactgaatgtttttatagtcactctgaaaatgagaaattttacgtctataccctacaaaggaaaatttacaatccaggtcctctatgtttaagtttcattcttatctaactcttttataatcactttccactttatagcctgataaaggtagacaatattttgtgtctccactaaccaggtttcttgaatctagtgccctttcacttcataacgtttttcacatttctacctctctcatccccattgcaccacattagctcagagcatcattatctgtcacttgtaatattgcgacagtacattgtactatattttcttaagtttctgagtctttgcacatgtcaccacctgtgtctagaacacccatattccctgataaacatttactgaatgaaaaaaaagttaataaatgctttggatgttgctgctttgggtgctgaacagaaatagtggcctatctaagattctggataagcctgcataaagcactcttactttcaaaattaattttgaagaataagaaaattttgccatggagaatcatggagcctatgccacaatattatgttttgcatttaataaaacacctccaaacccagggaaagaatcagttattacttccttcaattcatacaacgaatatttactgaacactctctatgtgccaggctctgtactaggcactgaggatttcttagagcatagaacaggcaaaaaacaaacaaacaaaaccgaaaaaaacctcacaatcatggggcttatattccatggcaagaggaaataaatgtgtaaataaaatatatattttgtctgaaggcagtaggtgctatgaaccaaaaggggtggaaagctaaatgttaaatacagtggttatgaaaggccttacttagaagtgaaaattgagcaaagacctgaagatgataagcaaacaagccttatctggggaaaacatttaaggcggtcagaaaagcaagtgcaaatgtgaaatcatgcatggtaggctggaggttaggaagggggtcaatgaaggttgaggggagtgagctagggtggagcgctaaatgaagacagagaggtaatggggaaattgaatatggagggtcttgtgaactactgcaaaggcttttcttccaagtgagatgttgagccattagagagttctgagcagagaagtgatgtggtctgactgaaattacattacatatattgcaaagcatcactctggctatcattttgagaatagactgtaagtggtaaggccagaagcagggaagacaattaggaggctactgcaataatccgggtaagaaatgatagttgcttggattagggtagtagtggtgatgaggatgaggagtggtaagattctggacttattctgaaggtagagctgcaggatttgttcaatggttgggtttgtgagagaaatacaggtctgggagagaaataaatttttgatttgagtaaccctaaaggtggagcgttatttaccaatattggggaggctatgtatttgcttggtaaaataaggaattccatttctggtatgtcaagtttgagatgctcattagacagacgtggagatgttgaataggcagctgaatatgtgagcctagaattctgtgtaaaggcctggactagagatacaagcttgcaccataagcttgggtgcaaatattaagagagtgaatggagctgaagagaagagcttcaaagattgagctctagggccctctaatgtttacctgcttgggaaatgagaatatgctagcaaaagagactgaggaggagtagactgtgaggcaggaaaaaaatcaggagagtgtggtggactgaacgccaagcgaagaaagtgttttaatggagaatgaataatgggccatgtaaaacaattctgagacatcaggaaagacaaagactgccgaatggttaatggatttagcaacatggaagtcattggtgaccttagcatcaacagttttactagactggtaggtgcaaaagctaactagaggggcaaaagagaaccagagcataggattggagagtgtttatagtgactatacgcatttcttgagaagttttgctgtaatggaaatcaaagaaatgggacaggagctgctagggagtatggtttataagggtatttttaggatgagataaattatgtgtttgtatactgataggaaagttttgatagaaagagaaaatttgataaaacagaagaaagatgtgagctttttcaggagcactgtttatgcatgtgcaagaggagagagattctaaggcacaatgagggatgggctgagccaagggtacacagagtttatccatagttgcaggagagaaggcaaaatacatgggtacagataaatatgggagggtaggtgtgctggacagcaagtatttgtgaagttgtcttttgatggtttctattttttcagtgaagtaaaaagaaaggttctaagttgagcgtaaggatgggggaggaggtgttagaaatttgagagagggaaaaatatgaaatattcttgtacagatatggaagagtaaatgacaaggaaacatattatatttgctgggcagcattaacggcctccttgagggatcatgaatttaaactgagagtcatacatttgcttgtgtgtttttctccagccacattcagctggcacacaggcatgaaatagatggcgagttgcatatgatcagtatagttgagatttgtcaagagagcacagttaagtcagagaaggtcaatggtgttaaaggcgcatacaaggaaatgattaaaatcattgtccatggaatctacgctatataatgaagtgagcatatgagaagctatgggtaaaatcaatgaattaggggtcctagtgggtttaaggaattggtgtattaggggtaacaaagggattgaactaccaagacattaggctgtggttggaaaatggaatgcttgaaattgagattgtggaatattgtaattattagtaattaaaacatcagaaatgtagccatgggaatgagtagctatggcagagtggagaatcaatcatgagaagttcaagaaattgagaggaggtattagagggagcgtgtatttacacagtgaataaccaataattgtaatggggtagaaatggaaagagtgttagtgagctaggggctaacgttttcaaggaattgggaaacttgcctggtagacaactgcatcaagggggagttatgggaacacttagcttttctactacctcctcaatgtttcctctctctcactttccatctttccagcttatatactggcattacaaactttaatttcctagactagatagctacatatcacctgtgtctaccctttctcctccctatccaaattatctccaagtcttgagaatttccaatttttttttctgagatggagtctcactctgttgcccaggctggagtgcacagtcatgccatctcagctcactacaacttccgcctctcaggttcaagcgattcccctgccgcggtctcttgagtagctgagattacaggcacgcaccaccacacccggctaatttttgtattttagtagagacgaggtttcactatgttggccaggctggtctcgaactcctgacctcaaacaatccacctgccttggcctcccaaaatgttgggattacaggcatgagccactgtgcctggcctccaattttgaatactctctactctccccctttgggaccatcactactctagcctgtcactctctattttatcactcagattaatgttcttcatggcactaatcgctctctaaacttaacttgttcatttatttgtttgctttttttgttggggggggtgtctattttccttcattaaatataaatttcataaggggaaaagttttgtttaatttgtgcctggaacataatatgccctcaataaatactttcaggatgaattaataaatgccccctataacatgctgatgaatccttatattcttgggttcacacaacagctttgctttactatcctaccagcttctccctcctttcctgctcaaaccatccatttcaccgagtaaagtcatttcactactcccccaaaacaccatgttcatttctattcagatgatttcatcatatttctcccttgtttatgtctattccccacataccaattctttgagtcccagcttaggtcttacttctcggatggtttttctatgattaccatgaggcctgctgatttctccctcctctaaaatcctgctatccctaacaacaccagctgctttatattttctaattgtttcatatgggttattcttaccttttcactttaaaataggtttatttttggcctaaggatcctgacttacaactacagtatactcagtaaaaactaacacagtgtagggcagataacgggtattcaaaaaatactatggcctccttagatagcttcatagacttccatcttcctcaacaaacattttctaccttttaccctgctgttagctaaatctaactattcttcctgctctatgatactgtctttgagaccagaaccaacccctatgtccactacacagaattctacactcttgcactgcaattcccacagctaaatcattgtcattgccattattgttcctggattctcttggcaattttagtatattcaaggcatagctgccaagatcatcatcctccttgattgtttggaatctttatttttttaaatccctgcattttttccatcaaactttaagtgttcctgtgggatttgtttttccttggctccatccttggcctggttcttctccactttcttatgttcagtcactcgatttgccctttgtctcatttgaaggaatcagctttcacaccttcttttaaactaccttgcatatttagaatattttctcaaataatataaaatttataatatttatgaataaatgacacaatgccaagatattctgtctcttctttcaaataacatctgaagatgcacctgcactagtgagttctatatttaagatattgaataagtatcattcacccatctgctttcattctgtcctgcattttttaggacctgcttcagagttgtattttgaggtcttttggacggggaactgtctggcatagttcacaaactggcctttgctctgtatattcatgttcctttgataaataataaataataataatagcccactgtgcatttttacattccactcataaatccctggaaaaagaaaaactaacaaccagggattataatagaaacacagaaacaaaactaaccttttaccaggttttgctacagtaatatatacttccatagacctatattctaacaaataattacctgcttaagtcatttgtaaattgttcctttgccaacattatgtataatagcaaatgtctacgtggtttataggacagggaaaacaactagaacattacagctatgtgggggatcagtgcaaaagcagcaaaataagaggtttactctgttgggtgcacagtttggaagaattagtctcacaagtagaactacttgacagaatatatgcctgctctccagctcccccttctcccctcctccagatcttttttcaataatggaagaagacttactttcttttttcaaatccaggtgggaagtgtatcattttgcgtgaaaaatctgtttttctttgaacataacaaatggtctgattgaagctgctctatgaaaacggcagcatatctaaccagggaggtgggaactatagtttaatgggtggagcacctccatatttagctgcagatgagccacatttaactttaaaaaaaataaaaatttaaaaaataaaagaaggccaaaatgtaatgattgtcttgttactgcagtggccactagatggcaggtccaaaaatctgatgggagtctcacaggagggcaaatcttagggagcagaatgtttctggcactcaatccagtgttggttcatcaataagccttggcagtttgctaaaatatcaggtgggtaagacaatatccatgttatttcacagggctgaagggggcaggaagccctttggtatctaggtttgtagagtattgtcatcacatactcacacatccagatactgctacccctttggacttctgtccacagacattcttggagctggtttttatatatgttcagctgtattccattatctaatggtctgtgcaatactgagccataatctcaggagtgtaaaaggtagttgtctaatctgcctccatggaaacaaatgaaggaggctgtcaggctagggtaagggaacatacagctgtactgtatttaacaacatatatttaccagtaattgcaacttcatgttaaatatgtgtatttcctatactggaggctgaccatatattcatgttaattgttttgaaaaagagaatgttgatatataagagacttattatttaataggataaaataactaaggcctatgattaaaaatgaaatgagtaaatttagaacaaattatttgttgtacacagtagagttttcattttcttttactaggatgggagacttctagatgtgggtcttatgagactataaaaaagtcattcttggaccaattattctgaagatagattgtgtctttcccttcataatttttttttttttttggttactagattatcctgataaaagtgatttcactacatggacaatgcctacttttctttatcttttaattaaagaactgaccttatgatttttaaaagtagagaatcacaagctctgagataatttatcattctcactaaagaaaatgtgctctagagtcaaatttatctttgtacaagagctgtgacatgcattttgatatacatttaagcatctatgtcaattaaaatattataaaaataaaagcaacaaaaactcaattatagccatgcaactcagtcatcactcaccttttgttccctttttctttgaaaatttagatagaataatggtaaacatgttgatttcatctattcttgctctgtatatttggactgtgaaatgtctacatgagacacaggaagagggcacgggtcttcaggataaaaaacaaaaaaaaatttttcctaaagaagaaatatgggctatattgaattatgatagatgttttaaatcagtaccgttttcctttagtttggagtaaaatttaaaatgagatgactgaaataatttacgataaaatatcatggttatttctacatatttaaggtttaaaaatgctcaaacttatactttcctcatagaaagagcactggaatgggaaactgagaggtctgggttctattctggctttgacagtgactcactgtgtgacatccagagagcatgacctccccaggctcctcacttctgaaatgggagggttttgaggacaaagtctctctctgctttaacattcaatatccaagtaagtaaattgctacgtattgcagatttttttttcctcagaaatagactaatttcctccgatgaaagaataatactgttaagaagctgatgttgaaagctaacatgtccctaccaacactgtgggctctacccatgcaggtgaagctagagcttgttcttccttcaatcccccctttccctattctgcaccactcttccacacactcccccatcatctttaagtctaaattctacctgagaggtcctctgtgacccctaggtagttacttgctaattattactaattattcaataactgttttacttttcctcttgagcacatagctaagttccatttcccagccttctctgcagatagctatggccctgtgaccaaattctggtgagtgggatgttggtggaagtgacatacgctgtcccaggcctggtccattaaaagttcctgtgtaatcattgctctctcttcaccagatttctggctggatgtcacacccacagcaatcttggaagctatgtactgaagagcctctgtcaacctgggtccctgaccagtctttacatgagcaagagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaataaagtgtaaagtctttttctaaatgctgtatggcttgccttttttatatatttgtgtaaagaaattcgtagtagtaattctctgacactgagttaaaggaagtcctattttttttcacaattatgtgaaaacacaattatgtgctgtataatgacattttagtctacaatggaccacatatctgactgtggtcctgcaagattataagataactgaaaaattcctaatgcctagtgatgtcatagtgatcataacatcacagcacaattactttttaaaacataaatttagtgtagcctaaatgtacagtgcttataaagtctacaggagtatacagtaatgtcctaggtgttcacattcactcatcactcactcattcactcacccagagtaacttctagttctgcaagatccattcattgtaagtgccctataaaggcatacacttttgatcttttatgctgtgtttgtactgtaccttttcaatgtttagatatgtttagatacatgaaaacttaccattctgttataattacttacagtatccagtacagtaacatgctgtgcaggtttgaagcctaaaagcaataggctatatcatatagcctaggtgtgtagtaagctctatcatctaggtttgtgtaagtacactctatattgttcacacaacgatgaaattgcctaatgatgcatttctcagaatgtattccctttgttgagcaatgtgtgactacattttgaaaagttaaaataatactaaagggagggacaagtgaagagctaacttgagaaatctaagaactaggtaatttaaaagaagtgcttttagttacatagggtttttaacatcattaccacctatgaaattacaggtattaactactgtctcaaaatgatcatcgcccttttgatactttactctcagtgtcatggctgacctcttttgagtcaagtttattggacattttcagttttattttttaattctcatcactgcccctccctgaaatacttcatccctggtttccttaataatactggcctaatttccctattctctatctctagttttctctcctcttttgtttggctcctctttctcatctattctttaagtattagaatttcctagtgttctgctctgagtttttctttctctcataatttttccttgagtcatcttatctagtcttatggctttacctactacttcctcacaaataactcccgactcttgatctttagcccagacctttcttcggagcttcaaaacctgtattgcctatagtatcctgggcattttaagaaaatctaaatattttgtgccaccttaaattcaagtcccaaaccaaaagcactccttgccctttcaagtcaaaccttcttcctcctgtgttccagctcttggtagatgacatcaatttagaaacattaaactctccttttctttctttcttgtcccttatctaaattatctaattaagttctaaatcctgtagtgcttttatagtccatttgagattttagcctaagtttgaggactagataagtgaagacagattaaaaataagacttcttttaactcagtgtcagagaattactactatgaatttctttacacaaatatacaaaaaaggcaagacatacagcatttagaaaaagactttcatacccttccatcataccagagttccattatcagcctgaagagaaccaggagagctgtcctgagagggagctttctcacaatcaggactggattgaaacaaaatagaatcaatggaaagaaagatttttggggaggggagagaagttttgcttgctgctggtcctttggtaacctctgcaaaagaaaagtttaaaaaatgaccctggctggcaagatggccgaataggaacagctcccgtctgcagctcccagcaagatcaatccagaaggcaggtgatttctgcatttccaacagaggtacctggctcatctcattgggactggttagacagtgggtgcagcccacagagggcaagccaaagcagggtggggcatcgcttcacccaggaagcacacagggttggggaattccctccgttagccgagaaagccgcgagggactgtgccatgaggttcggtgtattccagcccagatactatgcttttctcaccgtcttcacaacctgcagaccaggagattcccttgggtgcctacaccacgagggccctgggtttcaagacaaaactgggcggccgtttgggcagacactgagctagctgcaggaattatttttcataccccagtggcacctgcaatgccagtgagacagaaccactcactaccctggaatgggggctgaagccagggagccaagtggtctagctcagtggatcccacccccatggagccaagcaagctaagatccactggcttgaaatccttgctgccagcacggcagtctgaagttgacctgggaccctcaagcttggtggggggaggggtgtccaccattactgaggcttaagtaggtggttttcccctcacagtgaaaacaaagccaccaggaagttcaaactgggtggagcccaccacagttcggcaaagccactgtagaaagactgcctctctagatttctcctctctgagcagggcatctctgaaagaaagttagcagccccagtcaggtgcttatagataaaactcccatctccctgggacagagcacctgggggaaggggcagctgtgggcgcagtttcagcagacttaaacgttcccacctgccagctctgaagagagcagcagatctcccatcacagagctcgagctctcctaagggacagattgcctcctcaagtgggtccctgacccccatgcctcctcactgggagacacctcccagcaggggtcaatagacagctcatacaggagagctctgggtggcatctggtgggtgcccctctgggatgaagcttccagaggaaggaaccggtagcattgtttgctgttctgtagcctctgctggtggtacccaggcaaacagggtctggagtggatgtccagcaaactccagcagacctgcagcagagatgccagactgttagaaggaaaactaacaaacagaaaggaatagcatcaacattaacaaaaaagatgtccacacaaaaaccccatccgaagatcaccagcgtcaaagaccaaaggtagataaatccacaaagatgaggaaaaaccagcttaaaaaggctgaaattccaaaaacccgaatgtcgtttctcctccaaaaaatcacaactcctcaccagcaagggaacaaaactggatggagaatgagtttgaggaattgacagaagtaggcttcagaaggtgggtaataacgaactcctctgagctaaaggagcatgttctaacccaatgcaagggagctaagaagcttgaaaaaaggttagaagaattgctaactagaataaccagtttagagaagaacataaattacctgctggaactgaaaaacatagcacgagaagttcatgaagcatacgcaagtaccaatagctgaatcaatcaagcagaagaaaggatatcagagatgaagatcaacttaatgaaataaagcatgaagacaaggttagagaaaaaagaatgaaaaggaatgaacaaacctccaagaaatatgggactatgtgaaaagaccaaacctacgtttcattggtgtacctgaaagtgatagggagaatggaaccaagttggaaaattcttcaggatattatccaggagagcttccccagcctagcaagacaggccaacattcaaattcaggaaatacagagaacaccacaaagatgttcctcaagaagagcaaccccaagacacataatcgtcagattcaccaagattgaaatgaaggaaaaaatgttaagggcagccagagagaaaggtcaggttacccacaaagggaagtccatcagactaacaacagatctctctgcagaaaccctacaggccagaagagagtgggggccaatattcaacattcttaaagaaaagaattttcaacccagaatttcatatccagccaaactaagcttcaaaagcaaaggagaattaaaatccttgatggacaagaaaatgctgagagattttgtcaccactaggcctgccttacaacagctcctgaagaaagcactaaatatggaaaggaaaaaccggtaccagccactgcaaaaacacaccaaactgtaaagaccatcgacactatgaagaaactgcatcaactaatgggcaacattaccagctagcatcataatgacaggatcagattcacacataacagtgttaatcttaaatgtaaatgggctaaatgccccaattaaaagacacagactggaaaattggatagagtcaagacccatcagtgtgctgcatttaggagacccatctcacgtacaaagacacacataggctcaaaataaaggaatggaggaatatttaccaagcaaatggaaagcaaaaaaaaatgcaggggttgcaatcctagtctctgataaaacagattttaaaccaataaagatcaaaaaagacaatgaagggcattacgtaatggtaaagggatcaatgcaacaagaagagctaactgtcctaaatatacatgcacctaatacaggagcacccagattcataaagcgagttcttagagacctacaaagagactttgactcccacacaataatagtgggagactctaacagcccactgtcaatattagacagatcaatgagacagaaaattaacaaggatattcaggacttgaactcagccctgggaacaagtggaccaaatagacatctacagaactctccaccccaaattaacagaatatactttcttctcagcaccatatcacacttactctaaaactgaccgcataattggaagcaaatcactcctcagcaaatgtaaaagaatggaaatcataacaaacagtctctcagaccacagtgcaatcaaattagaactcaagattaagaaactcactcaaaaccacacaaccacatggaaactgaacaacctgctcctgaatgactactgggtaaacaacaaaattaaggcagaaataaataagttctttgaaaccaatgagaacaaagacataatgtaccagaatctctgggacacagctaaactaatatttagagggaaatttatagcactaaatgcccacaggagaaaacaggaaagatctaaaattgacactctaacatcacaattaaaagagctagagaagcaagagcacacaaattcaaaagctagcagaagagaagaaataactaagatcagagcagaactgaaggagatagagacatgaaaaacccttcaaaaaattgatgaatctaggagctgattttttgaaaagattaacaaagcagatagaccgctagccagactaatcaagaagaaaagagagaagaatcaaatagacacaataaaaaatgataaaggggatatcaccactgatcccacagaaatacaaactaccatcagagaatactataaacacctctatgcaaataaactagaaaatctagaagaaatggataaattcctggtcacataaaccctcccaagactaaaccaggaagaagtcaaatccctgaatagaccaataacaagttctgaaattgaggcagtagttaatagcctaccaaccaaaaaaagcccaggaccagacgaattcacagctgaattctatcagagatacaaagaggagctggtaccattccttctgaaactattccagatcatagaaaaagagggactcctccctaactctttttatgaggccagaatcatcctgataccaaaacctggcagagtcacaacaaaaaaaggagaatttaaggccaatatccctgatgaacattgatgtgaaaatcctcgataaaatactggcaaaccgaatccagcagcacagcaaaaagcttatccaccacgatcaagttggcttcatccctgggactcaatgatggttcaacatacacaaatcaataaatgtaatccattatataagcagtttagagccaatgacaaaagccacatgattatctcaatagatgcagaaaaggcctttgataaaattcaacaccgctttatgctaaaatctctcaataaactaggtattgatggaacgtatctcaaaataataagggctatttatgacaaatccacagccaataccatactgaatgggcaaatgctggacgcattccctctgaaaactagcacaagacaaggatgccttctctcaccactcctatttaacacagtattggaagttttggccagggcaatcagacaagagaaataaataaagggtattcaaataggaagagaggaagtcaaattgtctgtttgcagatgacatgattgtgtattcagaaaactccatcatctcagctcaaaatctccttaagctgataagcaacttcagcaaagtctcaggatacaaaatccatgtgcaaaaatcacaagtattcctatacaccaataacagagagccaaatcatgagtgaacttccattcataattgccataaagagaataaaatacctaggaatacaacttacaggggatgtgaaggacctcttcaaagagaactacaaaccactgctcaaggaaataagagaggacacaaacaaatggaaaaacattccatgctcatggataggaagaatcaatatcgtgaaaatggccatactgcccaaagtaatttatagattcaatgctatccccatcaagctaccattgattttcttcacagaattagaaaaaaacaattttaaatttcatatggaatcaaaaaagaacccatatagccaagacaatcctaagcctaaagaacaaagctggaggcatcacgctacctgacttcaaactatgctagaaggctactgttaccaaaacggcatggtactggtaccaaaacagatatatagaccaatggaacagaaagaggcctccaaaataacaccacacatctacaaccatctgatctttgacaaacctgacaaaaacaagaaaaggggaaaagattccctatttaataaatggtgttgggaaaactggctagccctatgcagaaaaccgaaactggaccccttccttacaccttatacaaaaattaactcaagatggattaaagacctaaatgtaagacctcaaaccataaaaaccctagaagaaaacgtaggcgataccattcaggacatagtcatgggcaaagacttcatgactaaaacaccaaaagcaatggcaaaaaacccaaaactgacaaatgggatctaattaaactaaagagcttctgcacagcaaaagaaactatcatcagagtgaacaggcaacctacagaatgggagaacatttttgcaatctattcatctaacaaagggctaatatccagaatcaacaaggaatttaaacaaatttacaagaaaaaaacaaaccccatcaaaaagtgggtgaaggataagagcagacacttctcaaaagaagacatttatgtggtcaacgaacatatgaaaaaaagctcatgatcactggtcattagagaaatgcaaatcaaaatcacaatgagataccatctcacgccagttagaatggcgatcattaaaaagttaggaaacaacagatgctggagaggatgtggagaaataggaacgcttttacactgttggtgggagtgtaaattagttcaaccattctggaagacagcgtggcaattcatcaaggatctagaaccaaaaataccatttgacccagcgatcccattactgagtacatacccaaagtattagaaatcattctactataaagacacatgcacatgtatgtttattgcagcactattcacagtggtaaagacttggaaccaagccaaatgcccatcaatgatagactggataaagaaaatgtggcatatacacaacatggaatactatgcagccattaaaaaaggatgagttcatttcctttgcaggacatgaaactggaaaccatcgttctcagtaaactaacacagaaacaggaaaccaaacactgcatgttctcactcataagtgagagttgaacaataagaacacatggacatagggaggggaatgtcacacactggggcctgttggtggctggggggctaggggagggatagcattaggagaaatacctaatgtagatgacaggttgatacgtgcagcaaaccaccatggcatgtgtatacctatgtaacaaacctgcatgttctgcacatatatcccagaacttaaaagtataataataataaaaaaaagatctaatggctaaacctatagaaactctagctagacctgtggtttctattccttcctgggtataataataaaggctcacatttattttaagtgttacatttttcattgacattgaaatgagactcccttttcgactaatcggctgctttgatttcttcaccctaaaaatcactcttcaatgttttccacaattcttcaacattagtaataacttcctatatagtatctgtggtcctttttctttccccagtgtgatatatttatcatctattacacaaacttcctcttttgcttcctcccttttcaccaccagctctaacatcttaaattttcatttgacatactgcttacctaaattatttcatgtgtgttcccatccatggaaattcatttttgtgtgacataaatccctaccctactctatttcacagtaataaaactttatactgaattgccaaagagataggtaaccaaccacgcagtttaaattaagtgcaagatacacatgtttgaatattctgctctctgtctaagatgtgtagagacaggtcctgtttgtgtctgagcattctgtcatcttattcaaactgttggagttaaatcacctaagaactgttttctcactttgattcaaaagtaacttctgctatgcaaaaaaagcacagttatgaaataatatgtgtattaaaaaatctcaaaaataatgattagagtcacattcagtctgtgaaaggagtagctccatgacttgagcacatgccaatgagattagaactcatcgggggttggcattctcattgattgttgtccctctgtaccttcaatggtttccagtccttgtccaagttaacctttgctagttgttgtagccatggtaaatatcctgtttattggattttattagcgttttaaattttgacatttggaaaagcacaatcctccttctttttcatcctgtcatctttagtgtataagtgtccaggctccttccaattttaagtttctctttcctagctttagaagattataattttggaaagtcacaattattctgctagttggtggccagaacatatcaattgcatgtaacaaaattttattcagatgcatcattcatacattttaagtctcacggtttacttctttcataattatttgacatttttggtgaaataagtttagttctgaatcacccattttgttatgttgattctccactatttttggcgatacaatagtaataatgttagacatttgtatagcagtgtaaagttttcaaagtgcttccacatacacagctcttatttgcttctctaccttaggacataagcaatgtggtgttatacccattttacagataaagaaacacaggaacagagtattactttggatcacacatggtaagcctcgaggacagaatgagctcctgtgctagtgttctttccattgcatcgtatcattagtaatgtttacttacacctacatacttactgcttttcaaatatccagacgtcatctcctctactgtaccactctattatcactcgtgtcatattctgtttttatctctttgctaaggctatacccacccttccagttccccactgccctcattagactctgagctgctcgagaaaaatgattcatccatctttgtatctctagacccaagtaagatcacaccacatttttgccaagtctctcttgtgctataaatgttcatcttctcttagttgtaaattgctttcaacccaccttttttttttttttctaacttttattttaagttcaggggtgtaagtgcaggtttgttatataggtaaacttgtgtcatgggggttgtacagattattttatcaatgaagtactaagcttagtacctattagtaatttttcctgattctctccctcctcccatactccatgctccgaaaggccccagtttgtattgttcccctctatgtgtccacgtattctcatcatttagctcccacttataagtgagaacatgcggtatttggttttctgtggttttctttggttgctgtgttagtttgcaaaggataatattaccactgaccccagagaaatacaaacaaccatcagagaatattatcaacacctctgtgcacataaactagaaaatcaacccataatttttaagtttatgttataaatattagtattatctgagaggaaggcattacatccataagcagaaaggtggaaaaatcaggagagtgagtgatttatttgagagtatctggtttgttagtgaaagagatatgaaacaaacccagggctcctcatacctaggctacatctgtaacaccaaagtccaatgtactggtaccaaacagactggcacttgtgggatgctgtgtaagcagcatggacagtattcccttatccccagtgcaggctacagttgcttaaaagaactatggaaaaccggacattttgttcccttctaatttatctgtgttcctgtagccatgtctccacttctaaacgctaatcacttctctaggtgagcttaagtacctaattattaagagccctccaaatttctagtgtcatcttcaatatagttagtgccctttctgtcccatttgccccctgtgcttggcactgaatcagtatagcaaatatccctaatgaagaatcatggtacagggttaaatttacaaattaagcaattcctttagtttttatgtcaattccttttatccttgtatccccaccctgcatttgcttaaaattcatcccactgagaagctaaaaaaacaatgctactatgacgatttaaagagaaatactgaaccctaggactttttcctgagattcttgttacctgtaaactcttgaatataggatcagattacctaggcttccagggaatagtaagaccatacattagcagatttaatattaatctctagaatcccagatttacttcttgtccaggttaaatgcccttttgattattttagcaaaaaataatacaaaaaattgattacaaccattaatggaggcttaaaatgttaactcccatagctttaacccagtatctatgattaaatgcaaaaaatctaagttaatgcaatgttaaggttgagcttctaattgcacaaaagtcatgaaatttaaaattaaggtttctagtgctactctctgtcatttctacaacattcctccaatggttttctacaatatatgtttcatttaaatgtgtgtgttgtagagttcccaggaaagaacataaagcacaacagatcaggattcaacttgtggatacctagttttacataatcaatatggctggaaaagtgtgattcttttttaaactacaatgccctatttgagtgataaccatattcctgtttacaaatttgcccatttcctctaaaaatccttgaatcttcacttctgattacacactagccatcccctagagaaggaaagagcatttatgtaataaacaaaccaaacaacctgtggactgtgatagtacctacagaccttttcttcaacatatgacaaagcatattcatgtgggattaatgttgaaagagtaactcagaatatttaggtttatgggtgcatctagcagaacaagcaaaggtgaatagggactggaatcctgttaatactattaataggactagctgaggaaactgtcatcaaattattaaacctctctgaatgttattatcagagtaagaatacctgcttgtaggattattaggaagaacgagtgaagtaatatatgtaacacatgctctttaaaactctcttggagtttatagtaatagatcaactattactattaaagaatgagtaatcataatttaatgatcatctggatgtctacaggtattttggaaatatgaaacaatgataatttaaaattcattttattgaaagatacctagaattatttttttcacaatagtttcattaagttaggtatttgtttatagcctactatggaatgcccagataacatttaatacatgatgcactgagctgcatcagctaactctgaaggcaggtgagttaaatgaattcttggatattgggctgccatgcccaatattttcttcaaattttatgaaacatttgtgtctaaatagaaaatgtgcttgagaaattctagcccaacatgcaatttagagagaaagttataaatcataaatataagagcttagagctaaagtgccacctcaaccataactataataaaaactcctaagtgcattctggcaggaataaataaaaaatggcaaagcctgttgtggacggtgcagagcccaggaaggtaaccaagtgagtaaacagctaaggcaggattatcctcatttgggaggactccattccagacaggaattaaagaggaggggctggggaagggagaatggaggttgtgggagaaagtgtttttgcatttgaaagcagctaagttaccttgtgtaatgaaaaggaaatttgtttttttcctttcaacagtaatctcatttgaggtctagcagactgctacacaaaagatacatgtgttctacctacttggtttttctcctctggcagtgaggtacacaggaagggttcaggtgaatcagaaccattcagaataacatagtcaaattcctttccaaaggtttaaatacctattctttaatagctttcttcaaaagactggtaacttactgcactgttcctggcacattcacaaccaaaatttgttcctgggagtactataatacgatgcaacaaatgggtttaaacgaaagctggaaagatctatactgaaactatgaatcacaattactgaaagcaaaaaaatctcatacacatataatatccagaaaaacatacaactgtcccttggtatcctcgagggactgattccaggaccccactgcagatactaagacttgcagatgctcaagtccctcatatgaagtggcacagtatttacatataacttatgcacatccttcccttatacttctcaccatctttaggttacctataatatctaatacaataaacactaggtaagtggttgttatagggtatttttaatttgtcttttttttggtatattgttattttttattgttttttttccaaatatttttgatgtgtggttgattaaatctacaaatgtagaacccataaatactgagggctaactgtataaccaataatttctgagtccttttgtctctccctatgttaaagcaatggtgtagatgagatttctctgaatagaggggagcagctggaccaataagctgcattatcacttagagttatcaggactatatcaactgattcaagccttagcccccatctccgacttgctgtgatatgcaccaagttgcctttcttcttggtactttcctttcttaacaacaactagtaaattgactataaaacccttggctactataaactctattagaaaactggctgtttccagcatgagccaaggactctagctttccatactcaaagatttatatttctcaagtttcttaacaacattggcatatatttattacaatacagtttatacttttaaaatcaagcaaacagttaagattttaatggtcataaaaatgaagaacgcattggctattttctgagtagtgaaaaagttctcttttataatagcttaactcaagaacttttgaagtctttttcttcaaagatttttcatacaaaaattacctttgagagtaagcatgaaaaaatctcaggaagtaggtaagtattgttaatttaaatgcctcccttttcactccaggaaacataaaaccaaatgacaaagtacagatgatttattccacaactattcattgagcacctactattctctggcactgtggtaggcagtgaacaactctgctttaacagtgagaacaacattcttatctcctgtgacccttaaggaaagactagctgtagttagacttactggatttggtcataaagataaattaaatataaagcagtgaccatttaagtttaattatgttaaagaaattttgaaacaatagcttatttaaatcatttaagtatttgtttacaaatttttaccttctttctaaaatgccaagaattgccaaccatgaaattatgaaaacaaatcaataaaaatacaatgatttgaagaacaaatctatttaagataaaaaggcacataacctaacaccaataaaattacctgtagcactcttaaaaactagatttcttctttctttctttctttctttctttctttctttctttctttctttctttctttctttctttctttctttctttttctttcactttctttcttttctttctttctttttttttttttgacagggtctcactctgttgcccaggctggagtgcagtggcatcatcttgggtcactgcagcctctgcctcctgggcccaagtgatccttccacatcagcctgtcgagtaactggaactacaggcacatgccatcactcctgcctaatttttgtatttttttgtagagatggggttttgccatgttggccagggtggtctcaaactcctgagctcaagcaatccacatgccttggcctcccaaagtgctggaattacaggtgtgcaccacaacaaatggccccaaaactaggttttcaaatatgtgagagtatctctcagctatgtcaaaaatcctatgagtcattcattcagtgtttatttaataccaaaacatggaagatagtatgtctaggaactaattttactccaacaataaatctagaagaatgagtacctatttcatgtggttatcatgaagaaactctgtcagaaaactaaaatgaaatggctcatgaagttgacatatgtatgaaaatataagaattctgctcacacctcttctttcttcctgggggcattatccatgagcatcatctctgtatatgaaggacggaaaacccgctttggatatgtatgcttctgggtagtctagtcaaaaaggaatatgaactcttttatctctgaatgcttccaaataccagagaagaatgatttatggagttctgtatatgactaaaagagctgctagtacttttagagtattcattctttctttattccttcttcagggtgatctggaaattgcccttcccaggactttctgtctctcatataaactaccatttgtataccactttttaggttgcaaaatgctttcacatgtattgtgcaatttagttaaaaggcatcagggtgcgaggatcaagaacactggctttggtaccagagacatcagtgtttaccaaagctacttactagtggtacaccattgtgtgagccacttgatcactttaagcaacaattttctcatttgtaaattagggataacaatatccaccttgcaatataaggtagagattagcaatagggcagttaaaatgttattatgattaataacccatagtagggacaccaaggacttctcaatagtctgtttctcttcatcaggctggaggagggggtcttcacagttacttatgagtacatattacaagcttctagttaaagtaatggcctcttcaaatcttagatctgaaccatcttcataaaacagttctttaattcatggccaaaaacatcgtttccatatactctcagagacagagtccttttggagcaagatataaagtttaattctaagtctttttttaaccccgaaactattttccctgaagcaatccatgtgctgccatcagattttattaggtgggctaaaatagagtcagaaggagatttctttacataatagctgtccctacagaaacttgagacagtcagcttaaaaattatttttaatgaagaatttttgagatccataagtacaggaaaaattttgatggtctttctcccttactgattcattgataattctcaaacattgggctggcacaactagagtaaatcggtacatcttacacagtggaaagcggtgggtgtagatgtttttggagccagtcagtctctggcagcggatagagtcacacttgtgctttgttgcccatttacatcttcagaaagcagcctgggtgggcatgcttatcaaatgtgctcatttaaggataaacccatttgaatattataacaacatttggcaaacttcctctaccgaatggtggacctggcccactacctctgaaaactattgcctggccaggcaacataggtcctttgactttctttacatggtagaacacatctgagaccttccaatcaaacacccaggaggagtcctgagtgctttacctgttcctcaagcattctgaaggttctagtctggactagtgggttatggatatatggatatgcagtgagtccttccttttgcaacatacaccttttttttttttttttaatccagactggagaattcaaatgccttgttaatatctagtggtcacctttggcatgaagaagtcagcaaacatttactgaaaaagttgcacgtggagaattctgtatcataattaaggagatgccctccactccctgaagatgtttataattcttgctgggaatgagggaaaaacaaaacctatacaggcaaaactgcacagcacttatagaccaacacaaaagtgtgtacacacagtgtacaaagacttaagcagagcaaatagggttaaaaaaagaatttggaagaaagtaatggatatacattttccaaggtgagagagaagaataccatagagtggagaaagcataaacaaaggcatggaaatgggaactggaaagcccaccaacttggctaacatagagaaagcagagcagtaaagagtagggggtaactacaggggcatggggatgcatgaggaaccagtttgtaaagattaccaatgctaagccaaagctcttgttcattccattccagggaaacagaagttgatggagaccttggagttgggaaagaaaaggaggccaagaaggataactggtagtagagtggccttacagctagatgaggaattcggattctagtcttcaggtagaaaagcagcagtataaaatccaaggccaagaaatgagacatagaaaattatgtgtgggagcaggtatcctagatgcttaaaaaaattgttttgtgaagatagtttgaaggaagggtggcctattcaagcggttcagaaaggagataaggggccacttggtctagtgtcagcccttgaaaataaataaaagaaagaggctgaatgaagagatattactgggtgagaactggcagaatttagtgactgactgaatggtaatgaagggcaaaagaagaaaagatttaaaaatgatcgtagtgctggggcctcaggaaagggtcctatggacagtaattgaaaaagaaaactggtggctagagcagaagatgctctggtcagtggtagagcatcccaatgattaaggggtgtatgcatgtgaatgcatgtgtgttactataggcacacagatttaggagtaatacctcctttgccctaatgttacataacagcttacaattttctttcaattgaaatctttatttcaagtatttattaagtgcatactaggtgtaaagtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactcagattagccttatggccatggtatcagaactgcaaatagttatattgtggattctttcttgtttgtgggtgacaggagaaaggaaaactcacactttttttgaacaaagcaccatgtagatatccaactgaagtgggctctgttcatcctcaattcaggtgtgatgaaaacctacagggagttgaccttcagtactgaccttttacattatctcatttctctcatgcaacttctgtctaaggatgggaagagacctaagagatctattagtctcagaattacattcatctacaggtgtgccaaaaggatatcaagttttaaaaacacaactgcactatttcttttgtttttctttttattttctttttttttttttctttttgagacagagtctcactgtgttgctcaggctggaatgcagtcgcatgatctcagctcactgcaacctctgcctcttgggttcaagtgattcttctgcctcagcctcccaagtagctgtgattacaggtgtgcatcaccatgcccaggtaatttttgtatttttagtagagacggggtttcgccatattggccaggctggtctcaaatgcctggcctcaagtgatccacctgcctcagcctcctaaagtgctgggattacatgcgtgagccaccacacttggcctatgactggactgtttcttaacattaatataaagcaaaggttgcataaacaatggatgtaggaagctcattccttcataattattaagaactgaaaaggtacattgaagaaaactagccatgaataagaaaataacttcttcacagtggttaaagagaaaaggtactgaaaaaagtaaacaaacatatgaaagcctcttaatatactaaggtattactatatatatttctgacctttggctactgagaaaatgtgaaagatgacaattctatagctattctatataacggcagatgctcctcttattccaggaaacaaaatccttttatgacatttcactaaatatctaatcaaagagtattttatgtgctcatttcagatagtctcattcacttgcccttataactttaaatgagttcttttcttaagcaggccagcttgtatattatttatgataaaatactttctttaagatggattcagtgttaattttgtactatatgacttagtacagtgggacaattacatataacacttcttctatcagccctatgtttctatgttctttattaagatattatcaaagtaatagcaaaattctgttaaatgttcaatgtatatctttactgctaattttttttcaacatggtaatattactggtaccacagtgactcctcatatcttgaatatatgcagtacaattcattctctactagcatcaatttctttttgtaaacagaaatttggctttaacacagcaatttccaccaaactatataagtgctaatgatgaccaatttaggacataaacagtttactactgtcctttgagcctctctcttttttcatttctctaatcatcacactaaggattttttttctagaaagctatgggcagagttgatttcacagagttacaagttgacctttttcttttttttttttttttgactgatgctgttaatagagttttggtgactctatcagttaagaggtataccttgtacctgacattttacttgcttgagcaactggccccaactaactgatttttaatattttgcttttctgtttcctcaattttccttccataaaatattttttctacttctatataacttcttttttatttttttgagatggagccttgctctgtggcccaggttggagtgcagtggcgcgatctcagctcactgcaagctccacctcctgggttcatgccattctcctgcctcagcctcctgagcagctgggactacaggtgcccgccaccatgcctagctaatttttttgtatttttagtagagatggggtttcaccgtgttagccaggatggtctcaatctcctgatcttgcgatccgcctgccttggcctcccaaagtgctggaattacaggcatgagccactgtgcccaccctataacttctttatttattttttcttcccttatcaaattccatctcatttttcttacgcaattaaaatatttcctcactacagtttgggtcagcggtcagtcatatttacatcactttttccatagtttggttgatgatgtgcatagagtatatgcactagccaaactgatccacattcactgtggataggctgaagtccaaattgtaagctgatttgtcaacagctttgagtaagcctgatgccagacaatattttaattcttcagtgatatttcctcttcacttatgaaggaagccttgaagatggcaagttaataagtgcattgttttaactctgtaaataatgctttttggggggttgtctttaaagattctcatttactttttataaagaaagttataatttcttattttctggttccattcttgatctctttattttccttcagtttgtggatttgctctacttttaaaaactcataacttatgagtaattttacagatcccaagatatagtttgtttgttttttgagacagggtctcactctgtcacccacgctggagtgcagtggcgtgatctctgctcactgcaacctctgcctcctgggttcaagcgattctcgtgcctcagcgtcccgagtagctgtgattacaggtatgtgccaccatgtccatctaatttttgtatttttagcagagacggggttttgccatgttggccaggcttgtgttgaactcctggccacaaaggatcggcccagctcagcctcccaaagtgctggaattatacacataagccaccacaactggccaaaataaatttttttaaagaggatactgagcatctgaaacaaggggggtttgtagactcacaaggattaaaaattatttcgattgtctttaaatcgattgttttttaatcgattaaaaatatattcgattgaatatagtgatgcatttatcagtctatcattctgtaaatagtatggaaaattctggaaaaaaattcctgttcacaataaaagagattcaatttgcgtaacgatatttactgtgtgcctactgtgtcctgtcctaagacacagtattaaagttctttcacttaaagagttcatacctagcagagggattagacaaatttatagacaattatgcaaattaagtaataagctttacaaaagaagtgcacaaaaatttattgtgggcgggtggtatatacaagtcaatgactttcgttgcatgggagagctaaagagaagtaagcaataagggcctcagaaagttagaggcatttgggatgagcctttgaggataggtaatatttgatatatggaaatgaagatagagatatacataagcaacaaagtgaagaatgatagattggaagtgggctattcaggaaaaaatgcttttctttggaaaccatggataatatttcagcttctattcttataaattagtctcagcaaagttgccacttatcatatgttcaatatgaagtattttccttgcctataagaaacactacaaggatgtgagtagaggtgaaacatagagtagacgtgtcccaattgtaccccagatgtgtttgtaaacttctaggtatggtttccaaagaaataaagctcacagaacttttattaagaacacttttatttctataaataaatggaaactcatcttcagctaaaaatatagtggcggctcacatctataatcccagcactctgggaagcccatgtggggggatcacttgaggccaggagtgtgagaccagcctggacagcatagtaagactccttctctacaaaatattattttaaaacattatttgggcatggttgctcatgtctataatctcagctactcagggggtgaggtgggaggatcatttagcccagaaggtggaggctgcagtgagtcatgatttgtcattgcactccagcctgggtgacggagcgagaccttgtctctaaacaaaacaaaacaaaacttggaaattctagatatccaggtatttattcactaccacatagcttaactgtatttccttattattttgtctctagctgaagttctctggaatggtcatgaagagagaaaacatcaaagattaggaaatctatcccaaaaagatcacaaaatcaaggacagtgacacctttttgagctttttacttgactcttcctgtttttttttttttccacttcccttagtcattcactaatcagttctgctttagaaccattaaaataatagaaaagttacagaaacttggtaaaatgtttctctggcctatttccaaaccgcccaaaattaatgggaaatggttaaagtcaaaaaagctttttctctgacatggatttctaaacaatataattatggttcactccatggttatgagctttgggagctcccacaaaaaagtctttgctgcagatgtggccactggctgctataccaggcaatttgattcatgtttgttgttgttaaaaaaatatataaaactctcttatgttggattaagaggcttttaagaggaagctagacagaaaggccaggtctctctctatttgctcattcatgacaaaggtggaagcttcaaatttgtgatacatgtgaagaaggtgtctgttacttcgtgttacatttttgccttcagaattattgttttcaatcattctattttatataaatgcacaaaaaataagtccaagctaaactagtgatgctgggtcactccaagaagtgtcctcaatatagcttcacaaatttacccttttctctccaaatccacgtttatttcttgagacagttatatgatgttttgccaagaaagcaactgggagcaatgccttatgtttaactgggcttttagatttgagaagcaatccaatccaagacttcatgataagacttccacagcaattggatattagtgacatataaggaccttaagaactccaccattttatactctatataaatgtatgatgtggtacacaaagtattaatcaatacttcatgagcatagtagctctgtttataccaatttctagcaatgtacattaggcaattttgtagaaaaaatataataattgaaagtataatttaacttccactccatgaacacttagcctcttcataccatcctcttccaagcatttctttggtccttggaaaatcagtgaaaaatctgaaaaattgggattttgtgtttgattatatgtacatttactacaagtatactgggctttccttttctgatgctatagagatgaactatagctttcctaactcagtcttattattagccaggtccagtttatattagttaaaatgaacatcataaatttacagtataacttatctggtacattccttctattgtagtttgaaaatgtgccattcaggactgaaatgacttaaacataatcagattttatttctagagaagtaaagtctatacttctataattctgtgaacccatcagcaattaactttgtcccagtagaattaatatagtgttcaagttcaggattgagtagatgagaagaggaaggaacaataaaactcattcactcccatgctaggttctgcaaaatagcttccatattcccataatgtgatatttatcttccttataatagcacatttaaagtcagtaaccctaaaaatctcctacataaaggtttgcatctttccccttaaaaatgtacagatgagcttgtgataaagagatgatgtctcctgccaaattgtaatatcatatagaccagttccaggcaaagtattgaagaagcagtcaaaacttcatatacctatctatccttgtcagcctcacgtattcatggatggggtcacagcttatccctttattctttttggttagaaagtctttccagatgaggtcatcattttcattactctgtttcttcctctctcactagagtgtctttctaaaggaaaccaaggaccacttcagtgaaatattgaaggcaggggaggccctaaatgattaaaagaaacaaagctttcccatagcacgtgtccttttctttgtaaggagatgaggtaatatataatcttcccacgttactaccacaagggcattttgtggcagggagagatggatttctgggagtgaaatccaactgcaaagcaagggctattttcagaagggcttatcttcaatatcctcatttcagaattggtctctttgctcagagcaataccttgggcaacactgagaactcccatctctaaggtaagaataaaagttatttcctcattgatggaatatctgatgaagaaaaaggaagacaaaaaacaataaattattctcataaaaggtgatgcatatgaataaatgtcaaatccttctagtatttctcatgtggcttgtacacaagacttctatttgatctttggctctgcagtttctaccactagatgacccacatgtgtaatctggataggcagctagtttgcttacatataaattaaatagcctcaagtgtcagcagatctctgtatctttttaatatcccccaaactgcttcaagtaggaacagctacaaagaaccttaccaaaggacatggaattcacacttgccaaagaaatcactgcacgtgtaaattagaaactaatcatcacttcctctctggttacagtggcagctttgcctcatagtttatgttgaaatatacatttttatgaaatatttctcactgtagtcagcatcaatttaggagtatcaaacactaattcccagctccagcataccagaaaactagagacagagaagtgcagacaaagggaattgacaaaggcctggacttttcttatacttgaagaagctaattgtatttgtaaatttctggttaaaaacctgacaattatcagatctgccactgcaaggctattcctcaatttcttcatcatatatttttccctaaagtctctcagagaagtaaagggcttctagagatgaaaatgaacttgacaatcacgttgcaactcaaactgatcttgattcttttcgtcactttttaatttattgcagatggtgtaaatgggatgtttactggttggcaggtaatgagtcttgttgtagataatagtgatggacagaatctcacgcctgtcgacatcccagcatctcagcagctatatatggttatcatccattgctttgaagcacatataatattgtgacaggatgcacaatatttcccccatagaaacgatgattggtacacctgaatctcactagttcacatgtcatttgtcctgattccatcctcactgtccacatgagtagacattctaagatgtgatctaatggaaaatgtaatctgtttaaacatccaaacactcctcttccaaggtatcaccatttatcacaactgtcagtgcccctgtggaagagtaatgaccctcaggcatgggataatgctccatagaggccttatgaatgccactgtgaaacacagaaattgaccagttttcagttgggctggtatgtgcatcatgaaagatctgcacttactcactaaattacaagtggctgtttaccctttatacaataaagtctaggttgggaagccacagaccctgctgacttcaattgtcccaaacatgtgagtactagatttggacctgcctttgaaatggacttaagcagcttgaaactggaagttggatcacagtcattcaaaaatacattgggagataacataggtgtcattgccttccacttttttgcctttttaaaaaatcctctctatcaatggaggataacaacatctcactatccactattagcaattaaaaactaaacagggtaagcatgccagtgaaaagttaactatttgtttccttcttgtaagcttcccttcatccagaagaaaatctggatctggatctgttcatatattgtttctacaaagcagaacaaaggtgaacagttatgtggtatgaactcatgattttcaggtccctcccaatgggtccatttcctcattgacgatttccttgaagtcccctgtaccttcccaatcttatctacattttctatgaagtcaccttagataataggatcacttgcactctaagactgtttacatctcagtaaatgctctatcactatgaaagtttcatctaaaacatatctattcctcagtgctcagacaccctgaagatacccttcaggatgtagcatccatatgaagtcacaaaataccagttgatcttcccgtggaaattgttttccaatctgtatgaattgaatggctcaactaaataaatgaagaaaatgaaatattttactcacagtgattcattccatattaagaaaatacactaagtaatgaatggcccctatgaaatcattacagttatgagcatcttttctacttgacagatctctgttcccctcgcagatgagttatgccaacctaactatacttttggtattcacaatattctgattattagtatctccaaagatgggacttaagacactttcctgagaagagaaatttacaattagatacatcttaacaattaataaaattaatgagataatgaaataagaagctctcagtatactgctgaggatgcagaaatctttttgagaattaggaatgttctagaagacaataaaaaagatcagattgtgaactgagcaaaacaacctttgatgtgaagtgtcagccagaaatgtcaatccaattcaagactgcatacaaaggggcactgtgtctttgagctgagaggtattatgttacctgattatcttctctggaagaatgcattatggtttagacacttttattacctgaaagatgtagacaaattagggaagattaacaaccagttttattaggaagtagcagatgagctggtgtgaatggtactggttgttatgagttctgtattctcttttcagctttgatatgctctcatgtgggaatagtcatccttgaaatttagataggataatttatattcttttccccagagaaaagacagtttgggaatgaaagggaggggaagtgtttaaaacagcacaagaacctgggataacagaagggtcagaaattctattatagaatttttcaactcccatttacaaaaatacaaccaacaataaccagttcttaagcctttatttgaataagctcagtacatttagtatttgcagtatgtttttcatatatagtacctaattgtttttggtccacagaataaggctattctatgatactatgttattatgttcatgttttcctggaaatataatttgcaaggtcattctaggaactctgattatgaaattcaacatcactttaagtcagttaccctgaactctaatgcagtttcttgtctcttcatacttaccctggagctataacctatagtcttatagaagtgcccttttcaaaaaggctcccactccttgccttctgaatgactgtctagatatattttcacctgtaattgcatactacaccaaatttgcattatatatgaatgtgattgagaaatgattaagataattgtttagtttattagtgaaaataagtggtatataagctaaaataaattattatttttacacatggcattattcctagttgtatttattatgatttaccatttactaaagtatttcagttggttgacaaggaataatagcactaaacttccttcaagcaatactggtgactcactacagccctaatgttaatacattccctcagacttaatcttttaattctattgggaaacacctataaacacaacagaattttttccttttctgatgttcattcaaattacattacctatttccaccattcagtgtagtaatttctgggaactaccttgaggggtggatggtggtaaagaatcaggacatttaaacttctattaaaaagggacagaagaagactttaggtcacctgtgatcttaggcagctttcaggaaacagaggaagcacacttgtgatgaaccttcataaaattggcccatattcccaataattcccttacctattgagattcctggttgctaaggactttatcagttacttcaacaatcctccctccccgctaataacagtacctcatttgcgaacaatactggactgtactcacaattccttttccccttcctttcagaaagaacacttttacgcccctaaatagtcctataaatggccaaagacataggacatgctacatgattcatctcatgaatcagtttctgttctcttggctgttcaacaaaagacatttcaaattctccacgaggcaatgtattacactgccatgagattaatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttctcactctacagcctatatagtctggttcctgattccttctctgaacacatcaccagtatacttttccttattcactgacctgtcataattcacatgcctagctcacttgagcctcaaggcctttgaagttgctattccaatttgcctgaaatgattttccttcacatcttcatatggctagtttctaacatcattcaggtctcaaccaaatgccatctccttacatgccatccgtgtgagattttactcttactttcttcatttcattcttcattgtgtgttagtgagtttacatgtttattaactatctcccttaactagaatgttccagaaggaaggaggactttgtgagttctgatcactattgtatttccagtgtctggaatagtaggtgctcaacaaatacttgctgagtgaatgaataaattaatgaccaaacagtaaataaatagtaaacaaggccaatatcaatgctctttattacagtagttatttaaatgtacctcaaaatgctctaaaaataaatatgtgctttccctgcacattaggattaaaagtactcattttactaattaaaagccaggacctcaatttacattaatgactggtccaagatcatatggtaaatacgtattgcacaattctggtctgaaatcttgttagcccagtcagtcctacagtgatttacttagaacacaattgtgaaccaggtataattaatctgaggtccaccaataggcttgagggggtttgtgaatcctttgaaaaggtattgcaccctcttttgggaagagggtccatagctttcatcatattatcaatggaagccataaactaaaagaggctgggaatctctttaagcaataccattctgaaacaaattattcttaacctccctaggtagattggaaggctgctggcttcaacattttctgtagagaaggaacacctatgaaaatcctatcactggctgagtagacatattttcctttccagcaccaactctggggaatggtgggcctcacaggctggctaacccttcttggagttcacgggaaaaagatgtctagttcaaagacgatgagaagggaggtatcattctaatcatgtggaaagcccactgtgcttttagtttgtgtttgtagcattcttagcttaatttcagggatgttattgtagctgtgaagattagataataataagaaaaactaattcttaggcaccagacagacaatatgaaaaaaatatataattctaaatgtaggtcaaattttatatttatcagcattgatgcagtgttgttttggtctgttcttaaatttttgttttatgaaaaacaatgaatgcaataatcttctaatacagtgattaagaaacagtgtatatttttccacatactatcaaagcagagtaaagagtgaattttgccatgggaaatagtgtattgctacagtaagtaagaatattaagtttaccaagtttttctagactgaagacttaacaataaataaggcacatcttccctgtaaggtttctcttgagtctgttacttttcagtagatgatgatgatgacagcaacagcagctaacatttgttgcttattatgtaccaggtcctgctctaagtgctttacatttattacttcacttaatcctcccagcaactatgtccatgaattaggtattattattatctattcttagagatcaggaaagtcagatgaggggttatttaacttggtaatgaggggtaaaaccaagattcatatcccacctgtctgatgccatgtccaagcctttcaccactacactttcctgtctccctctgtggtagtgcagggatactttggagatgtaacacatcttaattaaaaatactttattgctgaaaagtgctcaccaccctctgagctttcaagattaccatctgagtggtaatctttttgctggtggagggtcttgctttgatgttgatggttgctgactgatcagggtggtggtttctgaagcttggggtggctgtggtaatttcttaaaataagacaacaatgaagtttgccacatgattgactcttcttttcacaaaggatttctctgcagcaggtgatgctgtttgatagcattttacccacagtagaacttctttcaaaattggagccaatcctctcaaactctgccatcgcattatcaaatgagtttataaaacattctaaatattttggttgtcatttcaaaaaatgttcacagaatctttaccaggagtagattccatctcaagaaactcactgctttgctcacccataagaaactactctttacctgttcaagtttgataatgaaagtatgaaagtacaacaattcagttacatcttcaggcttcacttctaattctagttctcttgttattttcatcacattatgtacagttacttcttctactaaagtcttaagtgcctgaaagtcatccatgagggttggaatcaacttcttccaaatgcctgttaatatttatattttgaccttgtcccatgaatcacaaatgttctttatgacatcgagaatggtggatactttccagaaggttttcaatttactttgcctatgtcgatgatagaaatcactatctacggtagctatagccttatgaaatttattttttaaatataagacttgtaaatcaaaattaccccttgatccatgggctgctaatagatgtcgtgttagcaggcatgaaaacaacattagcctctttgtacatctccatcagagtttttcggtgaccaggtattgtcaatgagcagtagtatgttgaaagaaatctcttttttctgagtggtaggtctcaagagtgggcttaaaatattcagtaaatcatgctataaacagatatgctcttgtcctggctttattattccatttatagagctcaggcagggtagatttaacataattcctaagagccctaggattttctaaatggtaaataaacattggctcccagttaaagttacctgctgcaccagctcctaacaagacagtaagcctatcctttgatgctttgaaaccaggcattgacttctcctcaatagctataaaaaccctaaatggcatttccttccaagtagaagactatttcatctatattgagaatctgttgtttaggtcagccaccctcatcaattatcttagctagatcatccagataacttgcttctctatcagcacttgatacttcactttgcacttttatattatagagatggcttctttaattcatcttcatgaatcaatctccactggcttcaaacttttcttctaaagcttcctcacctctcttggtcttcatagaattgaggagtcagtgccttgctctggattaggctttgtcttaagggaatgttgtggctggtttgattttttttttttttttgagacggtgtcactaggctggagtgcagtggtgccatctcggctcactgcaacctccgcctcccaggttcaagcgattctcctgcctcagcctcctgagtagctggaactacagacacgtgccaccacactcagctaatttttgtatttttagtagagacggggtttcaccatgttggccaggatggtctcgatctcttgacctcatgatccacctgccttggcctccaaaagtgctgggattacaggagtgagccaccgctcctgtttgatcttttatctgcaccactaaaactttctccatatcaacaataaggttgctttgccttcttttcattagtgttttcactagagtagcacttttaatttccttaaagaacattttctttgcatttacaacttcattactgtttagtgcaaggggcttagctttcagcctttctgggccttcctcactaagcttaatcatttttagctttttatttaaagtgagagataacgtgactgttcctttcacttgaacacttagaggtcattgccgggttattaactggccttatttcaaaattatgtctcagggaacagggaagtcccaggagagggagagagatgaaggaacagctagttggtaaggcagtcagaacatataaaacatttattgattaaatttgtcatcttatatgggtgtggtttgtggcacctcaaaacaatcagaatagaaacatcaaagatcactaatcacaaatcactcaaacaaatataataatgattaaaaagtttaaaatattgccaagaaccaccaaaatgtgacacagagacatgaagtgagcacatgctgttggaaaaaatggtgccaacagactcaatacagggttgccacaaactttcaatttgcaaaaaatgtaatgtctggaaagtgcaataaagtaaagtgcaatagaaagaggtatgcttctatatcctattttcaatacaaagatgctgggtagccaatttctaccactgtctttgtctatttgacaaaactttcccatgacttttatactgttaacttttttgaatagcagatgagacacatacttgcatcctcaaatctgcaaagacaccttgggccagtttgaaccgaatcccatttttaactgaaaatgatgaaaataaggtacattattagcctgaactttgcataactctaaaatgtattaatcttcggtaaaaattttaatcttagttttagaatcctcatgaagtacttagaatgtttaaatgagataacactgggtatattaaacattatgaaattgccatttctgtagcttaaaaatggtcaattgttgccacagtcaagtgattaaacctaaggtaagtaatcaacttaccttattaagttaactgctattgttgtaagataaattattctcactctacaatcctccctccctgaaaacttttctagtctggaatgtactgctgataactagtgctagggacatagggttgaacttgcccatgattttaatttgtaatacataggcttttaaaattcatatcatagcaggtatacctccaaatgatgccacaaagacagcctagaaaatgggccttagaagattaagttaataaaggcttattatttttcctatagctggatgtactcttaactagataactttcaatagaaatcaagttcatgaagcaggttcatgggaactgtattagtttcctatcgctgctgtaacaaattagcacaaacttatagttctggaggtcagaaagtcctaaaatcatggtatcagcagagttatgtttttttctggagtctttaagagaaaatccctttccttgagttttccagttattagaggccacctgtattcattggctcatgatctattcctccctcttcaaaaccagcaacgcagcatctttcaatctctctctctctctgacctctgcttccatcaccacatctcctctgtgatcctcctgcctgcctctttcctttaaacggcccttataatcatattaggcctaaccagataatctggcataatcttcccatctcaaaaatccttaatttagtcacatctgtaaagtctctttgccatctaaggcaacatactcacaggttctgaggattaggatgtgaacatcttcggtggggtggggaggggggcattaatctgtctgtcacagagaccgaaatattctaggtacccaaatttcaaatagcaagcaagatggtatcttatttctttaaacctcatagcatggtaagctgcacagacatttttacatataccctcataatttttaaggagattgtgatgtacaactctccagtttctcttctggcacaagtgtgtggaaatcatggtcttagctttggtttgtagaaccagattttactcctttacccagttttagtcaatcccatttatatttaaatttgtcctttttgagcattcatactgctatccttagccaaagaattattagtacagtaagtgctttctgcacttccttctcctaactctaggaataaaaggcacacgtgtttagctgagaaccaaccaggacagaattctagcacttctcattacatctttcttgtgctcttccttcaggcactacattgacatctcaataagcaaataacaccagcgttgcaggtgttaacaccaatgactataccatgagaaattcccttatgtcacgccttgcatgggtaaagttaactcaaatgtcttccttctcttacctaaaatatctgcttgcctgacctacatctcccttgtccattgtttccaatgaacactaacccttaaacatttaagcctcatcagcacatgcccatcataacagcataacatccttgtcctgctggaaactattcagcatccagaggaccatctttatgctgataacactaaaatataaaataatgccaacagctggtgctacaaatggcttttaaaaacgatgttcattcactaaaattcctcttgctacttttgacatgaaacacgcagtctctaattattctgatcaagacggtgaaatacaaaaacaaactttaattgtgtttaacagatatttaatcaggactcactgaactacagattaaagctgaaattcataaaccataattacccgattgtcgcaatcttttggtccacattctccttccgtctgggcgtctggcaccttgccccgaatttcttttactgtcttctcagcttcattactgttcatgttttccagcagagatttagcacagattacaaaatatctgttcttggcaactttcttcattagctttttctccccccttgcaaaaagtttattttcttttttctaccagagtagctggaacaggcatacgtttagggtgctttgatgacacaaactaattatatagttatcaggagataatacggtagcgataactaaagttactacagttatcatgtaggtatcatgcaatttctccagtataccatgcggtgtgtcccagtcaccacgtaattacctaatgtcactactgcattgtttcatggaaaatgcttatctcaccccaacaaaaccttttctgccacatttagagaaaaaaaaagaagtgaaattcttagttctcatatccagtactgctcattcccagtaagatgttgtcatgcaaatgtaagggaaacacctgccctctcctgaaaatttgctcttacagggagcaaatggagcaattattattattattttttcctgcttcactctttccaggtaaaagaagtaattaccaacaatacatacattttttctttttttttctttttttaaaagaaaccaatccccctaccgacccccgaaagaaacaccctatttacttaggattcgtttagtctggcacttcccccctatactctttcctttcaaatttcagtcactcacatttgtttttcctagaattatggtgtaaatcattcttaacaagctaacttgaaacttctctcactcagtagaaacacaaaatgccactgtaattgaaacacggaagcttgaaactctttctaaccagttcttttgggccactcttcagaagggcatgccgagtttccctcacagtgcggtaacccctgggtcacacagcgaggataacatcacagaccaaggcaagaggataaagagaaggcactggctaaagaagaggtgggtggttcctttattccccccagttgggcagtcaaccctatgaagcaaggactgtagttgctacttatttatctcaagttgatggcttgaagtctgacctcactaagacctttagatgtgacataccacctgagagttccagtttaaaacaggatgtagcagcttcctttgcagcacaagttgaaagctatttccaattctgcttttattagtcacctcccaatctaagagctgcccattcaattgtacacttaactcatgtcggggtaaaaagcacctccagatttagaagggccagaaaaattgctatcctatcctagcacattgttcttcaatcacacagttcctctaaatacagttgacagcctttgagatgcaaaatgtatcactttaatgtagtagaggtccccttcactgcattgccaaatctatttagcagaatcttcttggaataatctgtccctagacctgaggatgcacagtgatttcaagcattttaagctaatgataatggttagtgctgagaacagatgtacctggctgtgatgtgatctattccagtaggcttttatgagctgttcattcctattgacttagcattttatgtctgtgcttttgcctggtgtgatggttgcataggggtgtcatgtgtgtattttcctgatgtgtgatggctgcacagggggctgtgtgtattttctcagtgcaatggccacacagggtgttatgtgtgtgtttgcctggagttatagctgcacatgttattgtgtgacttttctctctatttgatgcttgctcgcagggtcctatgtgtatctttttcttagtgtgatggttgcactcaatgctgtgctaatgatggacatttctagcaattatctatctacagggtcctcgggaaaaaaattgcagtgaaatcaataaacagtgctagacaggcccttgtaaatatgaaatgacaccatgcataaatgccgtttcctactatagcatgttaaaatccaaattctgttatgttattggcattgggataaaatttctatggtccctccatctccttcatatattgcaatcttttgggggaagttgagattactgctggttggagggcttttacacatgcatctatgtaatactactttttgctacattgtcctacacatcatctcttatactccattctgacttatcctggcataatagctgatattctaaaagtgaatatgcctttcatttattccttcagtctcaccaagccctcccccatataacccctacatcacacatacaaaaccccctcgcttgcctccctctctctagtttctccgtatccctcctgtgttcaccaaacggaactgacaaaggaaacaaccaatgaggttaaaatcttttgaaacccctggaatacagatgagctgggaggcatctggaaacaaaaccagacacttgaaatcaaagagacaagtaaattactatcctaatctaggaagaataactaaaggtgtcagtggggttccattgatagcacttggctctgggccagaatgccaagggttcaaactccacaccagctttgggctcaggcccaagacttgctactgcagggtgcagcagcatgtgcagcagtgttaaaggtgtcagccttctgcagagaggttaagtccaagtccttctgcctgtttgtcattacaccccagagagacggagagataaccctagctttctcttcgctgcctttctcaatagaacaggctgaggaggaactagtgctcagcagcagtacttgctagtatgagtactatacaactaattagtaaaattcccctctactgataaggctgcttgaagtatgcgcaagaaaatccactgtccctctccccccacgaaaaacctgatgtttgtcctaaagattcttccatcaatgcaaagagctaagtttggaaacctaaaaccatgtgtctaaaagaaagaaaatgttttcattggaacagcttacatgtctggtacacttgcataaaaactatcgcatagcattttagagctaaaattgctataaaatgcttaatacagtaagagtaattatgagattttgcatgcacagctggtatacaactagagtctcagccacatattcaatggagcatgggaaaaccatttataaaaattcctggtatgccagtttaactcaccatcaacagcctatcaacacttcattctttaagtggatagggaagatatttacctaccaaatgctttatttcttctctcatggatgttatcaatacttgattcaaggaatttgagttattacttagagagtataaatataagctgttaacaggacatgaatgacctgaatgcaagccttctccactgagtgaagaagttacaatgatagtagtaagtaatgaaccagaagaccaaatcattaaatctacttgtatcttccctttttaacctccgctttttgctatatcttcacatattcttatctctcttcatttctctaagattcaaatcctcgggtgagttcctgggtactctggactcccctgccatagcccacctggccttgccttcccctgagtaacaccctgaagacagagctcttcgtttacattttcccccaatcaagttataacaggtatttgttctccattccctttagttccagctacatcacttgaaaagaaactgatttgggtgagttgttaatggttaataataatttaataaagtttatttcttgatgaaaacattgattttaagagtcaaatgaagaacctctttattgtggtcttttaggctctatggaaaatgccataataggtgagatgattctaatcagaagcattgatggatgctccattgcacattttttagccataggagccagtggatagatgggaattcccaggtggacaggaagtttggggtcacaaaggcagcatgacacaatacaaaatgaatttgaacagaatcaggaaactcaagttttaggaccaacaaactttgccacgaagtgtttggcagacattcagtttcttaacctgagaaatgaggcaggccctgggatcagaaactctccatgatcctctctggctcttacattctatgactctctgaccgcagatcagtcaggtctcctggattagctaccacctccagttaagaactaatagttctgaataaagatggcggtcattccacactgagccaacctaactaaagaggtgttgatgtccataggtgagttttacctgtctgcctacaacctgcatacactacttttgagttggctcctttatgctatacagatatttcttagcattttgttttccctcatttacttaattcagcaaacatttaatgagcactttctatacatgaaacacagagtcgatcactaaggacaggactgaacagggcaccatctctgttgcacagatgattttattattcttgtccattctctctctctctccccaccttcacttttatgcataaacacatacttctagaactataaaagtagtatagaaaaaataagaggaattagacttatctgagccagtctgaaatactgtttattttaaacaaaagaatatgataataatttgtgttggcaaaatatatgcattcaattacgcacttcaatagtataaagggtatttctcaacatgtattttgaggtcagtaatttgcaataaggataacaatttgggggaaagaagattataaaggtaaaacattcccttctgtagaatcctgataaagtcctaggataaaatctgtgacttgtgtaaataacctctgggaaagtgagatcatagaattttttttttaagtttttgtttttcctctaaggattttgggttcatatccctccaaattttatttcctgacttaaaaataataactgccacttattgagtaaatattaaattccatgcacttcaaatacattatttttataaatacagtatgaaatacaatatattaatatattgtataatacaatatgatatattataatacattgtaaatattaaattcaatatattattaaagcaactctgctagatagatattattactctaacagacatgaaaactgtgggtcagagagctgaagtaacttgtcaaagataattcagacagtgtgcagagttagaatttaaactcaggtctgtatttgtctatgcaatatggctccataaccatttcttggttctgctgaatctaactttattttaaaaatgaataatcttgcttgaatgctttgttagcaaataaggaaagcaccctttttactcttccttcacattcattcattgcattacatatagtacaatgaaaacaggagatggttaagattttttcaatgcagatctggttgccttttcatattgatttggactgagataattaaatttgggctctcaatcaaagtgaaagaataagctatttgctatctgaataagtatttcttattaattgatcagacatggataaggtgtgttattacaactatatttgtaaggtatgatttatgttgttctactgcatattactctgtgctgtttttcattttcttgcactttggactttttgttttgtttttatgaatttagtcacagttggttgtgtgttgaactttgtaaaaatgtaatactaaggaaattaaaaaaagaaagaaaatattttcaaaatgatgtcaaaatcaaatctacccctcactaatttgatttgtaggaaatggagaacaaagtattagaagcagaatgcttttaaataatcctaattacttcaatgtgcaaatgcattgactaaatcgaagcatgcgtttaacactttgcacttcaattgtgcttattcatctaagttctatagatagcaattctataaaaaacaagagatatagccagccattccatagttattgggggaaaactattgttctaaaattcaagcttacctctcaagtcagcccacttttggactaacgcagatcattaggtcaaagaactcaaaataacataatttactgtaactactcaggttttcccaattgactctgccttccctattctttttttctgccttcagcggggtggggtgaggacgtggaggaaggaaagcttctgttaacaaagccacagagtggaagcagcaaggcttttggtagtcaagccacacagcattaagcagggccaatcttaaggaataatgccatggggttagagtggtttgtgatcaaggctgagatggagtcatgatggcagggtaacttagtacctggtctaggaccagctgcatcagaaccacctgctgagcatgttaaaaagacacatttcagggtctcactccagagcaaaccaacagaattagtatctcttgaggtggaactcagatctccattttaaacaggctccccaagtaattcttatgctacttaagcctgaaagcactggcatatgcacttaagctctctaattctatatccagcgacagccctgctgctacacctgtatactctgtcccagtcttcaagacatatgtgcaagtccaactacttgtcctgggaggcattaatgctaataataatggcccaagggcttagctaggcatgatgttatttgacatgcagtatctcatccaatccccacagcaaactacgagacaaagatgattactattctcatctttcagatgagaaaactgaaattcagagagacttagtaacttgttctgggtgccacaataataactgaaagagctctgaagaactatactactgtactttaactcagccctgcagaaaaatatcttgaaagatgtttacttctaaaggtgttcataacttggtgatatcattattccaaagaaacttgcctagatgctagtaagatagattatggaataacacacaaagtgtaagcatttctacccaaggaacttttccttagattatttcatagagacttaaactctcaaaaactaggctaagaatccttcattagttcgttcaacaattatgcactttgccagaacctgaggtatacaaagataaacaggacatagtctctgccttcactagacttacagttctgaaaaagagacaagcttgtgtacaaatggttctgggttaacttatacagtcagtggaggcctgagggagagagagtagttcattctcctggcagaaggaaaagagggtgaggtctgtaaagttttagttactccagcactatgccattggctaatgtaaggaacttagattttaaagattatatttttacttgtacagttttgttactaaaggggcagactaagttacttgtatatttcgagccaataaaactttatctggttcattctctctggcatcaaactggttttcttttttgggtaaatttctgggtacagagccaagtaagttgttatgtttattcattcttacacagagcaaccgagattctattcttgaaatgagtgcctaataaattttatcagtagtactttattccacccaataaaagtggttcttccttgacatactgtgtcctttattttcacttgtttcaattactcagaatgctattattagatttgcatattttcataagagaaatttagaaattacaaatgattgaaaacaaagaacaatctagattctttcctttgtgataagagaggatgatcccatatacatgtaaatgtgctttgagtatgttaatcttagaaatgactgaagaaaatgacattctaaagaaaatgagggccaggcatagtggctcacgcctgtaattccagcactttgggaggttgaggcaggtggatcccctgagctcaggagttcgagaccaccctaggcaacatggtgaaaccctgtctctactaaaatacaaaaaagtagctgggcttggtggcacgcccctgtagtcccagctactcgggaggctgtggcacaagaattgcttgagcctgggaggtgtaggttgcagtgagccaagatctgacacttcattccagcttgggctacagagtgagactccaacaaaaaagaaaaaaaaaaaaagaaagaaagacagaaagaaagatgaaagaaagaaaagaaagaaacagagagagagaaagagagaaagggaaaagaaagaggaaaaaaagaaaaaagagaaaaaggaaaaagaaaaaagaaaagaaaagaaaagaaaaaaatgaggttctggaacatcgaagttcaggctaatcacttaaggcaaaggtacaaggatccaaaaaagaaaaagaaattatgaaatatgatatgattcagtttggggaaactgaaaatctatgtatcccatattttagtaactgaataaattggaatcatacatgtattcttttctaagttgaattattaccaaatttgagattcagtgtttagattatttactgcttgcttaaaacttttatttttcaaattatcagagtatttttcaagcattaagaaagttcaataaaaaggcaatagaaatatcaagtaattccaccatacagagataactcctctttacatttgaatgtattctcttacatcattatcgaatactttcatttttatatttgggattgttttaggtatatatatttatttgtatcttttggaccaggaatttttagttgtgttattttataaacttttcctaataaaatattgtttaaaataactttaagaactatctaatttgcatatatgatatgtggtgatacatatggatattcaataatttaataatttctcgaattttgtaatttaagattttaaaatcttttttctcttttataaatgacattgtgataaacacctctgtacctaaatctttgtctgagattctatttcctctagacagatgcctagaagtaaaattaatgggtcagaggacatatttttaaagcaaggttctggataacataatgctacattactttgcagaattttgtgtcaatatatagatatccactatcactatgagtgtctatttcactgtaccattaccagcactgaaaattactatttttcataaatcatgactttgaatcctagtgaattatactttttcatgtttattagatatttgtatttcctttcataatttttctctttatattctttttagccattctatttgactgaacatatatctcaatatcttcatatctgttgcttcaacttcatttctgattgtaacaccatagtctgagctctccttaccttgctctgaatgatggcatcatgtctgcctggtctgtattccaggtttctttgattctgatttattctgcacactgatgccgaacagttattttgaaaatatgctttcatcatgtcagtcctgatcaagaacctatgacagctcctggttatttatctatcagctacattcaactgcctcattcaggggaaaattcatcccattcttggatattcccttatgagttctgttgaataatttaggttattgctatatggaccctatatgcacttacgtttttataagtgggtatttctatataaagacagggagacacaatgtggagtactagaatacaagaactggaaagggctttaaagtacatcaaaaccaactgtctacatttataaataaaaaaaagtggcctacagagtttaatgaactacccatggtcatggagccaattaaatgacagaactaggactagaaactaagttgcattattctcttttagtgacttttagatagagaataataaaagtcatttttacaatttaaaaaatagaaacagctaggaaggcagtttaatttcaatctgttgttatgtataaaagattgttaaaatcatgccacatagaaggcttgagtgttcttttaacatgaataatatgtacttcttataaatcaatcaaatgtatcattagaatttccataaaatttgcacatctgcaaatgacctagtttatttatactttgctttttcccttgctaatctatattgttttatttaatctgctttgccacaataaaagcacagtattttttatcctagcatattgcagattttcactaagtttcttaatcatatcaataaaaaatccaattttcccagcaaattcatataaaagatttcttttgactatagttagggatttgaagaactacctttaaaaaataaaaaaaaaaaaaataggaactacttcaaaatgcctctatttaaatagtaaacaacacgaactattgtggaagaatgtgggctgtcatccatttaatatgatatgatgattgctatatatattcaagaatcccactgtatttgccaaatgaaaacttaacggtagtcactggtttagaaacgagagttaccaaatatatttattatttgtggaagaggggtagggcataagaggtaaatgtggaaatagccatgaatggacctaactttgatagaagctcactgatttcaaagggctgattaacaaagcatgtgtttgcctaacaaaataattgacagaaaaggtatttattaaatcataaggtgattcaactgtttataaaatacaaggtttaaacaaaatggtagttcatcagcagcaatgagagctcagctatgttttctttctccgtgtgtgcatgtgtgtaaccaaacaggtccaccattcacttaacactcaaccaatatttattaagcacctactttgtgctagaaaccctctactatccaaaataagtaaccctgttattttgttacagaatactcgactactctggactgctgtaaaataaaaattaataataatttagccgggcgtggtggctcacgcctgtaatcccagcactttgggaggccaaggcgggcagatcatgaggtcaggagatcgagaccatcctggctaacacagtgaaaccccgtctctactaaaaatacaaaaagaaattagccaggcgtggtggcgggcgcctgtagtcccagctactcgggaggctgaggcaggagaacggcgtgaacccgggaggcggagcttgcagtgagtcgagatcgcgccgctgcactccagcctgggtgacagagcaagactccgtctcaaaaaaaaaaaaaaaaaaaaaaaaaaaaaaaaaaaaaaaaaaaaaaatgtatacctgatataaggtgttataacaaaaataataaattgagtgataagaggagacagatgaaacagcatcctaaatttctcatttcatgtaggatactacttcattaatgacaataattaaacaggcttgaatgtttttcagaaaaacaacagtgattattaccgaaagaataaactgtactttaaaacttcaaattgctagattgataaaagctaaaaaggtaatcacacatcaaaaaagacagagagtgagagtgagaaagtgagtgagaatagaccaagcaagcataaaaacatagaaaatataaaaaagatttatgagatagtactagatatattttttataaaacgaatattagttaatttaattaacattaaaaataataaccataataatgttaaaagataacaaaacataatttaaccataggatagcagtttaaggacactagctttggtagcaaaaacaggattcaaatattatttctgctatttacttgttataatctctttcctactggtgtatttatttagactatttacctcaactttctgctctaaaaaatggaaataagaataactgaacgtagaaaggattgggaaaaaataatatgtaatgcttagtgaccagcacaactaaacattcaataactgtaatttgtaatattatgtgttttaaatgatgtatctaactatgtacccatataaatttaaaaaaaaagaaaaaaatagaaaaatggtgctgatagattttctcaatgcagagttgccacaagccttcagtttgtgaaaaactcaatatctgcgaagtgcaataaagcaaagcacaataaaaataatataaaaaacataataaagagagataagaatcaaaggagtattgtccaagatgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaatattcatataagaatgaagctgaaagctaccattgtaagatctggattgggactgagaagatccagataaaggcaactgtaaaacccctagttagggacatgtgaacaaaacgaaacaaacaaaacaaaacctgtaaaacaaaattctaaagcataaccaagtaatggtaagaaaatcaataattgtaacattcactccagataaatttgattttatgaaattatctgacaatgacctcagcatgaatatgcttgagatgcttagtgataaagtactcatacctaaaaaagaacaagaaatgattaaagatagaaataaaataagaataggtgaataagagtaaaacttaatcagaaatcttaaaaaattaaaaatgttcattaatataaaagtacaataaatgaaataaaggaatttcaaggaaagaattgagtgtattggaaggtaatgttaaggaattcactcagaaaaaaattgtagcaagaagaattaattttttgaaaatgaaatagcaattgagatactaatcagtaagctgattagaaaataccaatgtttatcttataagaattccagaaaaagaaaatggaagtaatgacaaaggaacaataaagaaaaggataatagctgagaattttccaaaactggagtcctgagattaataagtatatcctgagttcatgactaataattcaaaataaatccacgtccagacacatttcagagaaactacaagatatttaggatatagaataacttttaaaagctaccaggagaaaaagcagattatttataaagagataaaaacagattgatagatttctcttaattaagaatagttgacagaacaatagtctaagatataattgagtaatgtctttaaaatactcaacaaaaaatacccagataaattgctatttaagataaaaaacaaaataagtacatttttagttatatgaaatatatgtattacccaaggtcctcattaaataattactaaaaaaaagtaacaagaaaagtgcacccagaaaggaagccacaggatctaagaataatggtaggcatagtaatatctaaaaatattagtaaatataattaagcattgattatagacaacagtgatcaccacttttgaatatggttaaaaacaaataggtaaaactaaaacttcatacacaattatagtaacaagattgatacttaataggtaattaaaagatgctatgttaaccaccttttttatactaagaagaaggtcagaaatactaaaaggtcgattttatattttcttagaaaaatacacagttcagtatacacaaaagaattttagaattagtgctaaagaaacagataaaccacctacagatttcaagccagaagtaaaatccatgtaccagataaaatcacaaaataagctaaaaaaagtttttcaattaaaaccacataaaacacatcattttattttaatgcgtttaaattcagaaataaataataaaaatagagcaaatatgtttacaaagtaaaagcatacccttctaaatacctcaagggctaaaaataaaacagatattatgaaatatttaaaattgaacaaaactacgtatcaaaacatggtatgcacctaatgagaaaccaggagaaaaatttagagtctgaaattcatttttaaagataataaaaattattgaaagtaaaagggtaataattcaattcaagaatctagaaaaagaaaaatggcctaaaaatataaaaaaaaagaaggaatgaaataacgctaatgctgataaaagcagaaagtaatgatttagactacaaataaataataaagtagataagcagaatcaaaagccagtttttgtaaagaagtaaatgaaacagaaaaatgtctagtgtctaataaaaaaaagcagaagggtcaaataaatattaggaataagaggggaacataaggacaaaaaattaaaaatcataagaatatataaataactttgtacaaataaattgaagtataaactgtgaactgtatttaaaaaaaataacttcccaaaattgactagagaagaatcagaaatttcctctgtggttattggtttattctgatattcaagtctgcctacctacaacctactgatgaaaattaccaagttcagatgacaaatactcagaataaaaaatcccaataatgtgaaaactgtttaagatatagaaaaaaatgaaatgttactcagcttattttgtgaggccagtattgtcacagcaaaactctatagtaacagttaagaaaataaaatttaaagattgatctccccatgtaaacatactacatgtcagtaaattaaactcaatagtagattaaaaaatacaccaagagcaagaatattttttccaagaatataagaactgtttaatatcaggaaatgtattaatatcttataaaatattaacatagtagtggaaaattttatcatattattgatgcagaaaatgcattagataaaatttaactagtatttctgattaaaaacacttagtaaactataaatagtttaggaacatattaagaacttccttaatacaataatttcgatttctcaaaatcccaagcaaatgttatgtttctaaaacatttccattaaaataagaaacagaatagatattcttaatgtgactatcctattcacactatactgaggtttagtaatgcaatatgacaggaaaaaattgaacatttaagaattagaatttaagagaatgactgtcattatttactgctgacatacatgttgctgtagaaaacttaagagaatttaccagtttagttattcaaagtagtaagagagctcagcaaagttgctgaatatataacaataataaccaataaacaatgaaatggaaaacagatatgaatataataatgtaagaatctaagttatatgaggaacaattttacaaaataggttcaagaaatttatgatggaaattttaaaacatgattataggatatgaagatgatcacaaatagagggatatagtatgtcactgggcagcaagacacattataaaaatgtcaattctccccagattattttctaatgttaatgtaattacaaataaaattcagcaagacttttgccaaacttgaccaactagccctaaaactcatattgaatagcaaaagaccaagggagctaaaagaatcttaaaaaggaacaaggtagagagacttatcttaccaagtaaaaagaatattataaagctatggtaattaagggttatggtgttagtacaaggatagaaaaacagtccatcggatcaaataaagatcatataaacagatttgatataggcaaaagatggcattataaattagttaataaagaatgactaattttttaaataatgctgggataactgggttatccatatggaaaaagaataaaatagggtgcatgtagggtaccagaaccaaaaataattccagaaggattagagatctaaatgtaaatgggaaatctttaaaactgttagaagaaaatacagaaaggtaaatgaccttggcatgtgaaaggatttcttaaatgacataaaagcacaaattatgaaggaaaatatcaataagcctagttgagttaatattaaaagctttataaaaacaaatactactaaagccacagttaaaagggcacctacaaattgggaaaaaatctttgtaatctctatggcccaaaatatgaaaatccagaatattacaacaacagcaacaactaataccaaaaaccaaatcaagccaaacaaaactcttccaaaataacaacagcacaacaaataacccaacagaaagatggacaaaagatgcaaattaggcaacacagaagagaaaatcccaatggcttacaactaaaaaaaaaaaaaaagttaatgagatattattcaattccgatcagactgacaaaaattttaaaaagtctgaccatcacaaatgttgtgaagcatgtggagaagctctcatagattgttactgagaatataaattggtacaaatacattggagggaggttttacaatacctagtaaagttcaaaatgcatatttcttaaagtttagcatttctacttctatgtatatatgtctataaaaatgttaactgtggtcttgtttgtgattgggaaacaattaaaataatgtccaacaatgagagaattgataaataaattttagtaatacatacagaagaatacatttcatataaaccaaaatatatagcttatgtaaaactaattcatgatgatagaggttacagtggttttgcttgttctttaccttttgttaaaactttggaaaatttcaccttcaaggggcacatacaaaggattcttcttaggtattataaatattctgcaccttgggttgggtgttgtcacatgtatactcatcaaggtatacacttaatttgtctaattcactgtatgtaacctataataaaataataaaaaataggttcagaaacaaatgttccaaattattaaacttcgtttaacctgggttctggattcttgtatttcatattatcctttatacttccatgtgttttaatttttttttttttttaaagacagagtctcactctgtccaccaggctggagtgcaatggtgccatctcagcccactacaacctccgcctcctgggtacaagcaattctcctgcctcagcctcccgagtagcttacaggcacgtgccatcatgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatcaccaagaacgttacagtatgacctacttaagtgaatacttattaaagaaacagattcatttaaaaaacatgtttttaggtaaataggaacggtgcaagtgtttctttgaaatcttacaaaagataaaaattaattgaactaactaaggttccttaccctatgcaaataagaaacggcttagaaagaaatgtcttcaaactgttgaaatgtatattccttagttggtgtaaccaatgtgaggtctcagttactataatagcaaatgttctattagatttaagcacatcagtgcaaattattaaaatgagactgtctttgtttaaaataaagctttaaaaaatgtaatgtaatctctgagggagtattgcctgaaatgaaagttttaggccgagctctgccacaatcctattgcgcatcttggttcatctgattaaacatctttgggtctcaaaattcacatacattcacatttctaaagtgagtgtgatataaagtcatagcttgatcatcaaactcctttctagccctaaaattctacgtatctaatgagattaatttatcatgaggtgtttttcttctttcctttgttaatttccttacaataaatagacaaataaatgatcaaataagcaaataaataaatattaaaaagacatacacacactgatagctatccatctgaataggaagaaagacttttttttgtttgccattatctatcccctaatgtgtatttaaaaagagagctcccacagaaaagatttttatttttttctaaatcaaaaatagtgtatcatttatttgccatttaagttctactaagaaggaaaacacaaaatcattatggaaatcctattaggaactttagaaagaaaaagctgatgaaattccatttacaattcaaattgttcattcacgtatttccttttgcagaaactttaaatgctgcctcaaactatcttcacctctttttccagggacaatatccctaactctgttaaaaaaaaaaaaaggctctcttctcacacccttcccacctgtcctctgaggtagttgttccacaaagctaaggtatagattacatcaagagatatttgggatgggagtaaaacatttcaccctggagacagtaatgtgtgcaatttgccaagtctaaaagaaagttaagcctcatcaccactttggcaagaaatgtggttctcatggatggacaatgattatcatttttacacagaacttttgaaaatgaaagtacctggggcaccagccagaaaataagtacgagaatgcaagttttttgcgtcaatatttaaatcagacaaaacactatcagtgtacccttaacagacctgaagcgtctagaaagaatacaaggcagctgacaccttggtgaataagagcagctcagttttatgaaaaggccaaagtcttagggcaaactctctgttgttccaagtgctgatatacctatggcatcaacaaaggcaaaacaccatagggggcaataggcaaggcttctcttacaggcaaggctcctgttaaaggctgggaccctctggactacacactcgaggaaccccaagtgtgggtccctgaggggaggaagtttcctcaaacagaacggcgagaggctgaagttacacagtgtaggagtactccctgctggcagctgaggttggaaatgaactggtgatgtcctagagagggctgcttaaattttctatgaggaggctaatggagataacagtgctcttgaggggacaagagcatgggtctgattaggtttagataactccagatattatgctgagtgaggaggaggttaagggaagctactgatgacaggaactccaacaattgacaaaaactatgtgtagagctggtatatacaattttcatttaagtttcccatctcatatcattctataaagcatacacagccgtatgtgcacatgtgtgtggggttcagaggatgcaggaagaaatctatttctgtgcagttcattttacccctgcaagaacaatctttgaaaccgtctaatgtattcacatttatgttttacaaggaatcccttccatacttctaatggacctgcctggtatgccccctgtaccactatacctaatccctaggcaggtggtctttgtatgggcctggggcaaccacactggtttctccccagtgctctgctctgttagggttcttctgcataataaaatgaaggtcaaaatggcagcctgctaaaagcagcagtatttcagttgcaggaataacttgcttgtcatcaacttgttaatgcaatagtcaaacatttctctgacatgtacagtatcagctaacttcagcagataaagggtctagaacaggaagatgctgcagatgctttagctcggaggaaggcttagcagagccaaaacgtcagcagggcctgtttgttccatactttccatcgggctctgtgaaagaaatgttagattactgcaatgacaagtttgtgacaagcaagtcatttgtgcaactggtgcgctcctgtttttatctgtttaccattcagacttgtgaatgccatttcaagcacttagaggatttctggctcccattaaggggaaatggttcctccatgtttagaattttctacctcaaagagaattactaagcaattatttgttcctgtggtcagtgtcacacaaaagcactcttgagttgtttagctggactctgaatcatgaaatgaagtcctgaagactggatagcttggagcatcaaaaatttcccatctagtttattggaatgactacaaagcaagcctgtgagagacaataaaattatggccagcttgaaataccttgcccttttgctctgggatcatatatcaaggccatatgcttcaagccacataaactcacttgtaacaagtagatcctgagaagctaaggcctggcgatgtcacactgacatgtgatttagcatatgactgttttggtgacaaggaccactttagctgttgagaagagaatttccactgacttctctctataccttgtgggtaactatagggtcaatactaatccagagaacattttaactgtggtaaaataaagtaatataatatcaaattaataactagggccatcctcactaggctgactttttaatagtgaatggagaccctggcagatttgagatcaagaattcaagatcctctcattaggtccttcacctgaagttgctgagtttcttcaagtcattttaacctcctgggacgaaggtagaaaataacagcacatgttcctttccatctgacataaatggtctcagggtcaatattacaaaagatgaagagtgccttcagactcaagaacaagaatgatactctctaaacatcatttattctttctacaattttacatttttgcccattgttggtactgaatttatacataactctaggtataactcccttttttttttttttttttttttttgagatgaagtctcactcttgtcacccaggctggagtgcaatggtgtgatcttggctcacggcaacctccatctcccgggttcaagcgattctcctgcctcagcctcctgagcagctgggactacaggcacccaccaccacacccggctaatttttgtatttttagtagagacggggtttcaccatgttggacaggctggtctcgaactcctgactacaggtgatctgcccacctcggcctctcaaagtgctgggattacaggtgtgagccaccgtgcctggcccaattctaggtataactcttaaagaacataacagaatgaggctttgaagcagacacagatgtacactatctggggaagcaagtcaaagccggaacaggtggaatgtcaaggactagacaaaagtaatgatgtaaagtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatattttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcggacagctttcttaccatgacaaggatcactgaaacagtctcaacttcaaactttgcacagaatgtatcctttgttcggtcttctgctttgtttctctttaatgatagctttgccatgagtcccattcgtatgtaactcagagctatgcaaatcaagctggtaagcaagcatttgcagttactcagtcttaaaatgaatatgtgtccaaccagtggaaacctgagtgaggaatgtctcctgaacattatgtgtggaatggctcctttccttgatgggtggcaaataataaactcagtgagatctgcattatattccctggtctcttttagtgtatgctcagagtgggtcacaagagtggttttagcttatgtaaaattttttcttatagtatttccaattttttttaacttcttgatgtctcccaaacacagaattcttaatagctactgaaaaatccccatgcctgaagaatcctaagatcccagggcaaaaatatggtaaagaacattaaacaacccatggtctgggtcttaatctggtgctcacagtgatcattcagtctctgctgcataccaccagggcacggaactctccactgtaggatacttctttctgttctgttcttccttatgctgaatcttaatccatattagtctgttctcatgctgctatgaagaaatacccaagactgggtaatttataaagaaaagaagtttatatgactcagtttcgcatggctggggaagcctcaggaaacttacaatcatagcagaaggcacctcttcaccgggcaacaggagagagaatgagtgctgagcaaagggggaaaagccccttataaaaccatcagatctcatgagaactcactcaccatcacgagaaaatcatgggagtaactgcttccatgattcaattacttctcaccaggtccctcccacgacacatgaagattatgggaactacaattcaagatgagatttgggtgaggacacagccaaaccatatcataatctatctttctaaaatccccccagtgcgtctagttctttctcaccctaaatttcagttcagagcttcagaaaattattagtttaatgactcatttaatgacaacccttgtgtgtattacataccaacaactgggtttagattgtcctgccttgtccctttctcctcacccaacatgatttaaattcccactctatccctctgacaagccggggagaaataaaagccagtcacacccatttctcatttccatttggatgcaggtagtactggtggcaaagcattcttaatctctttgattttctgtcctattctgtggaaaatctttcctgacaacctcaggcatctttgattgatatggctatttatagattgaccatttaatttattgtccaagcagggacacttttgacagtgaaagggccttataaataattataccaagactacagacttaaacaagaactttcccaggcaaacttacataacaccttgcatatacttttacttcaatacccatctttttgcataaaaactttcatgtctatttttcccaccaacctgtgaacactctttagcaacagaaacatatttttacctatgcagcttcagttcctagaaaagtgcttgtaagtataaagacctgggggtaaatatgtactgacgcacatgcatatgcctatatgcatgtgtatgtgtttgaattgatggtatatttttccataattacattctgtggacctctccccttatttcatagcaaataccaccaacacatgttaacttcatatttttggagatgaatcaaaaatatttcacttaatgccataggaaggaaatggtctgagtatattggtaatgggtttgcttttaatattgacagcaacaaacagaaagtgaaatgtgataaattttccactaaaagtctactgcatatttttttaacaaagcactgaacaataagctttaatcgctttcttcacaagtattataaattgtttcaggccgtgtgcgaaggctcacgcttgtaatcccagcattttgggagggcgaggcgggcggatcacctgaggtcaggagtttgagaccaagaacggccaacatggtgaaaccccgtctctactaaaaatacaaaaattagccagtcatgatggtgggcacctgttatcccagcaggaggctgaggcaagtgaatcgcttgaacttgggaggcggaggttgcagtgaagctgagatggtgccactgcactccagcctgcagcctgggcgaaagactgagactccgtctcaaaaaataaaaataaataaataaatttatttattaatttatttaataaaaaataaaaataaataaaaaataaacaaaaataaaaataaataaataaataaaaatttcagcagctgtatccacaatttcaagtttgtagtaaatgagttattataggaaatgatggtaatttaagagtgatcctttaatctccattaaaatgttggtggcatttctattgctttcaccctcgtcaagcacatttggaagtcctggtaacttttggcagtttttttgcttctgagtaactgtggctttaagaaaaagaaaggtaaggagaaagtgcctggaaaatgtgaaccacttagagaagtcatttcttcccttctcgctgacacatgcagaccattccagaaagatatgactctatactggttaaagagcttcatagaggataatctcacaacttccctttcagtgtttagcactcactattaataacctatctcattatcaaaccttaagattttctgttgcagcatattttgtcattatcagacctcagtgaagaaaagagagaaagccttgtttcccacttctcatcacttgcttaacagctactattagcgctctaccttaacattcctttttccaagataaaaaaagtcaatgtttttgactcttccttgagaatttttttccaaaatgttaaatttaaatttgtttggaggggtttgataattctgtctctctaagatgtttgtattcagtattatctgaaatcagaacaagcatgaataagtatgtaatctatgctcataagaaatcagagaaatatctatatttggcatgcttcttatacattccactattatagctattttaaaatttcagtttgacatttcacactcttgataaactttctataatctacttctagatgctatttttcccacagaggaagtcattctttattttcagtccatcaatgacatttaccaaaccatcacggataatgaaaaatataagacttataagattcaaaagaaacaaagttacatgtctattatttcagagtcttaaatatgtggaaaaaagaagacaatcccacacaaaagaagaaacatggataagcatgctcaggtgtttggtgctagctcaccagctattagtataggtgaactaatacagctatatggaattctctatacaagtgatgaagaagtagtggatgaaatgccacttttgaggtctgctttctctcctgaagaaaactaacaataacttttatttaacaacgttttgtttattcccagttttactgagtgttcatttcagtcctccctctgaagtggttagttatacttatctctcaaattgttgttatttggacactgtacgtaaaagcattgcactttgaaagcatgcatttcttgtcctcaacatctaaaataatgatttgcaaccatttagaagttctggtatcctgttgttaatgtgatttttgcatcactcttccttgcctattccttaaaatataattttaaatgaaaattaatttcattttgaggttttgaaatgcctctaacaataatttagaatacactgaatttgccaatattggaaaacatgtatgtagtctagattatcaagccagaatccaggaccgacctcaatagcatgtcacttctatatctctcaatactgagtctcatctcctactaatcatttcctgagaattctgaagtgctggccacaaaataaataggttagaattttttattttttggtcatttgagacagaattaaaggctctgctggttacgtggagttatatcataatactagctttgccttagttcagcaaaacttacattgggctaagaaagaagataatatattatcaaggcgttgtgtcctggtatcatcaaacgatgggcaaatcgatttcattaggtctctcctaggatatttcgtggaataaaagttagagttctatgtctataacttgcaggatagaattattaaaaatggttgtatttaagtgcattttcccaaatagtgagtttccttttggcagaaaagagacaatgaaggtaaatgtgaaagtatcatcaaccacaaactagtaagctgaactcaagtataatggcaatcttcctgggtgatcagccatagagcaccatttgtgcaagagtctgaatttctatactaacttacttttaaatttcgttgaatacaaacataacaatgtttttaataagtggcttatctattaagtttatagagaaccttccactaaagagattacttattctaatctattcttttgtccaatcttttccccatttttgcccagtgttttgtttatataatattttattctataaaaatctatattatacattttctacctgccttgtctattcttatacattcacaatctattctactcttagtatataatttgaacagattcacatacataaatcaacattcattacttctgggcatataaatggttgctgggtccatgacggctgtttaaataggtagcttccaggccactatgacatagggaaaaactgaaaagtgtatgttttataattattgagtaaaagaggattttcattatggagacatgtacagctatctcaaaggcttatttttccaaaaggaacaacgacactgtcccctgggatatgtgaattgaaaattcagtgtcaacctcttctaaaaaagtagatattttgaggtattaaaaagcgttcttttattagtgataacacctcttacttggggtcgttttgagatgaaagttggcaagtagatttttcaataaggcggggtgggaatcactataaattcataaactaaaaagaagaatgacaatttattggcccaaaaataggggagagggagagatttttttgttcttttttcttttctttttttttttttttttgagacggagtgtcgctcttgtggcccaggctggagtgcaatggcgtgatctcggctcaccgcaatctctgcctctggggtttaagcgattctcttgcctcagcctcctgagtagctgggattacaggcatgcgccaccacacatggctaattttgtatttttagtagagacagggtttgtccacgttggtcaggctggtctcgatctctcgacctctggtgatccacccaccttggcctcccaaagtgctgggattacaggtgtgagccactgcgcctggcctaggagattttggaataaaggtgtctctgtgactaaaaacatataactggtcatagatagtctgtttacctctagtgtcttttggagcaagggtgtgggtctctctgttgagtggtgcctatcattaggcatcacagcaacatcaacaaaactcatctccgtaatatagtagattttacattgtgttaaggtagaccttttaaacaactccttcaagttttctgttgatttcctgccagacagtcagacagctacttcttttttagtaggagtagtcaaggctaaagtcaatacatgtgccttccttgctgagttagaatcaggcatattccatcaacacatatgtcccactgttctcatttctctcactttactatgtgattagtagacaaagtatatactaaagaaagctgaggaagttgctaggatttctaaagaagaagaatccaaatcttgcctactttaggcaaaaaacattttagtattaattgaaaagagatggttaaattgcaacccataaattaaaatgtagttccaaagtgtgtctatagtgatctacaagcaaacataatttctcatattctttttttttttttttttttgagatagagtcttgctctgtcaccaggctggagtgcagtggtgcgatctcagctcactgcaacctccgccgcccgggttcaagtgattcccctgcctcagcctcccatgtagctgggattacaggcacatgtcactacaccgggctaattttttgtattttagtagagacggggtttcactatgttggccaagatggtctcgatctcctgaccttgtgatccgcccacctcggcctcccaatatattattaaaatatattctgcaggctaattctatgttcttatctcattcctgtttcttcctctgctccagaaaggattagtgtctagcataaaacaaacagtatataataaagaacagataatgtatagtcataaaattctgaatccacagcaaaaagagggtaaggtcttagtctagcaggtaagtcttattgacaataataaaggcatgtttctaagccacccatggaaaataccaaaaatgttctctattatatcttgaggtgaagttttggccgtgtaaaaaattatggttaatgctgtgtatgttatgttttatttgccttcattctgggaccacaaaaacggatctaactatagataggggcaggagagcatttgtgtttcttcattagaagctgtgcatgttagtctaatgtataagaattaggaaaacaatactaaatctcttgatgcaggccatgtcataaatccatttatacttatataatattttcctttttcttattctttcaaccttcatgcttcttttttcatttaaaaaactttggggtcagcccttatattaccagatgatttctagtagttgaagcccttgggaaattcatttgtccatccatgctgcctagtttagtacaacactccaaagggaacttccttctaccaaaggcaatgactgattggacttaaaaaataacttctataaatatgacataatatctggaggccacatttatagctggtcaaatgcactgttagccctacaaaaggctggctcataattatgaggcaataacatgtaaatttccctttctgatgagaaactaaaggtcacataggtcctgagttgtattaagactgcattaatactgttcgttagacatttcttttctcagtctcaacaagtcaccttaaaatctatggtatatagcagatcctgagcacctacatgaaaagcaagtactcaaatgttagagacctgaattgaaatcaagattgagatccatccaacttaggagttactgctggttcaatgagtccagggaagaggccatttaatgattcctccaaggaccattaagagttccagggtattcccttggatatctggaaacctgggttacttgatctgagcatgactaaaaactgggcaaagtcttgcatgcttatcctaggttggacacagatctctaagataagactggtatttggtaagctctcatctttcccattccttcctttagagttcatattcctgatgtattcttgtcacaagatacggtcaaggttacacatgggttaagagctcacagcagtccaataacaaacatgttgctgtaatactggtctcccttgtagaccttgaaagtccaatatgctatcatctagggcagttcatgggaaagttgacataataatgcttcaattattcaatttataaatgggacatttaactgatagagtagggaggacaactgagaaacgtttgaagatgtaaatagtttttgtttcagagaacaaccttatctctccaacacagtaatattttttctttgtgtagccaaatttctctaacacgaggctcacacagaagctatagagacttcacctagaaggtctcaatggccttagagccatatatatatttctactataaaacagcaacaacaattttggcccaaatatcataacctaagcaaaaatacaaacaaaatcaaacaaacgaaaactacctagaatataatcttaaaaagtactgcctatatgccatcaccatgtatactataaaacccaccaaacttagaatgcacaatgatgtcatttacttcaatttttataatactgctttttgaagattcctatttttatacgtaatgggaaacatgacatcatataaatgaggcaggcaaacagaaaggtgtagaaggcaaatgcaagatgcctatatattgtctaccaagtgttgccagttgtgaaaggatttgacatgctaatatccattcattcactaagagcatgatggctggcaggctctgcatttaagtgcggttatcgaggcccccaaatattgacagagtgccagattctaagaaactattgatgtacacagccggccacagctccagacacctctcagacagagtctttaaatgtcacagataaatgaattttcatgaaactgagagagaggaagagcaagaggagagaaagaacacagaatgagaggcaggaaagaaacaagaaagaagaaaatcacttccataacactgacatgaaagcatgtggcatctcatctctaaagctcaatcataactccttacacaggatgtgagatcaagccttctgaatgcattgcattaccaaagcactcaaacacttttaatcatttcattgcatggtattttaaaagttaagggagatacatgttacagaatagcttcaacaaactatttctgagcaaaatacagttcaaatataaatacttcccgactcaatcctaaagcaaattaaaaaaatatatatatatataaaggcccacaggcacagataagcattggagccttctaagcagttctccatatgcataaaaggtgaaaagtcaaggtgtcatgaaatctattttatgccaagacacaaatgtgtcctctgacattttcttctccacagtcctactgaaagtagtgacccctagtgggtttattgcacgatattaagggatgccttcttccttcacctctcttttcctgcctttccacagaaaacatctgccaggaaaatatacgagtcagttacttgacacatgataacaaaagtgagccatggttataactagaacgaccaagtattccttagaaatcatgtgtaactcaatatattttaaacgtaaaggaagcttttttactttgaaagttttccatctgctgagggcagcttctcttgaccttgatacactgtgccattgaaagcagtcacactttcaaggttagaatatggcttgtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccctgtctttaaaggcttttattttgaagacaaaatcagttttaactcaaatggaaattgcagtaaaatctcagacactgtaatcagtgactgcattaaaactctcaagaaggaagccaacttccatgtgaggccacaattcagccaggatcacaaagagacattatccactttgcctgtggccattctgtcattttagactgtaaaatttttatactgtaaaattaaggttcaaggaaatcttctctaactttcacatacatacacataaatatactgatttttgcctgtaaccatataataagcagagaggttttggcttactttagacataggtatagaagacacttaataaagattattaaaatttccttcattatataagtaatagtgttcaccaaatattcagtgattggttaacacaaactgtgttatacaccctacagaaaatactgtaaagttgctaaaaaaaaaaatagacttaaatgtgctatatgacaggatatgacattatatatgctcaatccctcttgtataaagaaaattagtatacatatatacacatatttatgatagataggcatatacacaaacattttcttctggaagtatatgtaagatacttttgatgtatttggggaaaataagatggagaattttacttctaattacatatttttctattctgtttgaattcttcaaacatgtttaaaatataatgccaatagggatatccgagtggtaaggttatgaggaatttttttctcttcatttttttatatactggaaaatttaatatatcatatttcaaaacggaagcatcttcaaaataattatgtaatagtaattcatgttagttacaagaaacttgaaaacactaaaaaagcatgaagtatatcaacaaacagccttgtaattctctgacccaacaataaccactgtcgaatttttgctgcgttgtgtccagtttgcaaagtctcttctgctttgtacagtgtaagtaagaaagatcctttacattcccttaacggggggggacccaaaacagctttatgtgtcatttgttctgctatataccttcttagacaccttcaccaccacaccgtttttagttgccaggacattgttgaaatagcatgctatatgtgacacctccctaaattacacaggttctttattcatctgctattgccccctgaaaaacatgatctctgtgctatttcataatagtacatggcatttcatgatggaagccatggagttgaaggcaacagtggcctcatgctccacaattattatagtatacatactgaaatagtttcgtgaggactcagaaatgttcttctcttctgaatgcacagagatgcttccctgtaaggagctctgtcttagaacttcttcaaagcctaataaagttgaaggaaaaacacagaaaggtgatatacttggtgtgatattttaagcaactgacctattaattataataccttttgatattttctttgctgaggatcattttctgaagaagggtatgaaccttctctttcatgcaaaataccttggtataactgttcatcttttaagtatcttatttgccttttggcaaattaaagaattttcctacctttgttgttgctgttattgaaaagaagataataatgacaataataatttttatagctaactcttattggttgctttctataggttgggcagtttacttacattatttgcatttaattccaaaaatacctctattattattgttgctgttattcccattttatagatgagaaaacccaggcatagaaatgttgaaaaacttgcccaatgtcacaaatctactaagaagtagacgaagaaatctacatcagactcattccaaatcttccttaagattattatctagattagggttacatgactgtactaagaggtccaaaccatgtccagagctttcttatttttctaatactatggggggtgaaggggagtgggaagagaaagagagcgagcgagcacataagattccaaataaaatgttataaaatttatctaagacttcattttcctcacctctaaaatggacagcacccatcacagaggtttatcttgaggaccagttgagataatataagtgaaagcatctagtacaactaaaataaaacaccattattgctctacaagtttccttcctttgcataatggatatgttctggataaggtgattatgaaaaggtataggcttaacttctgttgtcaaatcaaagagcaattacactataaaatctcagagaaggattcccaacagattgagatgaagacctgatgtaaggcaggggttcaggtggaggctgggtctacagatttactgggagcactctgtgggttggtaacacattctagatcctcttacctctctctcctcaggctccttggtctgaaaattcctgagtgtactacagcagtttccagagatgattgctttctttttcttttatctggttacaaagtctagtggaatttatttgcaatgatgatacttcacttgaaggccttatcccacacattatgatataaaatagttagaaattcctttaatgtgagattctcaatcagataaattcactgtgctctatttactctggatgtttggttacaggtttccatcatattattaataatacttgcattaacttcctcatattcattacattgaaaggctctgagttagaaaatatgtattctactttcttggaaaccctacactcactagtgaggcctataaataaaatgaaactttaaatagtacgaacttcaccttcaactcataactaaacccaactctgggcttaaagtgctattttctccctccagtctcatcagatataagtatatcatgttactaactgaggccaagctatatatttacacaattcacttcatactaacaacctgctgcattttgttgcttgccttttcttgaggtactgggacttactcttaaattaatgccttagtttttttttttttctctagggacatccttttacttatggaaaatattcagaaagaatggaatttttaaaataagccatctgctgcgcagacctcaagaaaaacagttatgtttgaaaataccagattcaactaatgaggggcacaaaagccttattaactgtgttagctttcttatctttagagctcaggtaggaagtaagagccgacctcagcatgccaacaggtatcaagtgagagaggtcagcacagtctacacccttatgatatagcttgaacacatcagctcagaagtactcttcataaattctaaaaagagaccttcttccagattatctcgcacatggcagcagcctgggagtccttaagacaaaactctctagttctagaacaattcaaacaaggtgcatttacattatatttaatattttgctgtaagcagacgatagaatctactcaaaactatctctatttcactgtttgcccatattcccatatccgtcctttatttctcagcttatatctttcttgaatttctaaagataagaaatctaatttattcatgtattcattatacaataaatattaagtatctcagaaaagggcaaataaatagatgatagatgattaatagatagctaaatatatagacagataatagataaatagctagataaaacagagatgagttatggcctaaagaaatggctaaggaagaagattgcatattgaggatgttttaaactaggtattgaaggatacttgggatttcaaagtatagagagcaaggagaaatcatttcgagcagaataaactgcatgaacaaaaaggtcatcacacgttgggaaaagcagattatttggtttgtgaaagagagtagtaaaaataaaactgagaaggtaaattagggttagatcacatgagagttcgagtgccaaccaaggaatattactctgtcaataatctaggtttgaggaaagcacagtcaacaactctctagctttcataatttaagtaatgagtattataatccaccaaacctctggtctttaggctccacaggggatacgttagatcagtggtagagaaaaggtcctcatatttaatgagtcctcctccagctgagattatcatgctgcatctattgaagttaatcatctcacatgatttgaacaagaatctcactagttcctaatcacactagcattggcccttcattctcaataacaagttctatagagttacctaaaggctgacactgaggctggctgagatgagagcggtgagtatcccaagcacatgtgagatgtctgtagaaagtttgacataagctgtcatttgattttgaataaagccaaattgttcataagtgattggttacttatatatgtctagttcaggttctccctatgatacagaaagtcattatagtatacgtggaactctgagatctccttacacatcttttaaggctcactcctaactgtttaggattctttgatagaaggtgtttcccagcaccttctgttatgctccctctttattgttctctagtggacttactgacttctgatatgctttgtttttatgtatgtatttgtttactttctgcctctcctctccaaatgttaggtctttgaaaacaaggattatttgaatgtgcctgttttgctcactgttgtatctccagcatgtagaagagatacctattgaaagactgcttttgaaactgaagacaaaatatagaggaaggtaagcacatattaactggtatatgggggaaaaaaggcttctgtataaaactccccccaaaaactcatatgctatataatttgaaaatatcatcagctaattatgtcacggacgaattttctataaaactcaaagcacttttaaattaaaagtatgtattttttcttcctgttactgaagtaacaatctcattctctctattttatacaaagggaaatcatggcagagagagagatactctggagtacagcagatgaattcagagcttctgactctaagggccatctatattctatgcactatttaatgttagtttatattttactaccagtgagatttaagtgctgaattgaatagagtcctagaatttgtaccaataaataatgttattaacttatgctctttctgctagcacatggccttctcacagatataagcaaacaaataaataaagagcaacacagaaagaggaaaggtgaataacttaaaggggtgaacatggttgttcttatttttaaaatccagattgttcattttcgttgtaattgtattgtattctactggcagaaagagatgagatttagtgtactatgcaaattatagtaggtccaccacagcttatcaagttctgagaacagtatggtttctttttcctcagatcctcttttacccttaaaatatcttctggattaaaattctcattcaatgaaccacatctttcaatataaaaaatgaaattataaaagtactaaaagaaaacattagtaaatttctttataatcttggcataagaaaggactttttacctataactcattatctagaagctacatagaaaagattagtaaatctgattatatttacaaacaaacttcagtatggccaaaaaatccataagtaatttttaaaagtgggaaaaacttatgcagctcacatagataaaaggattatcatcttaatgtataaatagcaagaaatacataagagaaagactaacaacccaatagaaagaaaaggctaaggagatgaacagacaccttatggaaaaataaacgctaatgacattaaacatattaaaaaagatggttgacatcacttataattttaaaaatgcaaactaaaactataccgagataccgtcttttaccaatacaattggcaaaaatccaaaagcttaaccaagcactattttatagttgaggcttgggtaaaaaggtacttttatatatgccaatggagctgctaattgatccaactcctgtcgagatcaatttggcaaaacttttcaaaattcaagatgcatataaccctttgatcaataattttatttctgagaatttatcctgcagataaacttgcacatctatgaaatgatttatatataaggttgttcactgtaatattgtttgaaatgaaaaaaattgtttatcaatcgggactgaataaaccatgatgcatttatataatggaatactgcaaaactataaaagagattaaggcagttctctatgtatcaatagcaaaagacctctaagagatactggagaatacaagattgagaacagtgtataaagtggtttaacttttgtgtaagaaggtggaaggagggaatatatattcactttttttgcataaaaagaccactggaaagttacacaaaaaaaataatgaataaaagtggttactaatgggaatagaaagagaaaaaggtggatggggagaagtgaagacgtttttacatagttttgatttttgaaccctggaaatatatagcctgcctcttcaaatatatttaaaatatatgtaaaatatatttaaacaaatatatttaaaaactaaatgaaagataatctcatattaaagtaaaaatgagaacagcatagcaatgataaaaatggttcctgagctccataaatttctcccaacttttagctaccggtgcagccaatatctgggtaaacgtggtaaaaaaaacttggcagtttggtccaaatggcgtctttggagcaaaaaatgattcaggttcttccctttgactttgtagcattcttcagatgttattaaacagttattcctttctaagctcaatcgagttaccagtaaaatataaaatgacattagtgttgcagctgtgaactagttgggatgaatccctttaaaagcctaggatgatttccatgtgttgagtggagaagacctggatgtttgcttgttgctacgtaataagaacaaaacacatttcttgaggaattttaatgtgtaaaattgtttttaaaaataagtaaaatctatttattaattatataatatttatcaatcttctataatacttaggcgatgtactcagtatgcataacattcttaacaggaggcagaatacatcattaggcagatgatgtatgttgagtacttagaagttcctaaaggagaagcctataaagacagtgcattataattaataataaatgtaatagtataatttttttgtaaaataagcaacacatttatccactagtcagaaattatagcttcaattcaataagctgctttctcatgtttgtattgagaatgccatctagaacaatctagaagccacagacaagagcaggggtgaaagctcctaaatttcctatttccgttgtcccatgactttttggtaaaaagataatcagtgaattacccattttgtgtaagaatttcttcctctgggttctgttcttattttaggcaatgattttaaaacatggaggtaggtaagtagggagtattcattcaatcattcatttgtattaattaaacaccaagtatgttctgtgtatttcgctaacattagaaatgcagagacaaaagacataatttttgcccccaaatatttcaatctagtggggagaaaggaaagtaaataaccaactaattataacacagggtgaataacctgctgtaattgacttaagcataaatagctgtgagagaacagaggcgtgggactctgacttttaatgaggaggctcaataacaagttttgaggagtgggtgccttagctgaaacttaaaggatggaagaagttaacaaggcaaagatttgagaggatagaaagggattctaggtataggtaacagaaaaaaaaaagtacagagcaagacagaatatgatccattcatgaactgcaggtggttccagacagaggatagagtgatggttgggaatgccaagaaatgagttttcaggcccatccagattgtgatggaagcactactttagataaggtgataagggaaggcggagatctgaatgaacagaaagagacagccatgaagagcttggtgagaacaacgttcccagcagagaactgtacttattgcacatatatgcctattttaaggaatggttaaagagctaggggaactgattcctggttgtcagagatgagcagcactattccaaatactcttcccctgacaattatctaatctcttttgttgtctctggaagcatggttctttcccatcaatgaattcattcagtccctgtaatcaactctgattagtgttgtttaacatcaatcttttctactttttttcaaagaaagataccaatcagttgctgcacacccctgcttgttaaaagcagcacctctcctgctgacttaccgttcttttaatcaaaagggcaggaggaagcagttgggattcacttttctttttttttctttcaaagtacacaaatgtcaacttccttaaggatgtctggcatagctgagttcagtcatgtaacatacaaagtcagcttgatcaaaaggttgcaggctgcccactgctaaaatggaagagaaaaggaaaccatgggcttccctgaagtgtgaatgagtgcataggccactgccacgtgtgtatttatactgaagacatgctgggctgacaagggagattaggaaacataaatccccaccactacactgctctatcttcacctttgaacctctggagcagcactttctctctttcctatttcttctgttgtgcccagtgaaggagttactatatagctttatagcaactgcaagccatggctatttttgaatatttaaaaaaaacatttttgcggccaggcactgtgcctcactcttgtaatcccagcattttaggaggttgaggcgggtggatcacttgaggtcaggagttcgaggccagccttgctaacatggtgaaactccgtctttactaaaaaaatacaaaaattaactgggcgtggtggtgggcacctgtagtcccagctacttgggaggctgaggcaggagaatagcttgaacccaggaggcacaggttgcagtgagccgagatcacgccactgcactccagcctcagtgacacagtgagactcaatctcaaataaataaataaataaataaatgaataaattcttttgccccaacatttagttgaagtttataattctcaatttgcaatatgaggttataattcacaatatgcaatatgaggttataataatctcaatatgcaatatgaggttataatcatttctatggatttaaaagtgttaataactagaaaaagcataaaactgttcattcattttttttttttttttgagacagagttttgctcttgttgcccaggttggagtgcaatggcatgatctcggctcactgcaacctccgcctcctgggttcaagcgattctcctgcctcaggctcccaaatagctgggattacaggcatgcacccccaacgccgggctaattttgtatttttagtagagacagcgtttctccatgtttgtcaggctggtctcgaactcccgacctcaggtgatccacccgcctcggcctcccaaagtgctgggattacaggtgtgagccatcacgcccagcctcattctcttactcttttaataaatcagtatgtatcatgtgacaaacctgtatctgccaatatgacaaacccttgtcaataattctcctggaagatgcttctggcaacccagaaccagaaaataatttttccaaagagttgattatcttagactaaactaatgactcaagttggttttacaaatagggaacactctgtaaatactcatggacatatctaaacctgaacatacattctcatgaagcacaaaaatcatcatatatggttacagtccccaaacaaggctgcagaagaatttaacattcgtaacaatgtacagctagtataattacattttgtgcaacctcgtaattctttaacagtacaactgaagtgatgagaaggtacatactgatataaggtaacatagctctgtgttctagccaaaactagaactcaggatccattatttttaatctaggaacttttatgtgatgaccatttactaggaagggttgggagtaaaaagcataaggcaattgatatagagaaacaaggatgctttaaaaaaacaaaaacaccagtctaaaagaagactattctttactcacttgaaatggctctgaattcctgggaagagcataggaagaaatgtaactataggatcacttttatatgagtaaattaataaatcatttcccctatgttctctaagaaatcttttagaacaatatttcccaaacttccctaatcataccaattgactagtttcttgtttcagatccaaatgccaaggccccttcgtgaaaatttcttattctctaggtttatggtagactcaggaatgtgcatatttcaagggtgaccctgatgattcttagttcagggatgtttgggaaacactgttctggagaaaactttgtacaatagctaaacatttcttcattcctaatgaatcatcccattttaatgtttctgtggtgtgtcttaagcaggtgcagactctcatagcaaaccataaactcctatgttcctttaaaatagcttaagatacatttactcagttttcaggattagcaaaaagtcaaatagggctgttaactagcccattcccacagaagcaccaacctgtaattcccaagtatcaattctaatgtgttcaaaaataaaagcatatgcttagtcatgtaacagagggtttctttttttacttttatttcattgtctgtcaatctggttgatcagattactaatttctactctactggaagtgatctttagaaaaacaggtctgccatgtttgcattacagagatattaacaataataatgatttttaaaaagtaaaccaaacataaataaacaggaaaagaaaccaccatatttgagtccagtctttgtcctgcctagtgaaacatctgtcttatacctttttgacaggcagaaataagacctttcacatcgcctcatctctctgataaatcagtctatttccttacaaatttggtctgagacaaaactcttctgctcttccacttaccatttagaaaggcacagtcagaaacaccatctaagatgagctcacttctgggtgtctttcagttagacttctattaaatggataacaagaaaactaaccaagaaacaaaaatattcctgtcacttcttttgcaacaattccacaatcttgaggaaaattgaattttgaagaaaagaatggtctatgccatcttacaagcatgagatggaggagcaatgactataaagaatattcgttaattttggttgtactgtagttatattacaaattgcacaattaattcccactatcaaattacactggtaaacaggcctagattaaaaacacaagcctgctctgcttgttttgctctgttatacacaaagtaatcttaaattcagtttattatcattagtatggtttcactttgggggaaaaaaactctttttcctcataaggcatattgcatattgagatgatgaagaccaaagtcaatgctgtagagagttgtagggatataactgctgctaaaataagcacttggtttagtagactatttcccttagacgcttggagcacaataattttttcctgctgggagacaatgtatatcctgaatggggtagggcctgaaagacagtgaaatacagccggaaatacacctgatggcagaatccaccaggatcagacagcatcaggacagcattaaacacagtgtttgaagatagcagaggtatgtggactctcaaggaacactgaaagattacagattgtaggtgagcatggttttgagagtctatctctgctagccacaagaaaattagcagtcaacatttgcaaggtctgtttaattatgtcagtgaccagagctagcctcccaggttaagtgagaacgagaactaacaagctgcccctagcctccttcaggacttaaatgataaagccatggcaatcacagcagcagcagcagcagcaaaagcagcaacagcagcagctgaagcagcaacagcagcagcaagaacatggttttgacccgcagttcttgcccatcaaagagctgtgccctgtctgctcccactgacaggcagataaatacagagatctgttggcaagtacatatttatgtgtatctacagttccctcacacagacttacagagaatgcataacagcttctagtggtataacaaatgcacccactaatggggtgagacccattactcacaaatgggtgaaaagaagcatcaatatgcaggtcttaaccccagtttgtgggcagaaacctgtcattccattgcaggccgataggtctcctattcacacagtccttgtttaattttccaaacaccctttctctaaatggtgctactctgagctgtgtagtgcagacagacaggtttgacaagcagagctgtcaatttcacatttttcatcccaactgcagggcaaaattaggccttgtacgtaactggggttgactggttaggaaggcaggagaggttggcatttaagaggtattttccacattagaaactcagaactcaagatagaaaactcaaaaagggttgtccctattcaacatccatgaaatcaggagagtccaaagatgtgtactggtggtctactgtggggcatatacattttgctgaaacgagaagatgaagggaaaagtaaagcttggtcctatctagaaggagctatgggtaagtaagtagtgaaagacactcactcaaataccataatataaaaatggggcacttgccgtaagagaggaacatagcaacgtgtacacacaattcttggttaaccaagaagttgaatatataagtaatatattagtcaaatttttatccttcaaaaaattttggaattgtccaaagaaaggccaacaggatacatgctaggcaatgatgggtggattaggcatacaacgaaagcaagttaaccagcgctgtttctaacaaccaagtcccagaatatccttgggatctctgggactatctcaagcatataacatgagtctgggatggttttgaaatctctgctagcatatgctctgccctgaggtttctttttggtgctgatttggttgaactgaagaaggaagggagaacacatagaagaagagttctctctattttcaggcggcagtcctatctataccggtggtacagttaagaacctagaatgaatgctcctccagaatcccctgtgcagatcgacactctatggtatatgagatctcacagagtcttgcatatcagaaactcacaaacgggaacacagaagagtctgtgtgtccctgagtttatgctcaagctgtcaaacatcaagagtaatttatgttgttcaggaacatactataacaaagctctcacaggttggaggcttcagtgagcctgagggctcacttcccaacctggacttaccccataaggagcaacggactttgctaacatgaaatcaaaaggcaaaggaaatcaggcatttaggaggtattttacagttacaattacccaatcctaggttggactaggattggggttggtggggaaggagacatggaaagtgctgttaaatgttgtttgaaatgtccctttttgatccccacagtcatgagtgtatttgagtcttgattgctctttacttaaattattgtcattgcccctcagttggcatctctgactaatcccaaccctctcaatctactctgcacactatagccaggttaacttctaaaacatgcctttcattatttttgcttgtctctgtaagtgtttcagttattcagcaaatccttattgcattctaactgtctgatagctattgttctcatcacccacaaaaaataaatctggactctgcctgccttttggaattcacatcctagtcttcaataacatggctctcatttctagtttcactacttcctgtatacaccaactttatttccattggttgatatttttcttcatcctccctacttctctgttttcccatattaaaccattggctaccatctttgcttctttccaaaagaccttttattccattatctttcaacgtccagcttttacatctacagctaaagttctccgtctactattaatcaagccttctatactcctttctaggccaccataatgcagattcttgtagtactcactacctttcgttattgctcatgttggtgcataatggcagattggtaatttccagttagttttaggatctaattactagtctctgcaataagagtataaaaaccataagctctctgtgagcaggtattgtgtttctgatagtaacattattaactgttgtgataactgtgaattaagtttagcatcatacttatttctaaatttaaattgtaccacttctaacaaaattttctccatcgttttattaaaaaaaagtccaaaagaggatgacaataacaggaacacaataaatatatatccacatgtaatggtcagtggtcttttccagtgacaataatgctgcattttgctattagctcctttcttttttacgtgatattcactattagacatactactacactaatgccaacattttccagtaaaaattgacattaattaagctttggatgttgtcagcactagcctagggatagggtaggtttagggccactgagaccaagttcagggtataagatctctgatattcatcaagcagctaagataagaagcataatgaaaggcaaaacaaatggtacaccatatagtatgccgaatatttttaatgctgatttttgtagatagaacttgatatcagcttttactcatttgttattgatatatgtgtattttcttaaaatataataaatatagaaaagggtttgtgaataacataatatgaagatcagaatcaagattagagccaagggcatcagattaaaatgcagatgaataatgaatcacctgtaagattaaagctctaattccaaatggaaagaaagcattggcaaaggcatacaaacatggttctagtgtggtgttcacagttccatgaaggaaaagatgaagcagataggagggtgggcctactgtatggactaggtactggtattaagggttttgtattaggcaagaagacaaaaataattaaaagagtttggactggaagactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggtttttttcctaacaagtattaaccatgatcctatagcataagagtgagtgatgatgaggaggatgataatggtaatgatgataacagcagctgtttattgagtgcttattatatactaggtattggtttaaatattttacatttattagattacttactccccacagtaattttataataaaaacaaatttatggtcccccacctccttctcctcatccttaatttacagataaagaaactgagtcatgagaattagttttcttaaggttacagtgttgtagaatctacgtagtcttcactcttaaccacactgctctactgcctaaattcaggtaaccaacaaaagagttgccctgcctcatcttggagcttatagatgtctacagaatatattgagaaatatatatgagaaatgatttaaggatattcttaccagagcagtagccattctaaaaattatcacaatggtatattatattgtttagacataaaatgagagtattggggtaacatatatcagagatttggctcttacagattttaatttttaattgtactatttaagggaaaaattgagtattgtgaggagcactggaacaatggaaaaggtaatatggaaagtaaaaagtttagtctcagcctggtaagtgtggctgtctatctcttcaagcttcctttcctcaacggggtgacataagggttaataggatgactgtaaaatgcagttaccttatgaagaatgaaaaatcccattattactgagatttttcaaaccctgataattctgctgggattttctgaaccatgataattctgctgggatctggtattaaacagcatgtagacagattaatcccaagcccagaaaagagcaaacaaataaaacataagtagcataatgactgaagaaagttagattgtagtgtccaatctcatagtggccactttttttgtttgtttgtttgtttgtttgtttgttttgagacggagtcttgctcggtcgcccaggctggagtgtgcagtggtgtgatctcagctcactgcaacctccacctccctcccagtttcaagcgattctcctgccttagcctcccgagtagctgggattataggtgtgtgccaccacatccagctaatttttgtatttttagtagagacgaggtttcatcatgttggctaggctggtcttgaactcctgacctcaggtgatctgcctgcctcgcctcccaaagtgcccaaagtgcttgggattacaggcatgagccaccgcgcccagcctgtagtgcccacttttgacaaagttgattgttcatgtgggagcatgaacatgaaaatttaattacaaactaaggagaaacatacttaactttgaatctttcctattggtttcctggagtcaattttaaagtatcacttaataaatactatttgacaatttgcaaatttatataaatgtattttccttagagtataagcattcaactccaatatgatggtttcctattttcagtttgagtaaatatcaaaatagaatgtccctgttagatatctagggaatcacttttaggggacactatataatgccttactaaataccaagactacagtactattattttcacaagtgagcatgggtcaaggcaaagaagggcaagttggggtaaggatgtataggctgttaaccttgctgcacaggtaaatgtaaaagttccttttttctagcctcaacatgctggaagatcctgactttaaactgagtagagaatgtcttaaagcaaagaaacaagaactcctgtactctgaactttgttggggagttctggccccttttatcatttgatcgtcaatgaataatataactgcgtttagcccttaagcctgtatcagctgcaaacgtgacagatacctgtcatattttagaacagcttatcgcctcagcctctggagtgattgagtatttatagacacaaagatagaaacataaagcacatatgtataggcaggagtcccctggaggtggcgattaggactaggcagtaattttagcttgaagttcctatgacttaaatagccacttgagctctgctcttgcagtttacgatgtcaatagaacccctaaatgaaattacagccttctgatacgcagcaggatatcctttctttgccatgcaatgtacacggccaggagaaattgctctgtatatggagtttcactaaagcagaatttatcataaggctgctctgctaaaatatcattatgctgttattcactggataacacatctaatgactcgaggtgcacttgatagccatgtttcagtgaacacagacgcatgccctgatgtgaactgggcactccagtacttcaaagcactatcgatttcaattctaccataatttacacctggcttgttttgccaatagcttgaacccatgctaacactggaacatacacatacaagctttagaaagatcagaaatgaggtgtatagcaaaaatgaatgcagcaaactctccaggattttgcctttataatcatctcccttgatgccgattaaatattttgcacgattttcctagttaagtttgggcattccctctgttagcattatcctttggttggtgatgatggtaataagaacctcttatatttggacaagctatggacacttctgcagcaggatctgggtgccagtcatcttggttctcccactatctagcacaatgactggcacataatagttgctcatgataatctctgcaggctcctcttcctctctccattccagaaatgcactgtatataaaggaccttctcccttttgtcatctttcaatatatttttcctgagaaatgtccactccataattttaactattaccatgatttggatgattcagatgactgccaaagtctgtccctgacatctccagcattcctgactaaatccaactgccagtctggatgctcccctaacacccccaaattaaacaccttcaaaagtaaatttgtaatcttcccccatcctccaaaatctactcttcctcctcatagcttttcttgcttagttgtataaggcagaaacctgggagcaatccaaaattccttctctccatgcccagcccaaaggttattaaattgtgtcaattttgcctatctcttgaacatatctcctcctctctgtctattcccacagttattgtcctagttcagggcttcattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccactgttgaaaatgcttttgcttagatatccacaaaacttgcttcttcactttcattgaggtcttttctcaaatgctgtcccccaatgaagacttccctctctacctctccaccctatttaaaattgcaaacttatccctgacacaaacacacatgtatacactctttctcctctttaaattttctccatagcacttatcataaaatgccacatattttacatatatatatatattttatcttctgtctctcctatctagaaagtaactacaaggagaacaaagatttctgtttttttttttctaaatctactgcagtatccccaacccctggaatagtgttgggtacataatatgaattcctcaataaatatttattaataaatgaatcaatctttagcttcttgaataataactgacacagagtagggattcaaaaatgtttctttcctttttttttttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgtgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattctttgcactttgttcatgatgtacctctgacatttgttatacaattttgcttcctcttgactaggaatgcaattagcaggaggtgcaaggtgctaacactttttattacaatttatgtctttccatattaggtgtttttcataaaaaagatcccctttctttaattttcacaagtggattaggcactcatataattttgcccttcggagtggtttgtacatgactacccaggaggacattgtgttacaaatcctgccagaatgaactggaaggtgagtgcagcattcatagcttaaggatgaacaggttgtttggtgccaggtttgtactaatggagatgttctccattagtgttaactcccaaaggagaataaattcaataacaaaacatttcagtttttggcatttctatggagagttaactttccattgttcaagggttaattatccattatgtgaatcacttttctttctgtggctgcttacatctaggaattcagtttactagagagtgagcagggaaaataaagagacgaaaaggaatattctatatatataaactccaggaaaaaaattggtttaggggacagaatgagatatagtttggggattgctaagttgattgacaattgaaaatgggtaagattaaagcatgttttattatacacaatattttgggttttttttttaaattgtttattagggtcagtttgtagtacatgcagttactctctggatgtgattcttgtcagcacaataccatctagggtgctagaatgggcatttagcaaatggtactttagaggctagctcgacttggtgcccctctcctctgaagaaggcttagtgtgctgcagcttaatgaatgaaacagcactaagtgattccacctatttctctactcattgatgagaaacaactgcagtaggctattttcagctattatttacctcaaacagggcatttaattagtgcttgttaagacagtgcaaatgatttggctgccagtcttcttgcccctgctctttattgtgctgtatgtctgccccgcctctctcctgtctagttcacagggcatccatagccagtcttcatgcctttccataactgacatcagcctgacctccacggatgtggaagtttgaggaaaggaagaacaagtattgacaagctggagggactgttggttaatatgatgcattataggtaagtctggtactttctgactacatgagctgaccaagctggatattcggtcaccctcataagtccaggaaaatgaatggaactactgcaaactgaagatcccatgttccatcagaaattacccaagcattgtggggaaccttagcaatcttagtaaatggttggaaatgctgtcagatagttggaagatctaatgtgggagttaaggaggctcagatatagaagactctgccaatttgtgttctagacatggacatgtttttttcttttcttttctttttttttgagatggagttttgctcttgttgcacaggctggagtgcaatggcacgactttggctcactgcaatctccacctcctaggttctagcgattctcctgcctcagcctcccgagcagctaggattacacgcatgcgccaccatgcccggctaatgttgtatttttagtagagagggggtttcttcatgtttatcaggctggtctcgaactcctgacctcaggtgatccgcccgcctcggcctcccaaagtgctgggattacaggcatgagccactgtgtccggctgtttctttcactatgataagcaagatgtattcactgtcaatgcactgacatgtagatatccattcattcatcacctattcattgatcctccactcagactgagccaatctgacactggttgggagagaaattaacaaacctaaaacacaaaacctgccctctaaccacttgcagtttcatatatagaaaaaacttcaacttaaaagcatatataaatgctaaatgaaggtagatttgtaaaatgctaccagtgtcagatcacttttaatttgggttttatggaaaacttcagagaaaaagtgtgacttgtcaaggatatgatttggctgatcttgaaaagttatcagaaaaattatggttgctgatgctaatatgtaaatacagcatcaaaatatttaacatatagtaaaatagctgagaaactaaaatgggatcatctgtatatgtactcagccttataaaataaaatgaattcattaaacatatgctcaattttaagatatcaattaatttctttctacttaattttaaacttttatatatatagcaattaatattttgaagctgtacataatagaatttaggttgataagctaatatgtatatttgctgaaggataattaccaaacttatcagctaactacatctttctttttgcaaatactgttcataaatatttgtgtaaactttcggtgttgtcagtgtgataaaaagtcagctacatttcatttatggtcattatgaccaaaacatttgactgaaatcaaaggcaagtaagcctggctagaatttggtcatatttttaatagctgaatatagatatatggttgtgcgtatatgtaggcatttataagctaacatacatatacaatcatatgatacaagcaatcaactcctttttaagtttttaaaatatatgtctttcttaggggaatcacataaatactaaaaaccacttctatataaataagaaagaacaatttcttattggggtaacaacaattctgttatttagcaatttgatttgtgtatatctgcgactgcctaattaaatgaatatagcatataggaagtacttacagctaaaatatgcacgcaagaaaatacacatttcacaacatgcatcctcattaatttaatgaaattagaatttccaggtgagcactaggaaattgagttattgacagtgcattgtgaaggcttatgatcaaggtattgaaaaaataagtaatattaatatagccattgaagcacaaaaaatacatcgtcttgcctttgtatcagaggtacactaatcaaattctgacttcttatatatttcaatttagtcatgaaattcttccacgaccacttggaactccaagccttagcaactataagaaaaatctctctggcagattatatttttttaaatgtcatgtcttgggaatactcttaaatatttgttttcacctattctcttcttaaagttgcttatataatttcatatgtagtcattaataacatgttttcaaagtgttagagatctagcttgccttcaacgcagttctaatagacatccctaccagaaactatgagacagttttcctgggagtctgggcagtttgaatattaactgaggaatgttaacctcctatgtaggtcttggtggtaatggcctaagagctagttacattttttataacgtattgtaaacaccatttccctttcaactttttttctttagaaaacaagataactaatgaaaattacccaagaaatattatacatataaatagtatagtcctaacacgagctaactacaataggcaaactttactattaatataacattaaacttttaccatactagccctaataaaactctgagactattttctatcacaatgacagctgatgaatttaatgtgcctcacaaactataggaattgtgataggaagctgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacgtttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgctctgattagtttgtcgagttcacagtgttccagagtgctgaagcacagaaattagggaggggaggtggaaggaaaatcactggagcctcttacgatctaacttccactaactgggaggaaatgtcttataaataaacaacagtaagagaaacaaaaaaaaaaaaaacccatcccgtcctgccagaggaatgtacattattgtctcccgacggaaaactttacaccacaccagaatgcagccatgtctcctgaaactacctccctcaaaacagaaagaaaaagagaatcaaaaaggaaaggagaacaaaacagaacaaaaaagatttcatccccttgaattctgttgggaagttcatgtgagttcccagtagacaaactaaactaagcaatttcaacagtgtcactgttccagaattttgtgcagaggctgcttattagccaaatttcatttctgcccagatcactgctgtaccatccagacattttcagaagggaagttcagggaaggggggaagggtacgactgtggagaagaggaagaagagaggacaaaggaaaactcctgatgaaccagaatgccctagccacggccatgatagagcgagcccccacccaccacccgactactgcttgttgaggacttggtgatgcggtgtgttttatctacttactctttctgctcgggaggctgaggttcctacatttccagctcatgctggactgtaccgtaagcaacaagtgaaatgagttcagtgatctcattctagtccttcgactcctgtccacatcactaagcgactgcacagcttggcacaggccaggatgagtcagcagtctctggtcatgagaggccaggcctggaatagcaggggggtttaggtcaggagcaaaatgaagcagaaaggcagtctagatggcagggctctgttctgcaatacacagaaatactgcaggtcaaaatgaaagcgcctcatcagctctggggtgaagattgtaggactgtaaaaaaagaagcatcaagagaaaaaaaaaagctgcctaccaaacatagcaaggacaaaacagagtaccacagtcagaaaaagagggcactggtagagccctggaggataaaagatgctcattaaggtttctgaaatgtcttttcttccacatgctcccaaacttgaattaagaaatggtgacttcctatatactatcctagtattttggtactgttttcccaattcagtaagtagcaaaacaaataaaatgcaaggcactgcagttaaatagcaagaaaagcctcatatttcataaaataatatgagtctgatatctcaaaggtgtacatttgggttaatagtgtctgtatatagcctgtatgaaatggttaaagaggagtactctttaagttgagcttgggtgggggtagagaagagcttagagaaaagagagttaccagttaatgataaaacataggggaactatgacactgtgaccatatttctactcaatggggccaacatagacctccattagacctccatcaagaagtgatgctcccactaacaggacttcaaacacttctccctctgcagtagtactgtaatatagcaaggggagagggaaaataaaatagatagaaaaacaaggttcaacataaaaaaaattagtgatagacattttgtttcagaggaggcaaattgctctataagtcaactgataaaaaaaagtcttggtatctgaacagacttagagaaaccatatctagatgaagatgccaggtggagactgataactatcaggaaatggtagtaatggccataaagaaggaagaaagcaatctcaagtcacatgatgtagaataaaacagcatggaaaacagaaggagagcaacagacttcgggaacacgagtaaaatatttctttaaagtccttttaagaggagtaatgaggacccaccacatattcctaaatgttgtccctcagagatgcacagatgtatatgggtaaggaaatgtaaaataaactttcagctttcatttcagagggtattaagtcatctgaacacatatttactaactgtttaatcttgggcaaatgagctttctagcctcagtttctctctctttgaaatggaaataatattatcatcctcatggaatcattgtaagcactgaatcaatgttcattaacccttatctcagcagtacctgtcacatggtgaacattcagtaaattgcttattattcatattatttgattatcatatcatatcatctttataagtatccagtgaaagaatccccctccagtgttgttccactggattgagaggaatcaatatgaagactctagtaaaatcagttgagtaacactgcttacactgctgctttaaaaagattatttctgtctgggtatgttaaacattatacttgaagacacaggatgttgaaaatctattatgtgaaatccttgaatttgggtatctatgttgtcaaagcaacttggagcctaacagttgtccagtaactagaggcccaaaaaagaaaagaggaatttttagaagcttctccaaaagcaacaggataaaagtgttattggccttaaccgcatgatgagggctttttaccaaaggggaaaacgtagtccagttgatcatcgcagcctaattgattaattgtgggtctgaccatctggctgatgaatgctgacacccagcagtgattactgtgtaacacaattccggatgtgctctccctgatgcctcccacaataatggcaactctgaacttaaggttagtttattcaggcctcttggctcaatctcttcatggaatagtggttgtggcagggaatattttactagacctggtcaagcattatcttctcttatttcagttacccactcttttccaactctactcctacccactcctaagccctctcttgtatataatcacttttcatgcaaagcattccatctgtagttttcatcatattatctgattctctcatttctggttgctctgttctgaaaaatatttgactaaactaggagatctatactgctagaatgccatttcacaggggatcctattgggacatgtttattgtatcttatttgctactggtttacttcaaattactctgcgcttccaaataaagaaaattattttacctaattcattagcctgattaaaagtcccacatatggcccaagttttccatgagattatcagaatacaagggttaatagacgataattcttacatcttaagcctacttctgaccctcagttaggagtatcccatgaagaagattcccctggagcatactttactgttagagaaggaaagtcagacccatgtaaatgacaaggttcaatagcaatgccatccacaaaccaatctacacctggagatgacttgtacatggagaattcaccaagcaaataaaacctgtacatataaatataaaccctggggaattataacaaaataattccattgtattttgtaggaatgcacaggggagtaactgacacaaaatatcttatacaaccttgaccaacaagtcacaatgacaaatcatccgtttcctcttttcttttcccagattgatttccagctctaaattcatcttttctttcactccccacagatgctgaattcttctatgttccaggctgagttagtgttaattttcagtagaggacggcagtagcatgctgaactgtagagttccgggctgggagttgggaaatgtttttggcctgactgtcagtaaacaactatgtgtcttgggcaagtcaagtcccttaactccccatgtctcagtctcttcattgaaaaatgatagggtaggactgcataaactccatagtctctgccaacactaagattctatggttctatagctcatttccttttttttctccctttggcatcaactgctcaacaactccgctcatagtaatctctatgctctcagttactaatggaaaaatatgtccttcatttactagttggtattttgtatttgtaatctctctctttttttatttgatgctagatattttgagtcataaacaccaacatatccaaatagatgctttaaatttgaaggcgtttaaggaaaatagctttcccatgtagaatatttagtgtagcagggcatggaggaagccagccatccaaaagtggagcaaaggggccaattcacaaatgagagaaagcctttcataataagagtctccacactctttaacttagataaagctaaaatgctaccaacttctaactacttttccaatcaatcccagacaccatcacagacacttaggactacaaatctgaggaccagcactggcagcaatgcagttcttatttcacctccaccacccattgccaagcaggatttaggatggcatactaataagagccaagaggacgatctgtcatttattttcctccaaactttttgaaatttcccatttgggctctgtttcccagttttaatttggtaactgccatttttcagcatttcttttaacaggttactaataatttctgatacaggatctcatatttcattttatgctgctagagctgctgttaatatttcatctgccttcaattcagctctgaataaaggctgctaggttttgatagactgttaacactttggttctggggatttgatcactatgttcatccagtttgtccatattttgttaaaaaaaaagtaataggttagctatctcagaaatatctcagggtgtgctatacattctagggatacttcagagtttctttttctggatctttgatgaaaaccaacaaaaacaagtatcctgggtttgttttcacaaatgacttgccatttgcttcagtgtcagtattctggaagcagtgggcagtggttaagattcagggctcataggcagatctagattcaaattttggctctgaaatttattatatatatcacctcaggccagttccttaaccttgccaagtctttcttttcccatttgtaaaatagggatgataataatatccacttctattaattaatatgaggatccaataaattaatataaagtgctgaggattttctcagttctcaataaatgatggctatcattatcctagcattaataatctacaaattcacattatagaattattattttgcaacatcttttcagggtcaacaaattattttttagtacagcctttgttgtttgcttcactatagcttacatttttaaaaagtctcagtaaaatcatgtaaaatatttaaaaatttgatatttaaactgtatgtacagttagactaatatatagcaccatattattattattgtagcacttttcagtgcagcagcaaattctcaaaagtttttgtccatctaatagccagccctagataaggcacattgtaccaatactaatctgttctataaaaagatgacttatcatatttatcttctcctactcccaaagaatatagattattttaatattctttgggtatgtgtcagtcaggccctgtttggatacagagaccatatagcaatttgaatagaaagttagtttaaattattaataataacgggattaaagtaataagagtagctagtaagaagtaaagaatactttaaagaatataagaataacatgggccaggcgcaggggctcatgcctgtaatcccagcacttagggccgaggtgggtcttcagcctaggagctgaagactagtttgggcaaaatggtgaaatgccgtttctacaaaatattagtcgagcatgatggtgtgtgcctgcagtcccagctacttgtggggctgaggtgagaggatcgcttgattccaggaggttgaggctgcagtgagctgtgttcatgccactgcattcaaccctgggtgacaaagcgagaccttgtcttaaaaaataaaaaagaatagaagaataacaaatgtaaggaacagccattatttgcagggctaagatagcatatccaaggaagagtctcctccatccctggactgagatctagacattgtaggactcaagacaaaaatctcctggacccctggaccaggatccagaccttgttggacaacacacagccataactcattggatggcagagaagttgctggggagctgcatcagtagcacctgcactctagggtgctaatgaaagctatttacagggatgtatctcatctgaggcactctgctataaattgcccaatgtgtgtgtacacatgtgtgtgtacgtgtgtgtgtatggtgggtgctaggggtagctgctacctgccacgtactggagaagctacctgtgcttcagctgctgggtaccaggttagctgcatttgctgcaggagctacatgctgtaaaggttgcttatgttgtagaagccaggctctggagaaaccgtgcacattgcaggaggctgccaaagtagtgcatgacaaccaggaaggaaaatttcttctttctgcaacgtctccctaccttctctactgacaaagcaccctcaaaccagctagcaaagaaaaaatatttaaagaatccagatacatttttgcagagcaggcaaggagaactacatttggaaggaggcaatgggaggtaatacattggtaactggcacagatattattatttgctcacacacttcatgaaataactcacattagagattataatccagtattttcaactgattgcactactgttcacatttactaataaaccaactccctttgcatagttaagcaaatactgtcagaattaagaaaaataagaggccagtagataaatacctataatagaatattttaaagtgacagtactagtatatgtacataaccttttcccccaagtgctgcccacatacattttaattacatgtttataatttacttaagaaaaaaatatacagaagtactaagctattgacctaaatgtatgcatcagtgatctcacaccagaatctcaactaagtgggtattcagaagagtcattacaaacaaccaaaagctttgagagaggtaaaaattgcctcgattatcatttttcctttctctttccttttctttttaattaactctagaactcatatttgcttcttctatgacatttttgtggaggggtggggtggctcttaaataggttattcttttttttttttttttttttttttttttgagatggcgtcttgctctgttgcccaggctggagtgcagtggtgcaatcttggctcactgcaacctctgccttccgggttcaagcaattctcctgcctcagcctcttgagtagctgggattacagacatgtgccaccacacccagctaatttttgtatttttagtagagacagggtttcaccatattggtcaggctggtcttgaactcctgacctcgtgatccgcctgcctcggcctcccaaagtgctgggattacaggcatgagccacgtgcccagcaaaatataggttactgtttttcagaaaaatacatatttagaaattttttcttatgattctggtcctatattgttctactcttaatattaaatagagaagcatcaataaatgaccaatttggtaaactatgatactgtgatcattgttagaactagttttacatatggggagagagtatattccaaaatacctcccctacttttgcctaattcccttaagaagggaacaggtgcttttgctgtataattacaggtagagtttaaaaccacaaacacctgacattagcaaggagcgtggttgtgagaggctgagagcagaaaagctaattgggtgaggagagtcctgtagagagtagactatactgaggtcaggaccacagaacatctttctcaccattcatccgtttttacctatgtctggccatcagcactatctgttctcactattatggaaggggtctacttgttacctcacagttgtgttttcttaaagccagtggtatccagcaaagcaagccatgttgggttgtctcacaatcacactgtaggcatctctgccagctgcaggtggttatccttatgatttccttttgtttgtgctatgcgtgagtactgaggataaatttaatgaccctatgtttagttctctcctccaacacacatgcacacccccctctcccctgcaattcctgagttcaaaaagagatgaagacaaaggaatgtcataagtccgtgtgattcaggcaggcaagtccattttattttagtttgcccttctgttctgctggcttttctgctatgacccactatacttaacctgtcggctgttcttagtagcaacatgcctttttaatcagccttcctggggtctgcatttgattacagcatttgtgttctattttgattcttttgtactgtgccctgtggtgttcgcttgaaaggtgttatttataaaatgaaattctattgtattgccacttggattcaaagaggacatataatattaatgcagaatgtatttaataatatcttcaatctattaaatcaatttcttcatgagaatacagaatggaagggaggcacatgggctgataatcaggtaataagacttaagaatcacctgaacttttccttcacaagctttcctgaaagctggcacaagaatcattctcttaatgtcagggtttccaagtggaggagactacctttcttcagccagaccagtgcagtgcgcacctgtttaaacattcaactgtgcaggccaaacattttcctaggcttttagatgcaaattttttgactaaggaaactatgagaccaaacatgaatatgacttttttactacatagaaagaattaggttatgaaggaaatgtaatcacctatttctaaggatctactttcaagatttgtaaaaagaagtatatttgttctcacactgactcttctcaaaagcaggataggaaaattctagtgataccaagaactgatgcaaagtttccaaggtggcatgttcagaatgatgttctcacctagcaaaagggcaggtttcattgtgggctgctgggcctacagtcaaatgtttctagattagattgatggaggagtccccaagttttttcaacttctaattttaattccagctaaagactgaaacattgtacactgtatcacagcttgcacagcacatttcttgctgcatacattctattctttcactacaatttttttttcctgttgatctatctgaaatcatcaatggctatgctgctgtttggatagggaataagaaagaatttggtttgaaagatgatttaggaatcaggctctgcagaacttactaaaagaaactgtaacatacaaaggaacctggctgggcagtcttgaaatgagagttcctggatttttacctgttctcattcagtggcatattatataactccagaaaaatcagggtccagttttctaatcactaaaaggggaataactgtccttttctacttgcactgggctactttagggatggataagaaaatgattccagaatcttgtaaatgctttgcaatgaagaggaaatacaaatgcacaatattattaaaatgatagtttaggccacatttttgtttctccaaatctagagatgaaaaatagtaacaaaggaataaatttcttccacttcaaaaataaataatatacccttatttataaatgacatgtcaaacataaggaactaggatgtgttggggaatacacatctcagttttgaaggcatcaaattataagctatttgcatgaaggaatcacattcatctctgtatccacccaagttctacctcattgatttacattatgtaagtattccattcgttaacatatgttgaattgaaatgacaaatgagatcgcacaattttagagctcgaattaactagagaccatgttaaatcctgttgcctcattttgcagatgatacaactgaggcccagataagtaacttaactaagtccaatactaaaaatattacaagttttagaagagttattttaaagatctgccactgaaaatatatcactgaattaaaacaaaatagacattcttctgtcaaaataagaagcactattcagctcaaataatccgatgtatcctaacctaatcaagaaggctgaagcctaaagtaacaagtaaacataattaaatagctatagacccataggcatgttagaaatgccaagttactgaggggtgcatatcttaatactttgtctatcagccagtccaaatggcatatttttttcaagtaaaattaatgtcttaacaaataataggggtgaagtcagcaagatggcagagtggaaaactctacctctcattcttccacagaaatactgataaaacaatgttggaaccaaaataccttgcaaatatattcagattgtagctaagaaatagaggcaccctagaggatcccaaactaaaagcagttgcatttgcatgggtaaaaagtgcaatttcatgttagaatgtcatatcagtacttcccccagactggcttagctcaacactgagaggactgcttcagctcatgatttctcctgtgccacagaaagtgagattggagtgtgtatctggcttcctggcctctggcctctcagagaaccctctgttgggtcagttcctatattgcctcatactgtgtactgacgcacctgtagaacttcgttcccagggatgcgtaggagcaaagaaatgaggagggcaactccttacagttagagctgccttgcaagattaggaatggggcagaactgaggttattcttagatgagggaggaaagggaatgaagggggccttattctcagcatttcagagttccctctgtgaagccagtttccatttcaccttgtactgagccttgtgcgaccattagaacttggttctgagggatagttagcaaaaactaaaaggagcaggcatccctttgcagctggcactgctctgtataataagaaaaaaacatagaaccgagccttttccttgagaaggcaaggaaagaagtgtaaagggccttgcccccagtcttagattgtgctccccaaggtgtatgtctctatcttgtctcatattaagcaccatgaactggtaaaggtctctactcatcaaaactcatctgtagagactgggaaaggtagctgctacttcaaatatacagatcacaaagaaaatctacaaggaacacaaagagtcatctccaataaccatcctgaaagaaacagagatccctgaattaactgacaaagaatgcaaaataaatgtcttaaagaagcccagtgagttacaagagaacactgagagatagctaaataaaattaggaaaaagatacaagaacaaaatgagaagttaaataaagagatagagactattaaaaagaacccaatagaattactgaagctggagaatacaaaaattgaactgaaagattcactagaggagttcaaaagcagacctaatcaagcagaagaaagaaacagtgaacataaagacagatcatttgaaattatgtagtcaggagcacaaagaaaaaacaaggatgaaaagtgaggaaagcctaagtgacttatgggactcaaacaagtgaatcaataaacacattagggaattctggggagaagagagggaaaggggtagaaagcctatttaaagaaataatggtaaggaacttcccaaatcaggggagagaaatcaacatccagattcatgaagtccaaagagctccaaagatctacaccaagacccattataatccaattgtcaaaagtcaaagacagaattttgagagaaacaagagcgaagcaactcatcacattcaaaggagtccccataagactgtcagcaaatttctcagcagaatcctcacaggcaaagagagagtaagatgacatattcaaagtactgaagatcaaaaaacaacaacaacctgtcaaccaagaacgctatactcagaaaagccatccttcaataataaagaagaggtaaagactttcctagacaaacatgcagaggggtgttcaccatcactgtacctgctttgcatgaaatgctacagaaagttctttaagctgaaatgaaaggatgttgattagcagcatgaaaagatgaaagtataaaacttgccaataaagtcaagtatatagtcaaatactagagacctctagtactctaatgatagtgtgtaaatcactttcaactctggtataaacattaaaagacaaaactataaaagtaatgacatgatttgttaatggatacacagtataaaaagacgtaaattgtgacaccaataacatgaagtgtgtatataggagaagtaaaagagtagagattttgtatgtgatcaaatttaagttgctatcagcttaaaatagatgattataagttgttttatggaagcctcatggtaaatacaagaaaaacacctgtagtagatatataaaacataaagagaaaggaatcaaagcatattgctacaaaagataatcaaatcacaaaaaaagacagcaacagagggacaaaggaactacaaaacaaccagacaataatttaaaaatggcagtaataagttctcacctattaataattaagtgtaaatggattagcttccccaatcaaaagatacaaactggctgaagagattaagaggaagactatccatatgctgttaaaacagcaacaacaacaacaacaaaaaacaacaacaacacactttagctttagggacaaacatagactcaaagtaaaaggtgggaaaaatatattccaagcaaacgataaccaaaagctagtaagagtggctattcttatatcatacaaaatagactttcagccaaaaattgtcacaagagacagagagaaggtcattatataacaagaaagtgattaattcattaaaatgatataataatccccttgattaggatccttttgattggaatcctcttgactggagtagaacaaaaactgaataattgtaaactattattatgaagtagagatctccaatacactactttttatttttccaaagctttcctggagatcacagagaactgaacatggagaaaaagtgagcaagagacagcagtaggctttatgccttaaatggctgtatagcttgttaaagattattgtttgtgtattaaaaaaacatgattctagaaacataattggggtttcacagatcaaattcaaattattaacttagtatttcagcctccattacttgctctatcttgcttaggcatcctaggttccagtacttcccaacaagtgttctgtggtgtatgcagactatgttagtgtttccctttattttggtatttccacaggagacctaattttaaattttctgttctatcatctccatgatttcttaaattatgtctagacttctggattagaatattattcatgtacttactatgattcaataaacatcttctatgtgtgagacagtaggaataagatacaaataagacttatttcctatcttcaaagaataaaggaattcacaatacagtggccacttaaatatataacatgtgttcctgcttttaagcttttattctttctataattagagtatcctatcattattttattgattgaattcctttaattatcttatagtccagcttatgttctgcttcttccataaattaatttttactttttatagcccacactgtttccttttccccccactattacagtggaagtggacactattccctaaccaaacttcattccctcattcttcctagccgcagacctctattttgtgcagagtgtcaatgtgctcagtgctggatgatgagttttgaaatttataagccaattatgacaagtgtattctctaatttgcttgcttctctagcaaagaagggtggcctagggattcagttatagccaataagatctatgtggcaatccacttgagaggcaagtttctgagaaagctttttttttccgttacaaagaggaaggtaaaaggcaatccttctgtttcctcctccttccctctttgaacatagacatgatgcttggagttgtggcagctattttgtgatcataaagtgacaagcatgaaagaaagacaaaaagaatcccagagatatcagcacagactttatcatataccaggaatttcctacctctcaacttctggacttcctgttaggtgagaaaactgaatctctatttgtttaagccacttaagtcaggatttgctacctgctgctgaacacatttctaaccaaagtaataatagtaacattcataatttgaattcaccaaactgttcttcctaactagataacagacattggtcacattcttggcacttcataaacattcatttgcttcacatcttgattaaatatgctagacttttatatgtaatgaaattctcacacagaaaggaaggggggaatttggattagtatcagaaaagaggatgaaaccaggtcaaaaaaggaaaatttgattctataataaaaaattatatgacaaaaatttgttacaatgtagctcaattattatatacaataaaagcaaatttttaaatattttccaaaattaatagcaacatattttaagaaataagacagtagaataagcccccaaatgataaatgttttaaaggagagatgatataaacaagtcttctattaaatgtgaagacaataccatgcagttctactgaaacctaagtgaggaaccagcgtttgtcaaataccaccagcaataagactttttctctgtcctttaggttgtatgactgtgattcaccccaatgctacaggctccttagcatgctcattatttctaaaatctttcacctgaggtttgaacccatgacttaggaaactattatcgcatttgcttttggagaaaagactacataagttgggacagaagctattttcaaggcttccaaatattacaagtaagtagtggggaactgttgagaagagaaatgagtagctttgggtcattttaggttagtgaccttaaacataaggtgtgatttaatcagaagccagagtaattatggcaggaggtggggaaaaagactcagagctgtctggagttagggaggactttggtggcagctttcagcttgagctaaaactgcaggattctgtcagaggctccacaaacaaagggctgcattatgtaaggaatcttgtatttctttgtgaactagtccacaacaaaatttcattagtttttttttttttctctcctagagatttttttttaccacttccagcccgtaacttgttgctcagaagggaaactttctaccttaaataaaagtttaaattgtaagcaaactgacatttttttaggaacaaatcaaattaatttgaactttataataactgggaaaatgctttttaagttaggtggatgataagtaatcttatatgaagaatttccaaataatttagcaatagttggcaataatttagcaatagttagcaatacgagttcatatctctctccctctctgtctctatcattttctgatagtctgtttacacatgtaacacttttgggtcacctttcaatggagcatttcataggcagaattggaagatagcaagacacatggatggcacatagcaataggttctcataaatattatctgttttcaaaagaatatttatttttttgcccattataaagatattctaagattaattacagtcctaatactgtcaaatttagctttgatatacaaaaatctattttttagtagtttaatttttttttatcaattactaacttgaggctttcattttacaacattattttggtcagttataaaaataatttaactgccaaatgggttttcccatttgacatttcaaatgttggtttaatacttatcacttagacctctatgaaggttgactcaggtttactgggggatattgcatagatcatgtcttttggtccaacagtttgggctgtgaatagtctaaatttgcatggaagctcccaactaccaagctatccaaaaactacagggacagggcggggtgaatgattctcagcaggtggcactcttccttctaattaggtcttgaatgaatgcaccagcattctgctatctcttgggtggagtgtgagactgaatcattcaataatgcttatagcgcttaagaaccaaattcaagggaactgtggaatgaaggcaagttataggtaacatacaaggattttcattctgctggactttttcattcaaaacagcatcattctcagactcagaattatggataaccatgcctctcagtctactcaggagagtttccagtttcagttccaatggcccagtcacaattattagtagtgttcattttcactttcaaaagtgtcctagtttggatgataaaatatggggttaccctgtatataagctttaaaaaagttagtcataacaccatttacagtgataatcattctatttaggacaaattaaagtagactctattggccaacttctataaagagaaagagataaactaaaacattattaatttaatctcagagctttaatcagaaaaagtttattttaagatgacaacaaaatttctatgaattatttaggatttctaattttaggtcatttttttttagccttattttatacaagcaagcacgtatgcccttaagatttgtggtggagaaagaagtacaatatctgaaataaagttctttgaagcttaggtttgaattctaattctactatttactcggtgtgcaaatttaaataatttctgtgaacattattattaaccctttctaaaatatgtttaaaaacattttaaaaaccagaagggaaagaactacatatgctgtgaaaagctgtaagttattaacagttactattatttctctttataaataatgatagtttttccctttcaacttctatgacacttttacagactgtagaaaaatttggccaagcatgttgtagcaagggtccttaactgtaatcacctttgacacagatccatgatatttctgggtgacatctctacatggacattgatggcctgcaaagatctagaaaagaaagactatagatcttgtacaccaaggccaaagactaaaaggctgaaatttaaagtacaaaagtattgtgaacagttttgttagtagtataatatataccacttatatagataatttttcttatatagatataagaataatttttcttatatagatataaaatagggtttcttatatagataatttttccatggaaggaaggggaaacgaggcgaaaagtggctggagtagaaagactagtttgtaaggcagaaagattttctaattactaggtagattttattttattttacttgtttttactagctaaattttaaaaaagagattcctagatctctatagacatgttcctctttctttttgctgatattttcctatttcttttctgaaatcttaatttgactagaaaaaaaatgatgttctgatttaattctcttagtctacctgacatcaaaaagtatatggagggtgtctttagttttttatttatatgaatgtaatcaaataattttattttttaaaaaaagactctcactgtttttcattgtttaacagacatttctttaaaactttgaagtaattatagaaaatgttctcataaattttccctccaaattaaccaggtagaaagggctaatcctgttatgcatgccatttttgtttgtttaaattgactattctgagaattaagtctgtagtacctagtttgaggcctcaagattttcaggtatgcacaaggttctatcaactaattctttgtctcactgatgatcctttattttaaatatactctacttgcaaaggtggtagggtaaaaagaggagtggctgacaagagactaaagaggggaaaggattcccaacatccttaatatctcagggctgaaaaagagcattagaaatcttctccaatctcttggagaaaaaatatctttcacacactctgtctattagaacttcatttgtgtttaacaagcccctcttttaaaatgcaaatttgccttgtgaacctgtaaacctcattcacaccttattgttaattactttgatgttctagaatatgatcaacacttaactgatattggcaatctaggaatgaacaaattgctcagggtgaaaaaaggaaaattttgttggagtggggctgtaggtggtagtgtgagaatttcatttgtgagaaatagagcatactgatattctgaagttttgtctaggagaatggcagtagttacggtaccacaaaacgagcacttttcccgactgccgatgtctagttgagatcagaaaaagcctggaagcctgcaaacctaagttttaaatatttagccatagcaagctaatcaagcttgcaattttctgaaaacgttttaagttaattcataatagctctacaactcggtgaccttgggttctaagactcatttggttcaaccttccaggtttaaaattcaaccaataaatgaattccaaggaaaaaaagtgaatatggcccagtccttttttactgtctccctagtcattcacttcagagattttggaatgcaatcctagaacatactgtaagcaatttcagaagaatacacaggatgcagtatttctctatgtgtcttagtaaatgtcacttgacccgatatatcaaaaaggttgcaaaatttgaattagactttagttgacttaagctacacatcttagcttggcagaaattcaaggaaaaaaatattttatggcctcttgtaacattattaatcacccctccttttatataaaaaataaatatgctaaactcttcactgttcagaaaaggggtcatttttcctgccaaaatggctaattttagtttttatgtagttggatacatttgtaaactattacatgaaaacatatggttggaacatgcttactccttcatgagtgttccccttttgaggctgcaaaattttccttagttgctccatgtgctactttgttgtgctgatgacttcttgttctaaataattttcttcattttccattgttaatgaaatgagttctaataaggaacaaagaaaccctctgatgaaaatccctttcttgtagaatggactgggaactgatataggacacaggggaacagcaaatgctgtgttgcacattcttcaattaaatgatccctttgtagtttattcacctgaatgcattttggcaaagagtgaagcaatagtgggaaaaggattgtttgtgtggctaatctttggttactcagaaagtactagacatgttttcctgcatgtttgattgatttcctgcacagtttgattggtgaatcaacactttaaggtatctaacccataaggaagagtgaaaaacttccccagaggtattgaaatttcactaaacctcttcttggagttttggtgtatgattctcagttgatctttgagtgtaacagtcaactattaaattggcatgactgaagtacagttttttcaaatagaagagtattttagaacaaatgagaattctaactctttaactgaatttctaactttacattttgcccgtacctctccttgtaacattcttccctttttccctatatatttttaccagtaatcctttcaactgctccttaacagtgagattctactgttctggcacattataggttctctttaactattttttgagtgcacaaatgaccatttggacaaatattataaaatgaacaataaaaaaccttaattatgcaaattaataagtctatacctttgggaaaaaagccatgatagtaacaaaatgaataacaattccaaggatatttaggaaggataaagcctagaagattaaaaatgagaaattttagaatcataaaaaacaaaacgaaataaaatagctcaataccattgaaagcacatgtatgcagaaagaagctaatatattattgtaaaaaattaaatggaaagaaattagaaatctattggtattattacatcaaaagcaggaagttctttctttctggtccaactttagagagaagaacaaatttgccagtgccaccaagggcagaatagagagagatgtttggaatttaagagttacaggttatgttatggttcatttatatcattgccatcactgcagttcattcattttgtgtctaattattgatgttgccacggttgtcaataaacgctcagcattactaatcatcagagaaacgcaagtcaaaaccacaatgaaataccatcttataccagtcagaatggctgttgttaaaaaatcaaagaacaacaggtgctgcatgattgtggaggagagggaatgcttacacattgttggtgggaatgtaaactagtcctacctattaggtactgtgctcattaccataggaattagggtgggattcctattccaaacctcagcatcacacaatattcctatggactaaatctgcatatgcaccctctgtatctaaaataaaagttgaaattttaataaagatggaactaatccctcatatcacagaattatgtagttgtgggtagtcaggataaagaatatttaggatataatttaaatgaattcactagctctgaaaatgaaagaataaacagaaaactaatctagacattaaatttttttctttccctaaggataatgtatagtccctaaggataatgaatattcaaggacatactgtaataaatcatatacatttattattaatataatatagtttattgcacacacacactatgagctccacgatgttcgttgaactattacaaagtttaaagacatacgaaattacagtaagagccatccatataaaaataaaatgttagtgtttggaaggaccaattgtaggagactatattggcgagttaatacaaaagatcatcttttgtttaagagttcatatatttttgtgtaaattatatctatttacagaaattttctttactaccaactgttctcaaacccattcactaataaataattactatatgtgattacttaatatttacctcaaacctttatgaatatcactgaaagcattactggcaaattaattatataggcaaatggtgaggatctctcaacctcacctctcaccttcttcccaatcactcgaagactgactatatcaatttgtcttgttatccagaaattggctttatttgttaattccagagatgcttcaactgtagtttcagccagctgtttccttacatctttctgggtggcatcagtttacaatgcatagcattgttgagggtcaaagttattttattttggtattactattggatttttcccccagtgcctcaaaggggaatgttgagtcatggagatgtaatgtgactccttaaactaagtagacttctaatacaagtatacttttattatggagaaaccaaattaattttatcaattaaatgagaatttatttaccatttgcctttaccagatatttcattagacacaattctcagactttacacaattacaaagaatgttgtataaaaactatctataaagcaggagatatttcattcttagttttttgccaaacaaattatgttgcttcgaggaacagagggaaaagaaacattgatgaaacacagccctcaactatggcataaagtccaaagcacagagaaggtcagaaaagaataaagcagttttgcagaattattatgatagggagtactgataaagaagagtcaactttttggccttagtcatttactgagttcctttattaaaaatagagcataaacattttagaaataattttttctcaatctttttttataaaacctctacagaaaaaagaagcgttatgtgaaaagcagctaaatgggaggaaagtaggggtctgtgggtgaaacaggaggttaccattgcaaaccctgtccttgatgccctcactcagtaggactggtggatggaagaagtttgaaaaacttttatgtagagatgaagaaaagtagaagccctagtttacagagaacgaaagatacatttttcttctgtgtaggtagagtttgtatttggagaaggaggagactcctttcttctgatgaaaactccttcttccaagagaaaactccattaggaaaaatggagcagcagtgagtgagagagaccaggtttaagatttgttttggaggttaaatttgttgtggaagttgacagaatgtggtgaaagcaagacacatcataaaataagccaaaaaaaatctctctcttccagctcattgtatattggagagttagttgacttttctactgtaaatgtaaagaaaacaaaagtttcattcatcctcctgtaatgatgccaatctaatttgctattaaatttctattcaaaagccctattttgtttagttacaagggatttgatccccttaaactttcccaggcaatttgtatggaaaggcggttgctaagggtattcctaagggaactggcaaacgttggaagataaataacctcagtacaatatgcagattaagtagaagggatggtttaagagttaccttttgaaggaaaaataaaagattcagaattcagggctagagttgctagttaatcactgatttgaaggtacttaatcaaggcagttttattttattttattttatttatttatttttttttagacagagtcttgctctgttgcccaggctggagtgcagtggcgcgatcttggctaactgcaagctctgcctcccgggttcatgccattctcctgcctcagcctcccgagtagctgggaccacaggcacctgccaccacgcccagctaattttttgtatttttagtagagactggctttcatcgtgttaaccaggatggtctcgatctcctgaccttgtaatccacccgccttggcctcccaaaatgctgggattacaggcgtgagccaccaagcccggccaaggcagttttatacttctcaagaaagtagaactttcacattgttcctcttgggaataaaggtaaaattatcatagagaggaaattagagagaaatgttcaccatttccttccttatattcttcctttctttcctctctctatctctagagctcttcctcaaagattcaaataaccaaaaatatgaagccatgggtggcagcttggagttctcaaaagtccaaagtgaggttagcttctgaccaaaacttttggcaatttccttaggttgagtgaaagaagcaatgtgaaaaagcatgagtttagagtcagtcagccatcaatttaaaatcaaactccactatttattattggtgtgatcttgaatacattagccaacctctttatagtccagtcatttctaaagaggtgattatctatgaaacctgtattacatatacaatgtgtaagtactcagtaaatactcagtacttctctagtatctctctaattggatttggctagtaatcatgacaattgtgggagagaaaaaaaaagatatgtaatcctgagggcactcagtctctgtaacaatcacttgataaataatcaggtgatacttcgttgacatctctttaatcttccaattgagaaaacattaggagtagaagaaaaatgattaatctccaacttctgtcattggaaaataactaaagatcagaactataagaaacataaaacttttctagattattaaagttaaccttttagacattttccacaatcacatggtatgcaaattttaactaaattattttacattaaatgtattttgtgctatgttttgactagttgattttactgtagtatagaatgtattatgacattccattatcctcttattactcatcaataaaaaatttattgagaaaacaattaattataattaatatttattattcattactagtaggcattgtagtaattacactattattggtattttaaatatcattaatagctataaacatgttatacataataataatagaaaccatttgtggagtgcttactgtgtaatacattttgctaagcattttatatacattcttaaaattaataatttcaaagatttaatgagctaagtgtcaccagataaacgagaagacataataatctttatttattaaaggaaaacttgccatatccacacaatcttccaaagcactgatagaacagaatgatggcatgatggcatcttaaatttagaaagtgtcattcataaaagtgtactgttaactactaatttgtgctatctgcaataataatattatattacacaagatggaaaggctaccccctaaaagatagcatttgataaattgtacataaaaatctagaagaataagagtataacagaggagtgaaatttgatctgaaatacagagaaaattaagaaaaacaaaacatgttagccctactggaatttgtctcaatgtatttcaaggttcaaagtatagcagaggaagatcattgacactgtcagaggattatcattaaatttcaacccaaaggcaactaactcaaactatgcagatatggaaagtagtgtttcctaaaatgaaactaaggcaaatattatttattctagcttctactcttttgactaatcagctgacccagaaattaaatatttaaaggcttaaaaataatatagttttaagaagttgacctatacgttactaaataaaatgatcctcgttgtatttgaagtagctcaccatttaaaaatttaatctatgtccacccattttctttcttcccaaataatacaatgatttaattaccccacagtttaatttgacagaggagccaaaaagatacactattccttcattgttaactttaaggagaaaaatacactataaactatattagaaatcttattttttgggtgtccaccacaatgttttcactacaaaatcccttgctgcctgaatacaaaatgttaccattcaatcagatgagtctccatgaagttagaaacattcaagtgaaactcataaaataaagaagatatactctaaaaattccagttcttgagaagctgtttacacacaaaagggctattaaaagtgaaagggtaagtagaaaatcttctgggctcatttaataaaagaatgtagagttccatgggattcttttctaaagaaaccactaacaatgttgcagatctacaaatcctaaaagagtgcataatggactcaagtctctgctttgtgactcatgggtgtacttcatcaggatgtacttcctcttttagggggtcatataggtgaataagctgacaacaccttcagagagagaaattccacatgtgtcataggaatagaatttatttgatctcaagctttctatatatagaaaaaaaacaaattctaatccaaactttaatgaattcagtattgttgttgttggtttgcctctagaatgtctcttttgaccaagtcacattcctttaaatttacactaggtaaattatatattttccaaatcttttataaaagcataagctaaatgagataacattaaaaggctgattggagatttccctttaaaagcagtcataagaacaacagcaataataatataacaacaatatacactacattttgggcaccatgctttgaatttatatacactaatattattaaggcaatctgtgcttttgagaagctactccagactaggcactacacaaactctgccacacacaagagagaaacaatttcaattacaaagagagctagaaaataaaatggataagagtatcatgaaagattttttgtaaaactgaatagatcctttcatgtttctcagttttaatctctccaaatatccctattgtctgctttttaaaagaaaaaacactgtaaaaattctgaaaaaattattcacaaagaaaacttccactcgtttatataaagcattattattaacttcataacatgcataatatcatctatttctgaaagaccattgaaaagtagccataaaaacttaaaaaattgaaaataatctttagagatcaacaggccaggaagagttctaagaatatgcattggcctttactaaccattttcaatgccatgcacttttgtctgtcaatactttctcctgttatttttaatatccctagattaagaaatattaacatctatttacaaaaaaatattctaacagtttcccccacaaaagcatattcccatgaagatcaagaaaacaaaaaacatagcagggagtcagtattctgacagccttttagtcttcttcatcttcttcctactattattattagacctactgcctattaccagtaggctttttaaaggtcttggacataaatatcagttgttaagttgctattttcatggtcatttaaaattatttcaaccataaatgcttttaatttcctgaatatcttaaagctgtctaagtataaatattctcccattatattcctctgtgctaacacaataatctagttggagtcaagtttcatgaaaataagaaaattggtacattataacattttaaacactgaaaaataaacgtgatagctgtaggatgtaaagtgtagtcaggcctgtagaacttcggatgcatcattttacaatatcatttatcattttgataaaactgaggtcaagtttctaaaaatacaacttgttaaaagcaggaataaatgaatgagagatgagtcagctcgtttgatggaaagggtttaaaaaatacttcaaaagcataccacatgacttggtaaatattcagtgtatcaaaatgtagttgccatctggcattgatagactgggctagaatatgtgtttaaaaagaacaagaaaggaaataactcagccaggttaatgtgcacttgtctacatttcataattcaggtattaagtgctttaataaatattcactatgaaagaaaggctgcattacaatcagacttgggcagtatttgttggggacagctagaaagaaatgaaagaagacaagacctgatggcacttaagaaagctaaaaacaacaataaaaaagtggtttaggtaaacagaattctcaatcatatgtaatattgccagaacactagtatcacagttaaatgcagggaagtggtaagcttatatttgaaaataaactgaaatcttgcttattttcagctttgaatattttaattattcttttctttggctttgacaatttaaaagtatagagaaatccagggaataagtaaaacccttggttggatagtaaaaaaaaaaaaaaaaaaaaaaggaaaaacgaaaaagtcctgacattctttgaagttttaaacctagagtttgatattaactttgcaatatgcaacaaaacaaaaagtaaatttgaaggactcctcttttctccctcttgctcaagaaataaaatatatttagaaagcagtatcattcacaaaagagaaaagtgaacacgagcagtgaacacttgcccaagcgttcgactgtccaaggctgtatctgggcttgttaattagatatttctgtctttaaccttgaacattctccagatttccaaatcttgacaatttacattctaccacatctcttggaatcagagcaataggcagaagagaaaagttttaaaacagctttgaaggttaattaggacagggaccagggtagccattaggaaaatagatgaagcacttcaggtgagagttgattagggtcaacatgaaatttttcagagttgaggtataatttatattcagcaaaattcatggacttcaaaatgtacacagaatgagttttgattttgataaatttatacacctatgtataaatatgtatatataaaaatgtatatatttaccaccataacagagacatagaaagttcctttgtgcccccttccagttaatttctatctcccataaacaaccagcattctgatttttatcacgatagaatagtttcgccttcacataacttatgtatactcttgtgtcctggctcttctgcataccatgtttctggaattcatctacattgttgtatcatactctgttttgttttatttgcttgttagtatttcattatatgaatataccacaatttgtatatccactttccacatttgggtgcttccagttttaggcaattacaaataaagtcagtataaacttgcctgtacaaatctttttgagggcattattttcattattttttggtaaataactaggaatgtaattaccaaacaatatggtaggcatatgcttaaccttagaagatactgatccaatgttccaaagtagaactatatatttacagaaagtcttgaaattaggtaatgtgagtctttcaactttattctttttctaagttttctgcaatctcatatacattttaaaataaatttgacaatttatcttaatgttagaaaaacaagatgttgatattttgatggtgattgcattgaatctacagataatttggggaaaaatgacactttagaaatactgagtattcatctataaataacggatttttctctaaggccttttaaaattttgagtggggaatcttacattcttttgttaaacttttatttaaatgtcttatatttataggctactgtaaattgattttaaaacttcattttcaaattatttgccggtactacataaatgcaatcaatttttgtatattgatcttgtgaccttcctaaatgcactgttagctctattagttgttttgtatatcccctaagagtttctaatgtaaacaatcatggtatttgtgaataaacacaatgttacttcttcctttcctatgcttatacctttaatttattttactcgtcttattgctctggctaggatctttagaacaacgctgaacagaagtagtaagaatatatatctttgccttctactatatcccaggaggaaagcattcagattttatcattaaggacggtattaattatatgttttcatagaggcccttcatcagattgaggaagtttcaatctgttctaattttctgagagttttcactgtgaatgactgtcaaattttttcaattgctttttctgcatctattgagatcatatttttcttctttattaggatgcatttacagtgatttattttcaaacgttaaactaaagttgcttttctgagataaatcctacttgatcatgaggtattatactttttactttttattgttgaagtttgtttgctaatattttgttaaagattattgtgcctagaaccatgaggaatattggcctatacttttattttcctgtaatatctgtcaggttttgctgttgggattatgcctgtctcataaatcaggaagtgttttgtttttacctcctatgttttctgaaagagtccgtgtaggattaatattatttcctccttaaatgttatatagaattctccagggaaactatctaaacctgaagttctttttttaggaatgcttttgacgacaaattcaatttctttaatcaataaaggaatattttgatttctttggtttactatgccagttttgttaatatgtttttaaataaatttacctattttatcaaagttgttgaaattattgacatgaagttttcataatattcccttgttatcctttaatattgttatgatatgtaatgataatctctcattactgatattcataatttgtatcatctcttttttcttgaacttttctgttatagcttataaattctgttaatcttttcaaatattcatgttttgctttcattaatcttctttgtagtttgtttttatttcacagttttctgcctttgttatttgttttctttttttactgcttttgggtttaaaatgattatactttcccactttcttaaagtggaaacctacgctattgatcttaaacctttcttcttccttctaatttaggattaaaagctcaaaatttctgctaagcttctctctggctcatattataaatgtcaatatattgtattttcatttaatcagtttcataaatttcaatatactgcataacttaatttaattattttaaaatttcatgactttcaaccatgaggtattaagtttgttgtgtagtttccaactggtcttttctagatattttattgttttctttttttatttctaatttaattaattataaacaagaagcatattttgtagtatctcaatcttttgaaaatgtttgaaactcatttgatgaaccagattagggtctactttaataaataaagtagaacatacatacaggactctattcctgtatgttttaaatatgttttaaagaacacatattctccaggtgggaatagaacacattctccaagtgggaatagtgttctgtaaacatcaaacaggtcaaggcagttgatggtgtttttaatttcttgtgtattcttactgattttctgcctatttgttctatcaagttctagaacaagaatgttaaaatctccaattgttattgtagattttactatttctctctagttttctgtcagtttgtgtctacatgtttatgacttatgcattcatgataatttcacacatatgattaggaaatatccctccttatctctaatagtactccttggcataaagtctattctttgtaatattaatattccaacctagctttctcatgcttattgtttgcattgtatatatctttctatcttttcactctcaagatatccatgttattacatttaaagtgtattcctgtagacagcatatgttgactcttgcctttttattcagcctaatactctctcttttaattgtagtatttataccatttacagtgaatggaattattgctacaattaagtttaggtctaccatttatttcattatatgcttttgatttttttcttttgggtttttgtcattgttattcttctgttttcctttcctttttttttttttttttttttgagacggagtctcgctttgtcgcccaggccagactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttcctttccttttttaatgagttaaactgatcaattatttttccattcaattgcacaactggctttttagctgtaccttttttgttattttttagcagttgttctaaggattacaatatgcctctttaattatcactgtttacacagagttaatattttaccactttatgcaaatgtgagtatcttataagtataatttcatttactgccacccagtactttgtagtatttttacatacttcatatctgcaagtactatagactcatgagaaaatactataatttatgcattagtcagtttttcttttaaagaaattaaaagaataaaaggatattcttttacatgtaaatagatactttaaaatttttagtgaaaattttctgtaaaaacaagtttctatcttggttcatagtgtcatttcccttcaccctgaagcactcactgcctttcacactacttataggaattccactgacaacagaaaattcatttcttcattattgcaagatcacattgctctacataaaattctggttttgcagttgtttttcttttcaatcattaagaaatggcattacatttagtatgaggaatgagtcgatgtttgattattcccctgtaggtgatctattgtttccacccttagggctgcctttgagatttttctttgtatctttggtgtacagaagtttgaatacagtgcctacatgtgattttctttgcatatttttgtgttttttctcagcaaattttggacattttcagctatgatttcctcaaatatcatttctgtcccattttctcatctgccacccacaatctgctgttaagattctccaacaaatcattttttatttcagattctgtactttaacctttggttctttttagtaatttcatttcttttttcttcttctgagacatgcaaagtatagtggactggttgatattgttgtacagatcactctgcacatttttgaatcctttttctctctgttctttacattaataatttctattgacctgtattcaagtttactgacactttcttctgccatctacaatctattgttaagccacttcaatgactcttcaaaaaaatttcaggtattataccttaactttttacttatttttgaaaattttcatttctctgcttattttctcatctgttccctcattatgactatatatatacatatatttttagagacagggtctcactctgttgcccaggctagagtgcagtggagcaatctcggctcactgcaacctccacctcctgggttcaagctatctattctcatgcctcagccttctgagtagctgggattataagcatacgccaccacatctggtggattataggcgtgagctaccgcaccgggcctgaaaacatatttttttaaaatcctgaatatatttataatttctgctttaaagtccttgtctacaacttctgaatcatcgaggaatctatttccatggactttaaaaaaaaattacatgtcacatttttctgtatccatcactggtaatttttgaattacagttgaacattgtgcatgatatttatacaaactctgggtttggttatctttctctaatgcaatgcatttttcttctagcaggttattaaattactagtcgaccactttgatttgaagaggactggttttattatttgacagaaactttcaatgcttcaggtttgtctctctttctataattaatttcttagttcttagctatcatctatatttctaaggtttgatccttctgggattcataaagcctgagacatttaccaaacccttctaactttgtaaactcaaactcctaactttgtctcctcttcatctaatgtatctgttcagctcttttagctttctagttgttgcttttctccaggcacttataggctcccacatacatgcacagtttatatcagccagaatgttagggtaacttatatgtagattcatgggagccttccctcgatggctccatcctttctaatacttccttcctcaatttcagctactttgccaatgccagctccattcgctaacatcacaaaccaataagattgtggttttctgcctgaattctaacttctctataccatacagactgggaagttccttgagggaagaagctgtaacaaacgtgaattttacccgggacagttcactccagattccaactgcttttggtcactctccggtgccttcaaataattgtggtgttttttttttaagtttttaattggagtttagttttatttttaacccataccatggtttggaactgttatctgtggaaatatttgtcctgaaacagtacaagttactcctttattaccaaaatcacaactaccaaaattgtggttttatgttagatagcacttgaactgatatggaaaactgcattagaatcaaagtgtctatagggcttcctctctcaatattcagtattttaaaattgagacaagactattttttaaccttaaaaaaatcactcatagtgccctaggaaagtgctatatattccactcagtcgctaaatatggccaatgaatatttctataattaaatttagcagaataatctgtgaataaaatgaaacagacctgtatgtaaagaaaactaccttaatgaacttgcttgggagatcagtggtatgtgatatttctaatcatgacagagaagttgaacatgtggtacagttgtgtagggaaaatggataactcttatcttcattattttttaagtcattctaagagaagcatttgctaagtagtttatatatatgaacttatataattttcataacaatttttaaaaatagtattgtaacattattttgtagatcacaaaactacaaagtatcccaggccatcagactccagagttaaattccaaccattccctctaactacctgctcagaattgagataaaactcatccacagcagtcatcattttttctaagaatatacatcacctattaatgttctttcccatctcccatgttaacaactttcttcctctatcatgtaaacttgctctctatcatctccgtgcctttcttgttcattttcatggagcagccataaaatggagaataacaattgaagcagtgaatagccaagaagcatctctcaatcaatgaacctgagacagcctgttcacttctgtccatcattcttgtcctttagatctcagtttcaaattcatttcttctagacattcatctcttcccatgtttaatctggaaccatctacccttccaccagaccaattatcctggcaaattaatgtaatagaccagtattaattatttgcttgtatgtcttaacaacattctaggtgctgtgccaaaaacaaatgaatagcaacacaaggtcttctggttacaagcacattacattttggttggggagattttgacccatctcacagtcataatcttcatccaggttatctcgtcaacctctatgtatgcatatattccaatattttgttttgcttttctttcttccttgtagtaatttcacacagactattcgcttcaagaacctaactaacttcctgttggtacccaatcctttaactctagagggtcaaatggagccctgtggctcctggcagtgttcctgaagatcaggtccctctggtggaactcagttctcactgccttatctaaccttcctcactcagcttgtaatcaacttaacttttaaagtctttgtacacattaggtaatatttgttctctgaactcccagaggggctgtggtaactgcccaactaggaagccctacccttcattattcagcaacagcttgaagaatattctaattctaactttccgccctctgacagaccagctgcatcaaaggctgtgttcccctgtttgtttttttcctgaagcagagtcaccatttcaaactaagtaatctatgagaaaagtaagagctctgggtccaaatgtttaaaacatggctcttctgtgaaccacggcaaatctaaactggattatgccttatgctggagtcagaacttacttggtcccttgttctttgccctctggctccctgcatgctgttcaggggaagttactggcttttgaactggcggtttgaaaacgaaggcatttttcttttagggagaacagtctttcagtgatttaaacaacaagccttgtgatcaaaataattcataaaggaaaagatttatgaagtgacttcactagcacacaatgcattttaaaaactttgttttttaaataaatctgtcagtacagaagccaagacaacacatctgaatgcaatatcagtggacacaccctgaatctcttcttctttgcttgtccaagactgtggtagaaaagggaaatgattctctttgtcttttcttatttaatattattattaaaaattttttaaaaattctagttccatgaaaagactttgaaaaattgtgcctacttttgtttcctgcaggaaaacctgccttgtaaaaatgtattttccattgaccacttgtgcttgtttaagaaaataaaaaataaataaagaactccaacttataatgaatacctctggcattagggagcctgttctaatctccctttatcaagtttgagtgatagttctgctcaacgagtattgacagggccgtcctgtttctcaggctttcgtttccctcggttggagaaggatacagtgcattttcacattctcaaagtctgcagttgtttttatataagaagcaatttgcttgggtcacgtcaggtcgaatgggatgcctgcccagctcttggttttaaaggaaaaacatacagaaagacacaaaaacacagcagtttccttcattaaattccactctacctgccatgggcttctagccacaatggaatttcccaccctggcctagcctagcctaacttttatttttagggattttttttcccctttaaatcttatgagctttctttcaagtgaactttgaggtaaggattattaaatgatagagtaattgcctggttaaaaaagaatcagacataaaaaacaaatgcctagtgaccttccataatatcgctggataaccaccccctggataacagcctttcaaaaactgttcataatcagcacaacaagacaggtcatgtaatttaaaattaaaacctgaatcatttaatgaatagggatcagcatttttttcaatagtaccctcttcttacctaattgcattggatgaagataattttggagaagaaaatgaataaatgaaaacacaaggaactagataaatagatggggcgggtggatggggggtggagagagagacagcaagtgagagagagaagcttttggacctctctctccaaaaagccatttatgcttttccccattgcctaggggcaactgatttaatcaggattgttcatgtggattatctaaactatgaaaagcaacagggagcacttcccaagaaatccagactgggtgtgctgcagaatacttggtttggggcctggagctaagtagactgttcacattgtactcagggtcctaagaaaagtggctcagtgtctctgtaattctttgtccctttgatctacctcaacatttggtgtctcttggcattaggaaagctcacgaaaatgaccctgcctagttaacagattcatagtctgggcacacaaaaaaagggtaagaaagaaaaaaagctttggtaatgagggagagaaacgtaccttcttgctatctttgctgggcataaataaaaatcgaaagatgtgatttttggagatgtgaatcccgttcttcccatatttagtaatagccttttcagagccaattcaagaccttctatcaaccacctctgttaaacatatcaagttagatttctcattcattattttcaagctggattttgcataatcttccttcaaatgaagaagtttacttttcgaacatgtcatttgctcttagcactgttgttctccttcacccattttggcttcttatcctcaaatccctgattccttattaaagtggattgttaatgcagccattctttagcaccacagcacatttataaatcaaaaattagtttactctgcctggcttccaaaaccatttgctgcttgaaaccatttcatgagtttgtctactcatgtgaataaataaaaacttgcctataatgtgactttgggaaaggaaagagcaactatatgaaacgaattctacagaggccaaaattattttcacgagtttcatggattcagcccttgcatgtgccattctacattaactttatctctgagattaggattttgcttctctttttttttttaattatactttaagttttaggctacatgtgcacattgtgcaggttagttacatatgtatacatgtgccatgctggtgcactgcacccactaactcgtcatctagccttaggtatatctcccaatgctatccctcccccctccccccaccccaccacagtccccagagtgtggtattccccttcatgtgtccatgtgatctcattgttcaattcccacctatgagtgagaatatacggtgtttggttttttgttcttgcgatagtttactgagaatgatgatttccaatttcatccatgtccctacaaaggatacgaactcatcattttttatggctgcatagtattccatggtgtatatatgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactcacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccatgagtaggttgtgaaaattttctcccatgttgtaggttgcctgttcactctgatggtagtttcttttgctgtgcagaagctctttagtttaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacacaattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactatgcttcataagtgaaggagaaataaaatactttacagacaagcaaatgctgagagattttgtcaccaccaagcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaatccacacataacaatattaactttaaatgtaaatggactaaattctccaattaaaagacacagactggcaagttggataaagagtcaagacccatcagtgtgctatattcaggaaacccatctcacgtgcagagacacacataggctcaaaataaaaggatggaggaagatctaccaagcaaatggaaaactaaaaaaggcaggggttgcaatcctagtctctgataaaacagactttaaaccaacaaagatcaaaagagataaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacaggattttgcttcttaagtagatgtcatttttctccagtaaaaccaagtggtttaccctgacatttagtagtaatttagtgatttcagagttccttctaaatctaaagtaaatgttcatgagactcatgaacttgtatctagacaattaatctgagcattttaagacttccctgaggctacatataatctctcacaaccccttgcaaaacctgagattttgaaccactgtcaagtttgtggttgccctggtaaggagtaaagcaaaatcattacttatggcaactaccacacaaacattgtagtgaactgaagtataagaaaatcactactatactttagacagaacattaggattaatgctggtaaccaaggaactaagagcctgtaaatataactggcttaagaaggagaacaggattaaacaatattggagtttagaaacaaaagtagtactgtatcaacctgtcactatgcagccagtcattacaataaaactaaccaaaggatggcggcagaaagaaataaaagtatttttgtgtacaattcttcttgaagcactacttgaattgcatctgtagggaacaggtctcataggtctattatttgcccacctccccaacacacacacacacacacacacacgtactagcctaggccgatatctactgtggtaagtttgcatctgtgagccactgagcagctgctttatatatgcagcataggatgaaagagagaaaactggggtactcatggtttttgtgtaatatcacaaagaaaagaaaacaaaaaaaggcttagagaaagttaaaggaaaatgggcagtggtacatatacagaacaagttaggattccctaggaactggtaataggactaaacttgcttaacatctatcaaaatgacttacttattccagggtcttgcatatacatagcagaagcacaattaatttttgctgaatgaataatctggaacaaggaatgtaaaataaattatccaaaaatgttgatggaatgaaacttttctgagcaaggaaaagctaaactgatggaacacaatatttatccaggtgtgcagaaaggtgccagtgcaaatagagaaaaacaaaatattcaaatacagtcgtttgccgtgtaatgacattttggtcaacaatgaaccacatatatctataccatggtggtcccatagattataatactgtatttttgctgtaccttttctatgtttagatatgtttacatatgtaaatacttaccatctactctgttacaattgcctacagtattcagttcagtaacatactgtacaggtttataaggtttatggcctaggagcaataagttatactatatagcctatatgttagtagtatataccatctaggtttgtttaagtacactctatgatgtttccacaatgatgaaattgcctaaggatgcatttctcagattgtatccccatcatcaagtgatgcatgtctagtttaattataagtcttacctaggaaagggacttaaaggctatgagctctttcaggcaaaaaggccttcaaaattttggcactcattaagtaaagtaatgaaaataaggtttataattcccttatattaaaccctctgcaattatgtgaaactatctgtacttcaaatgccatgttcctataacataacaactcagggtgtcttacacaggacagtcattaaagagtttaaggtagattaaaataatctgcattagtagagaacaaattattttgcggtattataacaattcattgaacatgagaaaaagcaaacaaacacgcttgttaataaatgttacttaacagacatcacactgacatttcttagtgactgactgccatggaagctttctaataagtctaatttttcccacgctctgagtttataagatagcaatattgtagctttgggtgtttacctttgtttatttattgggcggagttttattgcgtgcctcctccagctgtgccaatctggtaagatcaaatggaatcctttagctattgtcactatcctaaatggaccgcatgcttcctttgtcccttgcattctctgattttcgctgggggttatctatcatggctgtacatccaagtctctaatctatctcctttctcatccgtttttcctgacttatttcccttttccctttgtctatttccctgtgagaagccaaaagactgtatagttcttagtagcggtagtagtgctatctagagttggcatccaacagcaccagtgttataatacactttctacaatcaagaaatgatttgatttccttgcctcagtagaaattttacaagttaacagtggttcacctgatataaaccataatatttctatcatatcatgaaagaattctaaaaaatctgttagactttcttctacaagtttgcctatttcctctgaatacagttaattcacctggcaacaaaggagattagctatttctttttgtatgcagacagaaagaagtgtgatctttctttgccaataaaaacttctagtaagtggtgatagacttcaaaacccttctttttatttgaaaatcatggttcagttatcaggaattccaaattcagaatctaagaacagtgatcctatatagtcttgtgattttgcacatgctagggattggtaagttgctgaagacttcttaaataagagaggaagcatttttcttttcacttgcaaagaaccaggaggtacattaaaagaggttttagagtaactagaatgtgtgataaactgttcactttctgttttaaaactgtccatgaggttccctttagagataggacagactacagagaacgtggtgtctcgtttctatgggttgaaattccacagaacaatgctttgcaaagagtcataccaccagttccttttcctgtgagatgcaaatactaaaaacagatatgggctggacaagattattttaaaaatagatagaaggcaataaaagctttggtgatattctagattacatatgaaatgtgtaaaagcgtaaaatgaaaagttctctactttttaaaagctgcatcaaaatttccttcctacactgtaatcgtgccccttaacccatctatgcctgaggttgcaatttctttgaatttctgcaatcagaccatggcgatgaccttgagcagtaggatataaataactcctccatgcttagcgttccaataatggaacactaggcataaatgggataaaacacaaattgctaggttcatgataaacagagcacatctgtaaacaaaataacttttaaaaaatatgcctacatatataattttattacttctagaaacacaagtgttattagacttaaagagagccagtgaattgaatcaacttattctgatatgaacctcaatgtgatctgattgcaggctgcaatgattaacacgttttaaaagaaatgggtccatactatactttccaactgcccacccttctgttcttcttatgctacagatttatggcagcctaacctccagccaacaagttagagaattgggtaagacatcattttggctttttaagaaaattatggataatcaaaaaacatgacacaaaagatttagtggctattatcagggtataaactaataactaaaggcatttatgtgttaggtaataatgatgcttagaaaattataaatatcaagatgctctttcaacaactatattccagatttaggaattttgtagaggatatggcataagagtgttaagaaatgtatacttttttgaaaataaaataaagtctgatttatttattatccaagttcctgtgttttctgggaaaaatgtattaatgagaggtagcattatttgatagttaatggagagtggaaatcatctgttacaggcccacatgctcacaagcaaaataatattctctcaatcctcaaatggaaatggggattataaaatgctataagactctgtcaacatttctgataaattccatgaaaattttgtgttacatattttaaaaattgtgtactatgattataacatagttgattattaaatatgtaatcctttctttcagattattcttcttccttaaatgtaaagggtatattattttcttgatttattcttttggataaatatcctgtacatagatgtctgaaatccagcccgtcagtttccctttaaattctagcatattttaaaggaccttaaaagatgactgtggagtactgcctgatttggaacttgcctctgtctcttacacactgtatgacgttgggcaagccacttaacttctcagtacttcagtttcatcatcagtcagaacagcacaataatagtaccctgctcctatggttactatgaggattagtgggtttcatactgtcaataataagttgcctttctgggtctttgaagtacttgaaatcaggttaattaaattaagcagagctttggtccctttgtttgacaagtaatctccaattttcatttccaggttctgatcccctaaaatcagtggaataaaaccttgtttgtgtaactgccatcttcctgccccaaagccaagattaatttacctgttggttttagttttcactaggtctctctttagctaggtgcttctaagggtaaaatatcaactattaaactatttgaggcaggagatgttgaaaggggaatttaattgttaagtcaatagcagtgtgccagcttagtctgcctttcagaaagatcaccatagtaataacgagaccaataaataaataaaaagtataaaatatacatctatgcagaatcttagaaccctttctctaacacataagtcattaaaggaagctctgaggtctgcctatgtgattcaacatttacacacatcatagttctatggaagaaattctcagttgagagctaccagctttcttcagatcggatcagatttttctatactccattataaacaacaaaaacaaaagcaaacaagtgaacaacaacaacaaaactgtagttgtggttcactccagtaatatatactaccaattcagtggttcttaactgggggacaattttgccacccccttccccaccaggggagaactggcaacatctggagacaattttgataatccaaactgaggggtgctccaatggggagaggtcagaaataccactaaacatcctacagtgcacagaacagacatctaccctgcatcccggcaaagaattatctactccaaagtatcatagtgccactgttgaaaaaccctgtgctaaactaacatctgagagccactggccttaaaccatcagccacatcaacacgtaagacactcagcctatgggatagtctaacagttaaagaagacaccttagagggaactacttcaaaaatatataaactgacaaatctggataccatactaaggaaaaaactggtaaaacaggtagttgtttgaaagcttcttatgcccattattataaaccaataattttagattactgaaccaaccagactaatattccctttgaattccaggaggtataaaaatatgaagtcatcgactatgcaacattatcctgctatggagacattctgaaatggtttataaaagcagtgaacacattaaaaaaaaaaaaactagcccaaatgagttatgcaaagttaaagtcattttttctaggaccagttttttttcctgtgcatagtattttccatatgtaccgcaaacattcatttgtgcagaacatagcaccacatttctaatacaactcctctctgaagacaaatcaggctaaagctaagagttgcagaaccatttctgtatgagtcatttttagcacaacataagccctagagtaaaatttattttctaaataagccacaattattctgcaaacatttaacctagcacctctcaactgttaaagaatgtcaattatatatgaaaggaagaacaaatataaaggaaatttgaaaatcaagaaaattttttctgagaaaagtttgtgagaattattatgaatacagctaaaattcaaatatgtgacattttatttttttaagggtttccctgtcaaagacaacacatatttttctaatgaaagaggatgcctgaagttgacattcataagagcatttggatactaccaatgtgaagttgtacagatttactcatttctgcaattaccctcttgtgtttgaattctactttggttagtggtagcaagcactaaactgtactgagggcttcgcaaaagttgactttatttctttacacttagaaccccaaaaatttacttcctaggaagatactagggaatcatatcttactgaggaggaaataagaggtggaataactggattagcctcacaaagaatgaaagctcagtaatttctgagttggcaatatttttcaccctccttttctccatttaaatttctagatttaccttcaaaacacttgcctttttctaccttaagggaagttctaggatcagggagatggagatagagaaggtagagatagttttaggttttcacagaagttcaattaaaaactgccaagtacctcctaccaagagaccaccactaaaatttatttctagaacaaggtgcagaaaaataaaaggtagaaagcaggaatgttctggtactgtaaaatatttggggaaaaagtctaatttctgttctcaaaatggttactatcttgctctagagaaaaacataaaccctcttaaaataactgaagaacaataagaaacagtataattaagtgtaaaaatgggtggtagaagcaaaatgctgtggggcacccatgtgtcttacatctttccaacacagagaaaagagacaatgggtcaaatgcagcctactctagtctctgatattagtttcattacacagctataatcccattacaaagaacttgaaggaactgttgacattttttgctgccctggagtttattgtctcaagtattgcttgaaataccagggtacatgcagagatgtctgctctaatggtatttgttgacctacattatgttagggttagcctgaataaatggagaggaacgctacatggaatcagttagttagattgtttgtaagtaggcgtgcattatttttaccatgttttattatttttaacctaaagactacgcatttaaagtagggtattatctgtaagtaatcttgttgttatatgaaacagtaatatttattaaaagtgcttttgtaaagcccaaaaaggggatctgcagaggcagatttactgcatatttaatggagcttaaacctcagggaccttcacttgcgcagccccccttccaaggtcctgtacttaactctgtaatcataattttgtattctttttcttcaagaggaccccccaaatagtttaagcttctggtaaaatcttgatctagcctaggtataaaataatcttgaagggatccaaactgatagttctaaaaggctgatgctgagaaagatacaaaatgtgcttttacaaggatatcatatcaattatattttccaaatgtatctctcttattgttgtcgctcccccttccctgccaataaataaatgccattttttttttttacctcactgttaaaaggttattagacccttttaaataagatcggtctgttcagtgactgggaataaccagagtgttaaaaaaaagatgaaaaattcagaggcagaagataatttccaagaatgaaaagatatcttagagagactcacaaaatgtttcactaaaacagcaataattattatccatacctaaggagtacatgcatttgagaaaaggaagggcatggaaagtctctcaatacaatttacagtagtacctactgaaaactgtgctgagtttacacagagtgtgggaatttttaccaccagtaacaccacgtgtctgtttttctggtttctgaaaaccccaaataaatcccacaagcgcctctaaactccaccatggaattctcacacttctgagtaagaagttcagaacagaataaaaactttggatgcagtatgtctgtctatagtttttcctataatgccttgtcccagtttttgaagaaaactgaataaaaattaattcaagaaaaaaaatgaatgaaattacctcaaatggaatattaaattgaaaaataatagtcaaattgctcataaccacttcctgttaattttttttctcttttagaaatggagtaagaatgcttcaaataaaaaacgtaaaacccatcccatcccataaagggcccactcacgtaaacaggaagcttattaaaagaacttttcttggtttcctggcaaaatccagcttttattttggtggcagcatctattaaggaggagactcattttgtgggcaggatgaaaaattaaacattgcaaatccatcaggtacttgctggattagagttagttgactgacttgttggctacagggaacaaggtagttctgaaaccaaggaacaagctgccaaggaacagtccagccctgcccaaaagatgatggtcttctccatccaggcagcacaaatcaactcgaggttccaagagggccagtagacgccagcctaccttactgtaaagtgtctcacatgcatatctaactgttctctcctttcctttacatttaaatcctgttgtattggcttctctgttttccctttcctggaagcgctgtagcgtaattaaaagagtatgagttttggaatttcaaaacttggtttatagtccagcctctgccaaatactgtgacatgttacctgcttgagccatcattttctgatatgtagattgggactaacaattcttccttaatcagctcaagtttcacaaaatatgggtaaacatcacgtgactcaaaatcaactgaggcaaaaattcagatgtcaatggccctttcttgacttattagaacctccatgagctagaaattcttggaatctgaattttaaactcactcccaagtgatttccatacacacagaagtttgagaaccacatcccaccttgtcttgtgtcaggattaaataaaaccatataggtgaaacttatctgtaaattgcatatcaagacatgcttagctgctctcaatagtatcattttccagatagcccaaagcaccaaagtaaggacagcgggccattttcccaagatctttcttccagcttttccctgccatgccaacagcattcttcatcttcaggtaggcagggcaggttcactgggggttggggtagagctcagcactgtgacacaggcagtacttccgtagaatttcatttatgtgactgtacctaccccacagggtgatataaggattaattcctatttggtaatttactgtgtgtaaaatgccttgagccccttggaggaaagtgctatataaatgtaaaataattattataataataataacctcgactatttaactgatcagtgaattagccagaagatttaggctgccaagggacaaggctgaaaccattataagtagaaacactttacatcatcatatctcaaactgttatcacgaaaaagggaaacaaagggtgaaaattaagataaatccatgttctcaactgatttaaatgacagaggatcactagtaatgattcatgaaagccaggaaatgcaaaaatgacagctgcattgtaattctaactcagccacatgtcctgaggttttgtacactttggtcttttatttgtagggaaaatatctcatcagtgcaacatctaaaatttagcattatgaaggcacttgactatgcttttgcttagttgaaatacgttcataatgtatcccctatttgtaggtaatgatttttctacctaaaaagcattgacattattctatgaagttccaggtaaattttgaatcggttgcttacaatctgcctccccacatacacaccctaagaatacactctaacaaaacaatggtgtatttctagatctaaatttaggaaaccaaaatatatagaagataccttttcttcccaggaagaaaatgctttggtatataaactcacatgagctcaaccgtcttcagctcttacattatttgttttatttatttattagattcatgaagattcttctaccaaaagctcaaggggctgaacccagaactttcatatattgaatgtgaatcacttcttaaaccacagaaaggaaaataaagggctatagaaatcttaatgggcaagctccagatgctcaaaagcaattgtttagttactctacttagttatgcatcattcaaaacactttctaacaatcgggcaagaaaggttcctttgtgaagaacaggctttggggtcttggacaagttttaattctagttgttttatagctcatacaaaatagttgtggtgcatatgtaaagaggtactgtacttacatgcaataaagtttgcagatgaatattttgaaaatcaaagaaaagaaaacaaggggaggaatgagcatgtggtaccttgctctatttttaattattaacttgtagcctcaaagatttccatttagtagaaacacatgtaaactacaatgaaggagtactagaaaataaagtcaattggtataactcaaattattttgtaaaatgtgaaattaagctttaacctgtctatgtggaagggtgatgaataaatgaatgaatgaagtaaaaaatcaaagatacagagttgtaactgattttctttgcatgaagtagtaaatattaatattagaaatatcttttgatttagataaaactggccttgggtatataatacacaacactgaaaaacatttcaaatgtggtatttgtttaaatatatacatacataaacacacacatacacacacaagtcaaaaatatgggtgttctggtatagttttctgccttcaaagggtctctggaaaaaacagaagaaaaggtatcctataaactgcttttgctgaggtctctagtagagagcaaatcgaggcaagtgctgcccaaaataatctctattacaaacatttaaaaaatctatctttcatatatatatatgaatatatattatatatattatatatatacacaatatttttaatttttaattttattttatttgctgtatagctaacagcatagccaatgccctgatcttctagccacactgtaatttcttgtccttgcatcacaaccccagctgtagtcatcaaagtggaaaaactgacagcattgtctgaaagacacagcttgggaaaattgctccttgtagctcccctgtcaatgaatattatcatatttttctcatggataaggttactgtgttttttttgctgggccgggggtggggaggcttctacatacttagctactaagcacattaccattccgtttgtggaatggactaaacgtgacaatgcgagctgtagggttagcattcccaacattctgttttaaagtttttgtgtgtatatcttcaaaaataatattcctttatgtattcagaagaagtaaaatcacaattatattttacttgacattactattttcttaaggaggctaacagaaaaatcaatgggtgggcataaagagaaagaaatcatatgaggctaccacacatattctgttactgaatttctttcacctaaatatacaatggaatgctctgaattgtatgttttcttttcccatcatattaaactaaagcaaagttcttgggctgaaagtagaaaaactgcactttagtgttctaatgatccacacctttcacatattcacttcgcttacaattctagatgctaactcaataagaaagaaagaaacaaattcagagtatttcagtcaccaacaacaacagcagtaacaataacaataatattaatatcagttaatatttatttaactcttagatatactagatgccattgtaatcacatgtattaactcgctaaatcttcacaactctaccagagagtactgttattactccgattttattggtgaggaaatagaggcacagagagatcagaaacttgcccaagatcacacagtcagtaagtagaggagtcaggattcaaacctaggaagccagactctgttacaggatgaatattttggttgctaaaggccccatcttccttacttctcctgatcctcttccccaactgatcagcttgcagcattcatttgatcttctcaacaaattacgtattcatttgcacaccgtccatttagaataacacagtagttaaaaacttaggctctggagtctaatatgagggtttactgccacatattggtagtgcttaacttttctgtgcctcagtttccttctgtataaagtagtaataataaaagcaatttcatgtatttgttgtgagggttaaatgagataatgtatgttggagctcaatggaaggtcaatgttctataaacattaagttcattattattgatttttatctcttaataaatagaatccctttttccaattagattgtttttcagaaaaattgtgaatatgaatcttttttgtctcgtgtaggggttcccaaatgttcagtatgttgaactcttagatgtcctaggtactactgaaatcacgtgtattaacattcataacaactctgtcaggtaatacttacatttacccataatattataaatgatataatataccaatgtctaaaatttagtgagaacttactcactggacaagtgcattatggcattatctcattctccctctaagcctctgaactaggggatttttttttttttttttttttggagatggagtgtcactctgtcgccaggctggagtgcagtggcacgatctgggctcactgcaatgtccgactccctggttcaagcgattctcctgcctcagcctcctgagtagctgggattacaggtgtgcaacaccacgcccagctaatttttgtatctttagtagagacggggtttcaccctgttggccaggatggtcttgatctcctgacctcgtgatgcctgcctcggcctcccaaagtgctgggattacaggtgtgagccactgtgcccagccaactaggggatttttataatctcaagtttatgcaggaggaaacagaagctcacctcggtcatcagctggtaaatgttcacaaatgtaaattcttaaccacaatgccatactacctgctaaaaaatgaatttaaggtagatctttagtaaatatatttggtcttgatgatgaatcaattgaattctttatttctgttaccagaaaccttgcacttaacaataaactaatgtggccttgaccagcagccgccagtccccaggcttcagacactggtacctgttaggaacttagctgtacgggaggagatgaacagtggacaagcaagcattactgcctgagctctgcctactgtcagatcagcagcagcattagattctcattggagcacaaaccctactgtgaactgtgtatgcgagggattgagtctgcacactccttatgagaatctaatgcctgatgatctgaggtggaacagtttcatcctgaaaccatccccacacctccagtccatggaaacattgtcttccatgaaactggtccctggtggcaaaaacgttggtggctgctggcccagacaatatcactcattctgttaactattgaaaagagatgactgtatgtcaggtacatgccaaatactggaaatttgaaaaatatatatatatacattgtgggtctaaaactgtatcattaaaagcagctaatgatttaatatcatttcatttactatcattttctgtttactcttacaaaaatcaaacttcttcctctccccttcctctctctgcctactctttcttattccttcttttaaatcaaagttttacagtattaaccttacaaagatttttgcccataagaaggttatatgttaaggcaaggaactgttttaattatatttactcttcattttgagtatatttctttttcatacctgacaaagacttttgaaatgactaaagaaaggcaaagcaatctgattctttataaaaaaatctttcatatgcaatcttttgtctgtagtattctcataatagcttagaaattttaaaagaaggttttagctggttttgttcttttcaaattggcagaatttgatttttttcctcttcacatttggattcactttaaaaatcaacaaacaagaaaataaaaacatattcaatttaaaaaatatgctctccattggtgccttggcatcatcaaccaatatcagcatcactctgaaaaccatttctattctgtttttaaaaaaaagagttttaaaatgcacacataaaatgcacttaaaattgatcctactgtattaaggagagagaaaatttaagggcaatggagagctttgctgtaaccaactcttcagtcaactataggatattgttaatactgccttcacctccacactgaagatataggtaccattttgactgtgcttttgaacaatatatagctaaagatttgaagtgagtaacttcaaagtcagtagttttcatgtatacgtcgcagaatcactgcatcttatgtatgactttaagttgtattaagctgataatttcaaaaagagagactttcaatgaaagaaaattcctgaaatttggtcattaaatggttcgagtacgtagaattacttacaatgtaatgccaaagaaaggtatattgtatttatccagaaagcacgagcataagaatgacctcagaaagttattataatttattacttcattaaagatacatttctagtccatctattatgtgctaggccttataatagacaacaaaaatgcaaagaacaacaaatgtgatctgaaaagtagtaaaggttagggaagatgggactagtaagagagaacagaagtaagaaaataaagtgattataattgtaactgccatgagctgagggcatatcatgcattgaggtaaggtcctaggtgcttaatatgaacaagccctgcaagacaggtatcataatctttgtctcacaggtggtgttgggaaaactggctagtcatatgcagaaaaatgaaactggaccccttccttacaccttatacaaaaattaattcaagatggattaaagacttaaatgtaagacctaaaaccataaaaaccctagaagaaaacctaggcaataccattcaggacacaggcatgggcaaagacttcatgactaaaacaccaaaggcaatggcaacaaaaacccaaaattgacaaatgggatctaattaaactaaagagctcctgcacagcaaaagaaactatcatcagagtaaacaggcaacctacaaaatgggagaaaatgtttgccatctatccatgtgacaaagggctaatatctagaatctacaaggaacttaaacaaatttacaagaataaaacaaataaccccatcaaaaagtgggcaaagatatgaacagacacgtctcaaaagaagataattatgcggccaaaaaacatatgaaaaaaacctcatcatcactggtcaatagagaaatgcaaatcaaaatcacaataagatactatctcacgccagttagaatggcaatcattaaaaagtcaggaaacaacagatgctggaaaggatggggagaaataggaatgcttttacactgtttgtgggaatgtaaatatagttcaatgattgtggaagatagtgtggtgattcctcaaggatctagaatcagaaataccatttgacccagcaatcccattactgggtatatacccaaaaaaattataaatcattctactataaagactcatgcacacatatgtttattgcagcactattcacaatgtcaaaaacttggaaccgacccaaatgcccatcaatgattgactggataaagaaaatgtagcacatatacacatggaatactatgcagccataaaaaaggatgacatcatgtcccttgcagggacatggatgaagctggaaaccatcattctcagcaaactaacacaggaacagaaaaccaaacaccacatgttctcactcatacatgggagctgaacaatgagaatacatgaacacagcgaggggaacattacacaccagggcctatctgggggtctacggctaggggagggatagcattaggacaaatacctaatgtagatgttgggttgatgggtgcagcaaaccaccatggcatgtgtatacctatgtaataaacctgtatattctgcacatgtaccccagaacttaaagtataacttaaaagtttttttaaaaaatatgtgataaaataaaaaaaagaattaaccacagtgccttgcctattcttctataacagtatctatttcactctattttattttgaagctatttatctccaagtttctttctagaatctaaacagttaacagcctgagggcattgaccttgactcttgtctaagttttacaaacaaacaaaccaaaaagcacactgcattgatatacttggccaagtaatgatgtccaaatgctacaatgtcacaaccagtgctcagtaactattagataaataagatagagtcattcactcaatcattcactcctgcatgtttcacttagtaatcttgtacgctcattgaataaattaaaagctgctttatgaaaatgttttctgttaatttgaataaaaacctttacacatcaactagatacaaaagagaaatctattgtttgacaatgatcgttactgaatcaaaaaacagtggggccatctgcagggtacagatcatgctagagtcagggaaaactggtgataaacttcagaaagccaagaaatataccagcttacaacttagcagcactgcctccacacagtcttcaggtatttattgactgtctcacactaatgcatgagtgcctgtggtaatggtaaaagtatataaatttacttgcccagagatactaattgttaaaacaaatacaacaatttaatggcaatgcaagagaagacagactaacatttacaaagctatttcttgtttaggcaagatagtagactctaaacatatattatctcatttaaattatcatttaaaaacccttagattgttagtatttacccattttaattaaaaacataactgagcgtataatttttttttttttttttttgagacggagtctcactccgtaacccagattgcagtgcagtggtgcgatcttggctcactgcaacctccgtctcccgggtttaagcgatccttctgccttagcctccaaagtagctgggactattaggcgtgtgccaccacgcccggttaatttttgtattgttagtagagttggggttttgccatgttggctaggctggtctcaaactcctgacttcaggtgatccacctcccttggcctcccaaagtgctgggattacaggcgtgagccaccacgcccagcctgtaaatcttgacaaaattcccagaggcaaaattattagaaggctgggagccaggattaaaaaacataaaatccttggcttttccatttatttcacattgcctcttcttagaatccacttctacaccaaagcagttaaaatcaatgtggatttgtattttaatagagggtttatggagtagtgggaaagatagcaaataataactatgtttattgaatactactgttcctaacattttgaacctatccaatcatttaatcctacaacaatcttttggaagtgagtgctattattattattgccactttgtaacagagaaactaagccaaaaagaagataaacatttgaaaagtcataaagctagttagccgctgtgcagctgaacttgacagcctatagcccacagagtttaaccatcatgctatattgcttcattaggttgaaaggttattaaatgaaatggcttaaacaaagttctaagcacatggcatggcacagagtaggtcttcattaaatgttagtttctgttttttctttaatctctaaaattctataataataatacctttattttcaaagtaattctgctttttaaagactttatgacatctgatttaaatttcacaaaaaaaggatggtgaatgtggaataaatcttcacaaaaatgacactgaagattatttaaaggcatagaatgttactcacaacacagatttaagagacaaaagtagaaacagtgttcacagtgttttaccaaaaacaaaaagggtatatatgcacaggaaaaaaaatgattagaaaggtatatccccaaagtttgaaaacaaattacttctagacgattgtggggattttaatcgtcctcttgtaatttatgctacgcacagaattctacaatgccttttgtatgctttctatactaagaaaaaataaaaaagaagagtagtactccttttttgagatcataatactgaggggggagaaaatcagtagaaatgtgtgagatttcaccctcagtgatagagctggaatagaattcgcactcttcatctctaacctactgtgttttatctgacccttattttctattcagtgcttaccataattgatgaattcaaaactaatctatgatgaaaacccctgaaagtgattagagagactgtgattgtaaatgtggtatcaatcactaacacaaaagtcccttataactcatcaggcttcttaagttgtttattcaaaccatttgtttctgagtccaaaccaataatatatgtgatagaccggattactttctctaattcttcactccctctctataatagaactttacatccataaactttaccatatgacttgaatgtaactctcagtagagtatgtgttaatgtgggagatgggatatatatctctgtctcttggctttgagcttggttaagtgacttgctttgactaatgaaatattagtaaacatgaaatgagcagagactttaggtattttctgcgggaacaaattctgtagttgtcaatagtttattctcctagattaaatgtttgataaacttttctaaaagaaggaatttttttttcagagagaaatatagctaacatggaatatcatgtccttttgtacttacctggagccaaagtaaactacttggaaaattaaggtaccttttgctggactattcctcatcctttagtttcttcagtccagactgggacattttggttaaaaaggagtaggcttgtgatgttaaggtgatcatcttggtcaccataccccagaaaaaatctttacatatccatgtcttagacactgaggtacagaaagagagttctgaactttccattccattgtcatttgtgttgtggagtcttattaatctgtctcatggaaggtgggaatcaggctatgaatggacaataattcatggggggcagtcaacagtagagaagaagttgctgcaaattgattaatacaaacaaaccaacctgagtacctggctcattttaggttccctccaaaggcttcagtacaggcagtaacttagaaggtaatctcagagggtaagataataataaggattgacaataataaggattggccaggatctctgagatttacacaaaatggctccagaggtagacattataaagaaatagaggctagaacatctctttttccagctctattcctcctttagttgagagtttccccagggcattaagccctgggggcttaatgtaagccccactctccccatcctagattttttgagatctcccagcattggaaaaggtcctggggcagaaggaaaagcatacttgaggtgggagtctgggttagcagagaacggcttcaggtgcagctgaagggaccatgacagcactgcctgacatctctgagggactatgacaggattctgacagccatatctgctacagaagcctgtaaagacttggggtggggggcagtggtgtataatatactgtgtagtctgatattgcatcctttaaagtatgatctggggaaggttaggctgcatcttctttattaaattatattccaaacaagttgtctcctctgactcctgcatgaagtcagactttgggacagtaaatcctacactgtccagctaagaaaaatgacatgttgttaataggcttaactgattctcttgctatgatggcaagatcagatttttagcagtgcttctgaaaatcctgacactcattcaccaattattttcttctaggagtctaatatgtattcatcttcccatatttcagggaagaaatagttgaacgactttagggagcttttcccaaaatgctgacgcatttttgcagcattttgccataatggggcctattgaaaatttttctgacattctgaattcatagcattaagatttgtggtgttgtttttgtatctggtttgtatttatttttgtttttattaaaatacaggagaaattgggacaggttaagagttgcacctaaatgtatgaagcttgaggtctttgaacataaatgagttagatatacagaaagttattaagacctttaagcattcgtaaacatttcatcattgctgacaatatctatttactttaggtaaccctgcctgagcagctcctgcattgctacaaggatgaaggtggggttatttaaaaatttaccaagctgtgaaagagttttctggagaaaactggtttggggactcagagcataaggataaacaatggatacttttatggttacaggagaggagttgataaacccctcattcctctaatgtaatgtataaaagaaaatattgtattcctggtcctcacaaatggggaggtggtagggtaggtaggttatatgaacacacatgtcttccctttgacaatgagtgggcaggcctttaaaaaaaagtctgaaaaaataaagagccctggggaccatttaggctctatcagtgagttctatcctgagatatcaaatccagttgcacagaatctaaatgtcaatatttacaaagctctttccatcttatatcccgcttcctttttcttttatgctctttctaccccttttccttcctccctattcccttgatcccctacatcattctgttttcccatttgctctcatttcctaacaacccccatccccattagtcagtccaaaatctgttcatcccgctataggcttcagtgatggaaaagaaagggccccaaacaaagccaccatccaagacaaggagctccagagggtggtgaattggtgattgaggtaaagcctggggactgagaatgttcaccgctctggaggttcttagcccgaaaagtgattaggcatcagcaggcttgatagctgtatcaagcctcatgatttcaaagctttcatgagctgacaaggacttgctaatttcaaactttctaaccaattacaatcacaaagaactcaggacaacaatcagtgagcaaaatgaaactgctggagtgaagcagccctcggcaggtttcactcttgtagctctgctacgcaatgtgcagctgggactctgcttcaataagtaaataaaaatacattataaaatacaaacatacacaatggatcccacttgctgtcttgttcccagtaaaggggtatgtaggaacgctgtcttgcattcattcagtccattaatttctgatggtgttaattaaaaacttttgatgctggtttgaatggaaaatacctcaaacagtgtttcctttattgaaacaccaagttccaagtcttggattattaggttaagctctgtcagtagtgagaccaacataaatgcttttcataccgtatgctttgacaaaagagaatagtaataataataaataaataaatgaaaaggaagaagaaataaagtgtttagactgaaaactcctttacttcaccaacctgtttttttaaggactaaactaaaaatccaggtccctgaatgtagaacatataattttaaaaaaatcttttttcaaatctttatagaacattcaaatcacccaatgttccaggacctgaattttttatattttaaaatgaagaaagctgcttaaaataagtgaatcagctgctaagtgatttctctctgtcttttcctctactctctctttaaaaagactggaaaatgcttaaaatggtatatgcaattgatatgtgcagcttaaggagcttaatataattactgaggactcagactttctatttaaaaataagatagggtagggtaacagaaactctgagtggtgagtattcatcccttgtgatggtgaggtgtgggaaatgtttccaaatgtttaatccactgagcaaggtaaagagtgcgaagcagttattcacagaatttggtgtccttctgaaaacctagggaagcctaggaaatccagagaacaactgaggaggatagtatgagagatgctgtgcaggaaacaagcaaataaaatatccatttcttcaatccaatgcttttgtgaagtattaagccaaccaccaaaacattctgattgatttttaagactcttctctaattttattttttaattactcttccctttgtgtattggggtctgaagccttgggcacccattctgagaggtcttgtaaatgtgtctcacatatgcccgtttctcttttgttttctaatatacctttctctatcatttttcatttcccaacctgtttattcacactgtctgcaatgtcatctgaatcctcgaaaaaccacaagactttctctttattccccctgaaggccttcatcactcttgttcttgttttgatctacatatctctaacgagaatgaagttctccataaaggctaagcagtttggcagaacttccttccttccctccctaaccgcaggctgtattgacctcaccctcttggatcagtttgctaaaatggcctccaaactttatgtgatatgatagtgaaccttcaacaacaacaacagcaataacaacaacaacaacaagagcaacaggataacttcagtgtaaggcatgtgagaaaaatacgcagagtaatagaactaaaactccatgagggaaatgggcctgagcaaaccacagcatgggtctttttgttaacaaaatgtatgatttttccccagagtacattgatagaggacatagcctacaaaggaccagtaaatgtaaattaactaacagatatgtagcaaatgaatgcatttaaagatgatttccagctgaaatgtttttttttttttttttctggagaccaagtttttgttaaacttaatccttactctctttcctttccagcagcagaaacatctggtcggttttagattccccttggatttccaacttcaaagggaattataaagaataacaaattcatgtaccggcactaaaaaaaaattagagcagcaggagagaatggtaaaattgtccttatttgactgctagtgacaggcgccacaggcagaactatgagaaaagacaaaggcaagatcaccagttgacaaccagagttcctgcaagagactgaatctttggctacatgcaaatatgcacagggcccttaacaatccatagggagatttacttgcttaaggaaaataaataggtaaataaataaaaggagttgaaaggtaaaaaaaaaaaaaaaaagaaagaaagaaatgagttcatgtttgcctgtcacatagtttgttgaaataataacaaataaaccaataaatgtttattgaaagaatgacctggaaataattttaaagatccacttaaccccttgggttttatttgatttaaagaaaattgtgagagttctgattctacaaagggctggataagtcatccaagaaataatacaggctcttaagagtccactaaacttggatctccaaagttcttaaaagtagtttctgtttctcctttggctccagatccttattatcaaaagatgtgacgagaaatcaaagtcttcttagtggccgggcgcggtgtctcacatctgtaatcccagtactttgggaggccaaggcaggtggatcacttgaggccaggagtttgagacaagcctggacaacatggtgaaaccctgtctctactaaaaatacaaaaattagctgggtatgatggcgcgcatctgtaatcccagctacttgggaggctaaggcacaagaatcacttgaaccggggggacggaggttgcagtgagccaagattgcaccactgcaatccagcctgggtgacaaaatgagactccatctcaaaacaacaacaaaacaacaacaacaaaaaaccaaactaactgttcagtacatgctcagtacttgggtgatgggatcatacataccccaaacctcagcatcacacaatatacccaggtaacaagcctgcacatgtatcctctgaatctaaaataaaagttgaaaaaaaaaaaaaagaaatttgtaactgtgtcaagttgtgtttgacaccactttatagaaatggatttattcttctcctctatcattttcttagcaaaactgaaacacacttctagagtgcaggtcttgatataatcagacatgagaaaatgagaacagttagagaaaatacaattttgccattgtaattacctcttacaaacagcctttcctctttcctgttttatgtgcaatgtgtacagcaacaacaataaaaataaacaaagacatgattaaccgatcaatttgtttctccaaagagagaaatagttaagggctaaagtgcctttcaataattaattataagagtctttaaacttagtattgagaggttacagatttccataccacaaatacattaggttgattcacagagtggccatcaaatacccagaaagcaaattacttttgaccgaaatgtatacatcaacagtacggttaggaatgttttcatagaggaggacagaacatacataaccagttctctatggagcctagcatagtgtcccatggaccaatccacataagataagaccatctacagagcatattcttcatatcacagactctaggtaagaagaaagtattctctaggtaagaggagaaaaataagtgaagatttctttcgttaacacttccaccatgaaaggaatgagctgactacagaaccattttcttgaatatttttgtcttgagtggggtttttatccttccttcaccactctaggtagagcagaatcaccaaagttctctcattacggtaatgtcataaatcccatcctatagcagttgtgcatgatcctgtgttatgcatccaataaagtttattcagaaaatatgtcagcttcattaaacagggatctgatgatctgaacaaaccacttatcttgcttttgtgacatgtattggtatccttaggtctaaaatgaaaatcttggttggtgggggtatctgccaaggattccctgcctcatgtaagcagaatcatctaaccacaattctgagcttaactgggggaaaggaggtggaaggtgtatcgtactagttcgttctaagaaatgtcttatagcttgaggatacgtgaggtcacaaatgtaacaacaactgaactagcaccaagagccaaagaggccaagcataaggaaacctgaagcaagagaaaaaggtgtacgcgtacatacaccaagaagcaaatgctatcattaataataattattgttattacagctattagaatgatgaggcattgatggttcacttgggtgaaatatataatacataagctagaaagaactgtgggtaaacttatggatctttttaaaaggcagtttatattctaggtttatgtgatatgagacacataatttaacaccacatataagaacaggatgctgaaaaaagtgaagaagacttgcagctttaaaatagtataatggctagttcctactggtcttttcttgtgacacctgccttagtcaagccatccgatatagttctaaccttttctgatattttaatgatgatgacaggcccagagtaaaggagacaaaataatcagaagattcagaggggaaaaagaaatggaaagaaaaaaaaagagtttgtattgtttataccatctaatctgacaaattttatatatgctctctgtttgctcaggatagtttattgctaatgttatgactttctcttttttttccatgtgctttgctctaccagttttggctgaaaatattttgtatatgtccatactgtaaaccctcatatttttctagagatttagtgtggtggggaaacttttttttcttccccaagggttaggcacatcaatattctagctactcacttttgaggccaatggaaaatgtgctcctaagattaaatagacctgagtaacacataaattcagtttatactgatgcagtatgttgcatagttacatcctgaatttctgatgcgtgtaatacacctgttggacaacacatcactactgaatagtcactgacctacaattcaaagacagtgagacagcacaagactacagatacaggttctctacagacagcctgatttgtacagagcattcctcatctgtggaactctgtgtgtaaaggatctaggctagccatgggaagctggctcatagagggttctaaatatttttagaataaactagagcaataatacaagcacagagagcaccctttgttatacaatgcataatttctttccccccaaacatgttgtttaaaaatgattcagatttttattatataattcccccttttacatatttctaaatgcctcacatacccatcacatgttttccatgtctgccaataatcttaattaaaaattataaacttttaaagccagtgttacatttgatttaagtagatttgccatatttatctggtattggttggctgtagccagactggagttctaagtaataaggggactatgctttcctttcacctcaggtaagaaattgtattcaacacatgcttaaacccaataataagtataattaatgctgtatagatctggcaggcaaattagcatcctaaatttgagtcaagtaaaaaaagtaccaaaagaaaatagttcccccaagaaacctagccaaatctgtgaaatatttctctaggcaaccaaattgccctgtggcttacagatgtgtctaagaatattaggcaactcactgatgagattttacaatcaactgttacatgttagaaaatatgatgtcaggatactatgaagaaaaatactactatatacaataataagaactatttatctgaatagtttttaacattaacgtgtaaaaaatatcctgatggatctgaaataatgatgtactaaatactacaatgtctggggtttgcttcaacataacatggtgatatagtgagaaaataacaggccatcagttagtcattgtgcaagctggtgatgagtacatgggagttcattatagtaatttgtttatattcatgaatttaagattttttatcataaaaaatttaaaaacatatactgatttgaacttttattcatttattatttgttgactgattcatttactgtttatgcaaggtattattgagatataaataataataataatgctcttattgggcatttaggttaaatgagctattcctcttcaggaatattatatatttattttaaatgtttataaggtctatgtaattacatatttcttaggttaaattttgaaagcaggacacaaaattatatagaaagtatgataacatcatgttttaaaaatatatcctcggggaaaatgagagtaaggaaatatatcaaatggttattaatgattggatttaaattatagaaataattactttaatttttcttcattttactcctatgtgtttttctaaattatttttaatgagcatgtatcattttaaaatgaaaataaatatttcttcattactggaaaagatatgttctccttccccaaggagcttttcatttactgaaacagagaaactgcaaacacacagcattgcccagatagtttaaatctccatacctagaagggaaatacacccacaggaaaagaaacgtcaatacagattttatctgatcatagaaacataaagagctttctctgtgttggacagcaatagggaagaaactggcttgtttgcaagccagcaaaagcgtgaaattcagtcctttttgtgatgagatcattttgtgataaatgcaaaaggagtgacaaattaaagtcaccaaataagcctttcccttgagctcctgaggcttactaatacgagtttcttttggggtagcatagcaagtaaagcgtgggagtggggagggaggcggagctacaatcccgaaggctcctggccttcactggtgagatggatatgctcagagagacagagatagatgtgcaacagaatcagaaacaacaacacagtgacaactatggattatgcacaatggatatggaaagtctctgttagaaaactatctttattaccccaagagattatttccctcagtttatgcacgttcatataaagcgaagtcaagagtgtaacttttaaaggtttggatgaatatgatgttcatgactaaacaggcctagatggagccaggcagaacacagttagatgccagggaagtcacccttttcctcctcctccctctccagtacagttgccagtgcatttcaatgcaggtcagcctctagcaaagtcagctgtttcaagctctgattggataatactttatctatacacccccagtcttgacctgcactcttctcccagtcatggaaatatcaagaattctagaaggccacaataccaatctttttgaaactttacaaactttacaaattttcactacaagacacctagaaaaatcttcaagcctatgcttacctgtagccctggtcttggtcctcttacttaactggtaaaagaggatagccttatttatgtctttgaagggtattttccttttttgcttgttggtaagtacaagagcaaccatgtctaattttaagattgatccaaatgaagcaaatgcatttcaaatttacagaataccatagaatactaatgggtagttcaaagtatcactaaatgtgtttggagggttttgagttttttcaaaacatacaatgttccacacaggaaacatcagtgccaacttcaccctatcactctttctgtccactcaggagtctcctttggaaatatatctctctggagggtcttccaaacaaatcctttgaatacttccatcttgtttagcagagtattctaaaatatttgtcaaaatctgtgataataggttctggagatcatgtttcttattcttctaaatgctggtatttcaaatgaacaaataggatattaaagatctgtcctttaccaatgtcaaaatatgttctgtcaaaatttagtattgctaaagtttagacccaaagactcaccacagcctttggatctcatattttctgaggttcatggaaagatatttgacttctttgcacctcaatattttggactgccatttagagataatgagagttacttaccagacagcaatgtcatgaggaatatcctgttagtaatgatgaaacattctgaaataaaaagagtacaggtaagtgctaggtatttattttaataaatgtatgataacatggtaatcatagaaaataacccatttattcctcactttgggatactgactaagtggtagtatataaaaagtaaaggatgtttccctttgggaatggaaatagaattgtgcactaagaaagtatcttttgtaactgcctgcatgtttaactttaaggtctctaaccagttgcaaccagttatgaatgacttgctgcccatttctgcaattcactgtaacttgtgttgagaaggttatgttttatggttaattatccatggtctgtttaaaaaaataaatcaaaccactgtaaaccactaggatttgcagctccatttgagctttactgtagttttgatcaaacattttgtacataaaaacaagctggtttctctttgtttttagttgtttgttatttgtgttataaatattgtggcaatggtgggagaataagctatggattatttaccctcggtttcatgagttgtgagttattggccttatcctcctttataagtataaataaatgtataatattatattccaagtcttgtaagacaaatggaacgagtgaactgaaaccttttagacccaaaatcttttatgcgaagtcatagaacaacaaaacaaaacccaaattaacatttaaaaagcttctactgtggagcaacaaagtctttaaatattatataatctgcatttaaaaaactgctcatctaacaggcagcagtctatcattctacaagcttttcaatgcctttaacattcagaagctacaggtggttttcccaaagatcactcagcacccccaatatcactaccacaatgaaagccttgaaaatggccagcatgattactttaagccaaaatggatttagaaaaatcaggaattcgtgtagctaaaagtaatgaaacactgtataaaagaagaaccctatagaattttttttatagttaccatcctaggacttatataaacaaaagaagtccaaaaacaattgtccagagaaaatgagaaaagccaagattcaaaggaccctgtggcagagtgcatgaggagcatactcgatagctagaatcataagtatctaacacatttgcatatgaaacttaatgaggatcaccaaagtagcttgccaaaaattatgtttgttaaatcagccaacagtctatgtagcacagacccctaaaaagaacctctaggaaagatgtaaaattgtcttctgaaatttgcttcttttataaaggcagaaaggataaaaaggcctttctcataaaatgaagtgattggtccactactacagtctgaagagttctgtatcagatttcttcttaccctttattacttgtatggcttactgcttacctgcatcagcagtctgcagggttggccatagcaggtcccttacgagttcactgaaacacggaaaatatttatgatggtactattatgtgccagacacaactggatggattctgcttgaaaaggtaagtcagtaactgaggttcttgttgccacattaaaagaaaaaatctatccctactgccaacagcaataagaagagaagctagggtgaaagagttgtcaaagacttatgaaaaattcgaaactgtttaaaattctccctagcttcttttcttgcatgtccaagtaacagaaagcttaggcctgccacctgtcttaagcctggatcccatattaaaaaaataaaaaaaaacagaaaaatgagaaacagctaatgtgttcccaaggccttggttacaacagaaaatgagagccgagaagtctacattggcacacatcgagatttgaaaggtcagtcctgccctagtatggttcagagaccgtgaaaacccaccaagatgaaaatggaagctattctgacaacaagaggcagggaaaaagttcaaagacttttcctctgcttcttttataacgagatactttcaactatttttgacaatcaataaaatgcaaatctccctcacttttgtgttctaagttttttttttttaaatttaaacaacccatttgaaaattagggtactcagaataacttcttgtatacagaactacacatttaaaaagctttgtgcagattgttaatcatattaaaattacatcataaacaatgcactttacatggtgcaaatgttttatgtttttttcttttgacaatcaggcacctacatgcaaaactgcatattggaatccaaactcaactataatacatgtagaggaacccttagaaaaatgcatgtgggaatatgatatcccagttagagactagaatattctgaccaattttcattatttctctgtaataaatttatctgagctatagatcctgttaagaaaataaagctaaatggaaaagtattgataaaatacattaaatatatatatactagcttagtcattattcatattaagatcagaaaagatttccgcaagtcatcacaaatacagagatgggataataccaataatctcgatcacccagttgttaaaacagagaacctcacatttgggcaataatagttttgatttttatcttgtgcaccagatttttccatacaaaggaattctaaattgcaatagttaacacataagacagtgttaaacaaattcataactttagtaaaattaaatgaaccaatttcttatggctttaatatccagaagtaaagtatgatcttaaagaatgatgctgatctgagatacaaggagatcaagcgcttcaatagttcctcctcacacactaatgatcgcatccatcctctcttccacccacctcccaccttttctggttgtattaaaaacaatcaaaactaccaccactgctgctacccttcacacacctgaacttaatttcttctaagagatgcctaacagtgcctagggctgtgctatcactttatatccattttatgaccgcttgagaggcagaaactaaaaaggaagaccaaaacaaaacaaaaaatccctccaacctcccttatcagacaaatgcctggttcccagaggacaccagtcagttaagcaaaaccaaatattacaacagggatgaaggacttataaattgcatacaaatctcactgtgctcccacttaaggtggaaagggagttactccaatgaaagaaaagggggagggggttgtgggaaggagcgaagggctacagaaagagcgagagaaaaagagagagagaaagagagagatttattgtacatttgagacattaagaaggcagtacagtgaaaccaaaggtgttccagggagaaatgtgacagaaagctctaaatgagaattacagaaactattccttcttaaataaaactgttgtttagatgatgaattctataggaagtctgaattaactgtctctgttgtagcatctagatgttttctctttcattaagactttggagtttgaatgtactttgttaaaaaaaaaaaaaaagaagaagaaagagaaaaaaagaaaaaaaaaaaagcattagagctttatatagctcccaaagtaaaaagcaagagaaagatgggtttatataactggcttttttacataaatattacatcaggatacatttcaagtgaaaacacacaaacacacacacacccgtcttccttatactctttctattttaaaattcatttcatactttaaatgttgttggtttttcacaaaataagtaaaaacgaagtcaaaacatctcaaaataagttgccttatattacctggaaaattaacccatcatacaggtcacgatgtctcatttaaagccagttaaggtgctgacaattatgggacattttgctgcagcctagggcaactagaaagggccatggatgttaactaactcccttttaaacagtctgagaaaagggaaaaaaaactgtaagtttccccatctgttatttccttttttttttctttttggctgtggaaaagtaaaattatgcaagagcttttgaatgtaaaggctgtgtgtgctttttccctttttgtctctgtgtaccggttaagtgatgttgcgtaactgagtacagagtaggcggttagcgtttactattgatttacactatgccatctaatgaattcagaacactaaaaagaaaggagcaggagagggagggaggaaaaagagaaagggagaaatagggagaggaaaaaataggaatgaaggagaggaagaaagagcttattcagagaaacagttctaatgactggaataggttcatttttattcctatagctctgacttttggttattgttcagctctcacaaaaaaatggtcttgagctggtgaccccaatattccaatcctatttctaataaggattactggcaggtgaatgcctgaaagttctaatgtgtcaaattacttgaaaccaatttcactatactgtcagactcctccatatgcatctatttatgattctctctatgcatttgtgaatctgtatctgtgatcaccatggatttggtcctactggcttacccaatcaaaaatattatttgaaatatatcacgggaatgtcatcagggtaaagagaaatacattctattttacccatctcctttaaaaatacataaagaacacatttagaactttaaatatatcactattttactttgaaaacagacatgctacaaattgtttggctgaacaaaacagcccaatataggataataaaagagaaataggcaaaatgaggaagaacgctaaattgaggaacaatattcataaagaaatttaaataatttcttatgtctatggagagccttttacttttgtttgggtggaatgcctgtagcattctcagtctttgaatgctgctcagtgcttcccatgccatataatgaattcccaaagcgtggaccagaaagaaagggtgaagttgtttctgctgctaggtacaggtccttcctgtacctgagtgccctcctatggctgagaacaaccactaaggtgagaaagagaaagagaagttctctttagtaatcagctgaaaagctgggcagggaacttgatttctccctcaatgtgtgtttgcaaatgatgactgggaaaaatcacaggaggttatccaaaggaaagaacaagagttggggtttctagtcatccagttgtcttctcttttcagccatctgagcttagaaaatattaaacagatgcgtactctgtccacttgtcaaagatgctttaatgacccatggtggtatgcacacagttgtatacctagcacttgccatggtgcttggcacattttctatactcagcaaatatttattgaaactgaaaaatgatgatgggagaaatatctctgtagaaagaatgcactagaaaggcctgaaaaaatatattccgatgttttacaagaaatcttaggctatattgctctatcattaatctgcacacaaaataatactgtaagagaaatatcaggcagttatttaggggtcagttgacttcagttccattttattaggaaaaagcttaacaaaaattataatactgataacatcagcaaagttttgtgttcatttccaccagcccttttgggctgtctttcatttcagtcttgggcacagaaaagtctattttaatttccatggacacattctaaagaaaaagtcatgggatatcaacgtaattcatcttttaaaaaatactgagacaaatgtagccatttagtaatggaagagaatatggctttttgttgaagggcaaggcaggtggagttttgattaggttacacaaatttaaattactagaaggacaccaagaatgtactgatttccattttcttggttaaacagtttttttttggaaaaaaaaaattctggtttagaaagtcagaaatgccatctttcagttaattggagaataagacctttagaaaaagaattgcaactacaatttctcaaaaattccagcgaagattcaacttaaagcatgtttagcaatagtagccatattcttttaaaaaatggggctaccatcttgttaattctgtaggactgagcatgtagatattagtcaaaaccttcaaaaagttttttatttctctctcttggtcatctatttaatgtaatcggattcagcaacttccttcaataagcattctggcaatatgtcaacaagatcattcatttcatgattcttaaaagtggatgagaacttacctgttcttcttcattttatatatgaagattctgagactcagaattaattttctcaaaagcatatattttgaggcagagctgggactagtatctaaagctcacagttcatttttttcacagcacagactaaatcaaagttgtataaattcaatcttattttaaatgccataggggaagatttcaaaggattcttttataagacaaggaattcttacattatgtaaaatgttcacctcaaagctatcttatacttttttttatcttaaatgtgagcctactgttcaaattgttgcttctccttttccttgtcttaatttttgactctttagagtctttgcctcctgtcctctcacttgtactctgtgtctagttcatatatggcccttcctgacttcatattcttccttctctctctcttttcatctttttatcaaacttttatttattcttgttcctcacagaaataatttccttgttaatgtgatatcctcagaaactacaaaggaagaaaaagtgtaaatttagtattattataataaataggcctttggtttatatttaaaacaaaactgcaataagatattgacaaacagagtaaactacagctataggcttccctatagaaagttacagctgtctagacctccatattatcaatatgaaaacttgggggctagcatttcaaagtatctcatcaaagacagagagcaaaggctcatgatctccagaccactcattttccactacatcaggacacctttcgtttcccttttctttctttccattctacattattgatatttgagactgattacggcacagcaggaggagattcagagaaatctccttggcttaatgtggtcaaactctctcaattccaaaaaaagtcagaaagacctgcacactaaaattgtagttacacagaaaaagaactctgaggaggttaaaagagtcctctgacatgagaaagtagtctctggatagcagggacattgctgccaaaatcattgtaattaagattgggtcattgtttccattataaaccttatgcttatggggtttgtaattcagttaaaatgatcagctgtaggctgaaatgcagccccaagtatcttagagtgggaggtgtttctcccctcctatttcttaaaaaagaaaacacatagcaactatttaataatttcaatgagagttgtattctgacccttcccctacaaagggtagttaatcaatgagcttaatctagagtgagccaaggtgagcaacatccactgtggaatgaagcacattaacctggcatatgaatgggcaataaaaggatttcctattatttcataaggtttaatgtacatcactccattccactgtattgatgtgaataggctttcagcaacaccgtgttgaaaaatctcccacttctgtttgttaactcattattgtaggaaacattacaattataggagacaggaatttctgatggtttccttagatttctttcctcataagctcattcccagggtcagtattagataatcaataatttctaaaatttcttgctcctatttctttagcattgtctacaatatctgatacctatagtgtaatgctatgtgccaccatgatgtagagggattggggaggaaatcatagctatatattaaaattaacaggccagaggaaactggtatttactgagtacatactacatgacatatattccattaatattatttcatttaatacaaacctgcagtgaagtagctgtggcccatgttttatagattagcaacatagttaaagagctgttagctaacctgcgtaaggaaacagagctaatttaaaaagttgcgaagtgaggtttgaatcaagatctgtttgactcccaggcccatatgtactgcaatgcaatgcaacaccaggaacagaatatgaaaccatctaactgaaaaaaaaaagtctccatgccaatgatgagagctacctcatgctccaagtaggaggtagaaagggtaaatgactcctaaaaagagattcttgctttgctcttggctctgataaatccctgtttattcatatgcaaatatccaaatgcatatttggaaaatgttttgtcttagataagaaaatgcacaatctcctagaaacctttaaatgagaccagacatttgaatgtttacaaaaattcctttgaagatttatattaggagaaagttttaaaacataatgcataaaaaaaaatcagatgattggctaggcatggtgactatcgtcaccatgggagtcgctttgggaggctgaggtgggtgcatggcttgagcccaggagtttgagaccagcctagacaacatggtggaaccccatctctacaaaacacagtgaaaaaaaaattagcaggcatggtggcacgtgcctatagtcccagctactctggaggctgaggctgaggctgaggattgattgagcccaggagaccgaggctgcagtgagccatgatcgtgctactgcactccagtctgagcgagagaacgagaccctgtctcaaaccctccacccccaaaaatcagatgattaatacaacattaacatttcaatctggatgtgtgtgtttgtgtgtgtgtgtctatgtgcatataaacctataaatatacacatacacagatgaatttttttgtctttgtcaaaatttctggtaattattataaagtatttgacaaaagctaaacagtaaatatgttacaccaggagaaaaggaaacaaagaacaagaaaagaggagtatgtgtatgtacatacttccctcagaaatctaatcctaaaacattttttaagctaaatgggacatagtgctttagtctaaattgtgtgtgtgtgtgtgtgtgtgtgtatgtaaagataaaggacttttactatgttattttggcaagtgattatttttctaaaatctttgctgaatcgttttatgtagatatactataatactcttgaataaataaatacttgttcaagttaaccttagagctcatcaggtaaataacagaatttaaaaaagaatctgtagtctgaaacactgtagagtatgccaactttacacattacattaagtattcgttcaaaataatttataaattgaaaagtatactccattttattcaaacaatgcaattttttaaatgaatcttacacaaatttgtgtgtgtgtgtgtgtgttagagagagtgtgtgtgtgatcctcaagaccactgagtcattctttaaaaatattttaaaatcataatttggtgaagaacttaacaacaaagtaactgaagccagatttgagagaagaagaatgaacagttcttcaggaagcaccaattcattccttaacattcaataagtctttattgcttcgcccttccctcctttttttcctctagtctaaactctgatttggagcagaagttaggaggaacacgtattctggtccctcttctctcatccctgtaaggaaaagcaatggtagactaatgacagaaaaagcaattgcaacaactttggcagttttgtggtactgggaaaaagcaggctttgtatttgtacatttcaaggaatttcttcaaattttagcttctttgaatgttcctacaacaagctgaaggggagataagatctgctagggaaatagatgaggtttagagagggaaaatggagggactactttttttttattcaaatagcattcaaacacatgagcaagatataacttgcaacattaaaaagtaaattagctagctaaaaataactcacaatacccttctcactaaaacaaaataaaataaagcaaaaactcacaaccaattattttgactggtaaaaacagacagtgatatgaaagtaacagatggaagcccagttttactcacacaacacactcactaaagacaattgcaagtgtccccatgacaataacttaacaatggtcactttagcctgagatatctcctttaggtgagtttccttaaagacttcagaggggcttgtagaaaatactgtagaacgaaaccaactcatttgtctatatgtagaaataggcaagagttgcaaatcacagcctgtggacgaaagggatccaggtgtcacatttgccaaatctttttgcaagactggaatagatattcttttcttatttattttttgttgtatggcagtatttttaggagtggtgacatttctgtacttttaaaaacacaacactacacagcacctaaaaactttcctaaatcaaataattaacagtaataaatcttcctgctaatttctcctcaaagttgaaagaaaggttattttcttacctcacactgagccttctgatatgacagtgtcattcagtcaataatttcaatgtcagttactgatttctaactcttttattacaaagacttcaagcaataatgaaatggtgctgatctgcttgctttcactctatataacgtctatatttatatgcttatgcttctatttggatctatatttatctgctttatctgcctacagtgcatctgtttctcatacacacagacatatatttatatatatacacacatactgtatatatatatataggttatatataaacacacatacccacaaaaatgtatgaatgtatgctagtgagcttacttcaacaaccatgcaggtgcataaatattcaggcacatgacaaatatacaaagaacataaatgaacatgtaaacatagttacacaggaaaaagaatatcttaacaacagccctgtctgccatacttggctgttggcctttgagacttatacactgttgaatgatatgtcatagactactctgagaagcagaaaaatcttctgaaggcaaaagtatatgactaaatcaagataatgaattctaactctctcattttcgcaatgaggagtctgagatactaaggtgaacagcaaagattttacagctttctggaggcagagctggaagttttacccaagtctctgcctgctagacaaatgctctttctactactatgctgaattgaaaggatgaaaacaattttttcaaacccaatatcattattttctaattgccactctttcccatttttcccttttcttgctgtgtgaaatgtaaacaaacaacattcactcagggtcaggcactgttctaaatattctatatgtactataccatttaatctgtaaaatatctctatatagtaggtattattattcaaaatcttagtttagtgaattaaataactcactcaaagctacacagctagtaaggaaaagggctgagctcccataatactcaagacccatgtttttctcacttaactatgatgccttccctaatacatatttgtatataatactaacccttccctcaccaccacagcctgatagtcttagaaatctaatatttgatctgtttcagaacacataacaagtttaaaggttctctcagcctgaggaaaaaaaataaagggaagtagagcaggtataagttacatccctagtatgcagcacatgccctatactagagaactgaaatatgcaaaattcccccccaaaattactccaatgatagtgtgatgtgatttaaagccttaataacttccagtctatgaacattttatgtcttttgcaaaggattatggcaaactgataatatagaatcagattggaaataagaccacaagaaggcaaagggaaaatagcaaaaggaagaaagacccacacccacttcttcttcctctcttggcacaacacttccaaaaacaaacacccattaaaaacaacaaacccagtatcaaaatttggtatttttttccccactcaagtgttagagacaaattcagaaaagaaactaagtctacgtatggtaggtagttttatacaaatctcttcagatagtaaccagttgtgagccatccgaacacggaggaattttacactttggccagctaacccagaacccagcactgggagatgtcatgtggatttgtgaaactccctggggcatactgcatccataagccaaagaacagaaattatactgatccatacatgcagctcttcatctgtgccatattgataattactcttcatttgtgaattaaatcctagttataaaaacaactttcagacatttgtcacaaatggcacattttacttaactctttcataacaccatctagccacggtctataggaaatgggagctaccatactcccatataggtcatgatattataggaagaatatgatgtagagaaagagagagagagagagagacagacttgagtttgaatcccaggttttccatttattaacaataaagctgtaggcacatcacttaaatgattctgaaacctcattttcatcacctgtggaataaagaataaaaccacctattttgcaggaacgttgtgaagattagagacatcccagcacaaagaccccctcataaaagggggcattaaatattaattattgtatatttaagaagtctatttgtgtgtgactttctcttgtattaatgatacataaatctgctgggagtaacagaagatgtgaggtactttttatgcttttttaatcaaagacaaactttttggtgatcacatgtgttccatgtaaaagtggaaataaaagcatatcacagtgtaacattttcagtggacgattttaaagcacttaataacccttgactttttgtgattgctggcactctcatttaacagttgggcaaaatggggttcagagatacatcctccaaatcagtaataataataaagaaatcaccagcaggggttagtagaaagtctgtttttaacatctaaatcccacagtgtccagctaaggaataactgctgcaaggtcacagatacaaaaggccacactttccccaaagctctttgagattattcactgaggccaaaacattaggtaatgctgtgtacatctgctgagataacaagggtgagtcagggttaggtcacggtttcaggttagaggggtggggtgaagagtggctttcagatcaaatgacgagagtagtttaatttaagcaaagaacaaaccatacagtattttaagtaagaggggaaaaaaagggggtgcaactacagccaagagaaggtgggtgggaatatagaccctgtgggggtcaaatgggtaactgtggctcaaagaggaaacccacccacattcacacacactgaaaagcgaacaaaaagcccagggtgcagcataaatcctgctatcccaataacacacacagatgttccaccattgttttcttttatgcacattttaattaagagatcagaatcaagcattaaaatgttattaaatggcttgtttacatttttgctatatgtcatttataatgcattttctaaatgtgtgtatatctattcggaaggactatttggaatttttacatcagtgctacaattgtcccactaactcacagtcatttttgctaaccaaatatgtgtcagaaatccttttcagtttaagcaactggacaggagctctcactctttaattctcagtcaagcaattccctacccccaatcacacctcctttaagcatgacaaagtccaccacagtacttcaagacaataggaaggcccaggtacactggcaacctttctgatttttcacaagagtcccagtttcaaatattctcccattgtgctcacaagaaaatagtcttcatatacatgcccgaccctttccctagaacagttttgaaaatgtcgggaactcaaagctaccacatgaaggaccctgacctatgagtgtcccctggaggggacacagtggaagaagcgggaactagtagatttttttttcctccccacaatccatcttctatttgcagtctacaacttatccctatttgcctgggcaggaatttgagttctctatattattctggagttaaaacaggtatgcctttcccgtctctcagattccacagatatcatgactgatgcacacaatccacctgcatatgtggatcacaagtatcctgtagtctgctggcaccatataacttaattacttttaaccacagggcattgtcctagaagcccactatttatattgtaccttatcaatcatggtacttggaattgcaaagtctcagaaagcaggaatcatatctcctccacgttcagttcaatgcctaatgcattgtgagtgttcagttaggacaagcaagagaggtaaggttttttctttctttttgttatttgtttgttatccaggataagcagaatgcttgtacagaacatgcataagaaagaaacgcaatctaatctcactgtcaatttatattctgtaaactgtctcatttgcagcataaatgactacaaaaatgttttggttactctaagtgttaaccttaaggtaagagttaaattaagtctgctataactggtggaccagaaaggactcagagaaaagcaacagcatggctttgaatcaaatcacttttggaagaaaactttaagatgttaccaccgaaaaaataaaactggcaaaatgctctggagggcatcttagcaatatgcatcaaaaatttaaaaaatatatgaagactgttgacccagaaatctcacctctaggaatgtatctaaaggaattactcaaagatctacacaaagatttagaagcaagaatgtttaccatggcattatttataattgtgaaagactggtaaccttgtctgacaatagagagttgattaaataaatgacagtacattcctagacttaaatactatgcagtttaagaaatcatattttagataccacttaattacatgaagaaatgtttttggaatactgttaagtgaaaaggcatataaccaacaatatatgtacaggaaaatatattgtttaagtaaatattgctaagttaaatattgttaacttaaatattgtttaagaagtgatagttgtgtacacacaaagtgcaaaaagaccagaaaacactagaagtgcttgtttctgggtagagaaattataaataatttttgtttatttgaacttttccataataaaagcacatttatttcatagtaaaatattacttaaaatattcatctataccaaccttccttctctaaaggcctaaaagtgaccctctgtaggcactcttttgtctctagaagtcttccttctcctgtttttatagatgtatgtgttgcattctaaaatcttaagtatttgggactatgtagttataaaagataccctaccaattaaacaaataaaaaatcttattaaatctgtggttttaatcttaggttcctgcttagaaaaaataccaatttctctttaagtcctatattttgctttcaattcagcctccatagtattaattagttatattatttaggcctgcagcagaacagtttcatagttcttctcattctcacagttctttgtaagagacaccacccctctcatggttcttactcacccctacacccacaattgaccataggtaattgtgcaagagaccacaaatagaaagaaaatgaaggaagccttaaaaggccaaggtagttccaagttataaaacagagaaaggctgaaaatttaggcagagatgtggagaaaatccgagccatgacacttaagaatgaactggagtaaagatccatgagcacctggtgcagggagagacaactctacctatcaatccagtacatgctactcacacaggactattaattctagtaaataaccacagctttaggaggggcaaatgttctggaataggctgcctgttgaaaatacaagtgctagggcctttccataacctataatcaggacttccagaagtaatatccaggcatcttcattgaaagctccaaatgtgattctgaattatactagaggtgagaaccaatgggctactggggaagttcaaatcccttagctctagccaacttttataaattcatctcccttaacttcacaaacatatacactctgctgatgctagaccggtgtccttgttctccatccttgctccgtcataaagagaaagctagtttatgtctttgtacaatctacttatgactttatatcttgaatgccctgactgctccttactacctgtttaaatcttcactaattccaacaatgggttagagtttcaccttcctatgaattcacattgatttttcctacacattaaactacagaatctgtgtcttcccctatttctactcttacatcaatatgaaacaataatttgtttgtcttacaactcaatatgatcataaaccatatgtgcccttagaaagtgttcacatggttttgttggtacctctttgcaatgtatatcagggaattttaaaaaatagcagactgaattgagaccagtacttgcatgttcatcatcatataatatgggacatgtatatttacctccaaacattctcagagttcattcttcgtaccctgtaggcttatgctgtaaagaaaatacatatgcagaaataaaaacagagtttgaatctccagtcctaatccttcctctgaactcctgtctcatgtatccaactgcctactacatctctttatttggaaaagaatttcaaattcaacattctccaatactaactcataatcatctctttcccaaatctgctcatttctccatatcccctatagctcccaactccatgggatattgccatttatccagtggctggggtgaaatgcctgaaattcatcacacctgatgtctctctcatgtaaaaccacattgagaccctcagcaacttttgtcagccctaccttcaagttatgcagagttgaaccacttttcatcccctccccactgccattgccctttgcataactgggctactatgataactactacatgctcttcctgtatcaccctgaccctgtagactgttctccacagtgtagccctggaactcttttaatatgtaaatgagatcatacatgcttaaaaaaatcctctatagctttctgtcagtctttatcatggcctgtgtgagctggtccctacttatctacatgatcattcttactttggtccacttgagccacacatttcttcttgctcttcctggaaaatttcaagttgttcctactccaaagtctttacaatatccatcccctttccctaaaatgttcttcctgctggtcaccacatgcttaggttcttctaataatttaaatatttgctcaaatatcttccactcggtgagacctttcctacttaccctatttcaaatagcactttctaaattatatatccctattttctacctccttattatgcattattttcttcctagatctgatcattatttaaaatgatttttttttgtttacataattattggctgtctctccttccactataaaataagtttcataggaaactttgtttaatttctcactatattcccagtaattagaacaatgtctgaaacattataggtacttgatagctattaaatgactgaatgaataagtagatgaataaagtgttccagtacttataaatctcatcccagtcacataaactttaaataggaaatctttattctgcatggtgcagcggcttctctggattgtcccagaggcctctattctttccatctgactgcacaggccagtctgggaaaccacctacatgcaatagctcacatgtcttataataaacttcttgggaggagtaagtcaaattagatagttaactaaaaatagtatctctgagtttataaaggagacgttttcccagcccaactggtcctggtaagttagactggcatcaaatgctgacatggcaatcttatgcttgatgaaccctcaatctggagaggagtgagctatacttttatactatttattttgtgaaagttccaagtatagttcatctttgtatccacaatgtcaagaacattgctgagcagagagtagagcttcaataaatgtttattaaacagatgaacaaactaatccatgaagcaaacaacattctaagtgctattcttctatgtctaagctttgacgatgcgctatataaaattcattcttgcaattttccttcatagattagactgaaaaactcatcgtgaaggaccatgtcttatccatcttgtatcccaagttcttagtacagtgctggatgtaaaaggaagaaaaactccaaagcaaaggatagagaagttagaagtcctggcagcgatcagtgagtattaaagaatgccagtatgacgtgattatcagatgttaggtgatgaaaatcatgccagctaacatatggatttctaccctgtttctgtataagacttgagctctaaatttagttcctgaacacaggggatcagagttgaaggtgattatttactatgaaactgctattttccacagtatacatgatcaaagtgctagaaacttaatgcatgaaaatctacacttctttactcaacctctcttacagttatataaaattctttagaaaattaatgttataaaaaagagttcaggccgggcgcggtggctcacacctgtaatcccagcactttgggaggctgaggcgggctgatcacctgaggtcgggagtttgagaccagtctgaccaacacagagaaacctcatctctactaaaaattaaaaaaaattagccgggtgtggtggcgcatgcctgtaatcccagctactcgggaagctgaggcaggagaatcccttgaacccgggaggcggaggttgtggtgagccgagatcgtgccattgcactccagcctgagcaacaagagtgaaactccatctcgaaaaaaaaaaaaaaaaagagttcagtttgttcactaaagggctcaatttgttcactacataaaaggatatagcagtttgttcacgaaatcaaagccttttcaaatataataagcaatagaagaggtgacaaaatatataatgtaactattaaatcagtatgccttacaagtatccatcatggttatagtactaattgccttggtttgtccaagactgaggagggatgtgagcttttccgtgttcaaacagagaaagctccaggctagtcaggacaagttggtcaccctaataatggtataacctgctaagctggttatcagctattccgatgtatctatatgtaggatctataggtacatgtagaatatatgatagataactaggcattactaggttataagatgattaagaattaatcagtctgtactagtataccatatgaagtgcaaatcccttgtttcattttctcttcatttcccctcgatgttggacttcttatgtttttatatcgtatgcttatattgattttattatagtcaaatacattaatttggggtgttaggacaatttcattttcttcagaagaaaaggaaaagtgagtagcagcaatgcagatgggtctcaattgacgcatgagctcatctgttttttacaactccaagtgtggtaattccccgtagaattaaaatttcctaacacagaaattaaaattttcctagctgaaaatgccggctttttacatatcccaaaactgaacacataaagattaaactccaaaagtaaggcaagatctacagaactatcccagccctaattctgccgagatatttattataagacaaactgagacagtcccctgtggtctccttaaggtcctgatggccccctcaaagcatcatctggctttaagagaactccaaaatagtaattggtctttgggcacagaatagccattggaatctggattagagtctgaaaaacactgcattttccaaagagattacaatgccaggctttgaacattgaagggtaatatcttctttctaagtatctctggtcagtctcagtaactagacctacttttgaggctccatttcttttatgtcttttaaatttaatgataaaaaagaaatatctaaatttataatatacacgaaacagtgaaattaggagaaaaaattctatttgatgtgtccatttttttaagctcccatgactaaaaagatcaacagttacctacatttgtaatatttatgcctcccaggctcagtgtaatgagtttcatctctgatcgaatttttataactgactttcacttacctgtgaaataggtaataggaagccttggtaggtgctttccctaaagaatcagatgcaaaagttagacctactgcaaacaatacagaggaaaaaaatgtcactctaatatactactactatatccgtctgctttttgcaggaaaggaaagctatcatcctagacagaaatactgaaataagtgaagtacagacaagtgattaatcaaaatctgaaaatcatagtcttcagctttttcttccatgaaaccatggtgtgtcctcttaactttggccaagtgcccagctaagagaattcttccatgagatgaacatgcttcagggcaaaaccttattctaactgatggttttaaaagcccaactctacattctgctcaaggctttggttacgtaggtaagccaaaacacaggagacatgacttcctccattaaactggctgaagcccaggttacactaattgagcctaaatagaaaacctctgcttttcaatccctttgttctcttggatgtcacagcttcctgctctattcgcttccttttatagtcttctctcaccaagcatttcaggaaaaaaaaaaaaaagctaaataaagatcacagcctgttccattgtgtccccttcttcttcatcatcttcttttccatgtgtgcaatgttgtggcacctattaactaccaatgttttcagaatgacattatacaaggtgcaggctgtaccactgtgccctaaaaatatcaacaactgcattagtctcacaataattaatggcaggcattatgcaaatgacaactttttcgctgcaaaataatgacatttcttcattttgagcagagttatgcaaaacaatgaatttaggatgataaatcacacaggagaattaagaaagccataacgttcctgcccaggcaggcagaaagatagacagaccaacaatttagaagacattgttttgttctcacaccactataaaaaatcatagccagtcggccattaatgtgtgtaggtttttttccttctcccctttaggcaacaatgcataaggggatgctaaattctagcaattggatcattacaagtcacaagcaaatttttctttattaaccttaataagtcattcactcagagactatagtcatcaagcaaataaaaagtatcacatgccattctgctacacattaactaattccttatgcaaacatcacaacatatagcaattactgccgctcaaaaaaacaaagtcattttcaatttattttattgcttttatacttggccatttcctgtagcacattatcgtttctttccctaacaacccgaggtggaatgaagaagaatttcggtagcaatgagccccttcctctagccacctttgtcatacctttttcccctccgggaggcttttaaggaaggttagggataaggtatgtgcacgctccttcacaggaaatgtgcatcaagctcagagaaatggtacattcagctcctattcttgcagcaaagagagtgtggggtaggcagtaagacccaagtctgtctcccacatttgctacaataacactgacagctttcctttattcagtaaaacaaggtaaaagtgtaggcttagacctgtccccaacaggtgaacgttaaagtcaatatatgcaacgttgacctgagagatatagtaatggttaatgagaattatgaggttacttcgtcttgcttcactcagcacataacttgtcccttccagaatgctgaatgaagagcaataataaatactggacactaccccacaacatgcacagtattaaataagatctttgtgtgtgtgtgtttttaattctataacatcctttatccaagactcccaggatgtgaaacaaatgctaaacaaagcttacacattgctaacagattcttttagcccattttacagactgacaaatggattctgagcaactagaggctttacacaaagttggactggaacaggtcagactatctttccaatgttctaacctctgaggcccgtggcctcttataatcatgagcattctttcctgctgataaacaattatgctgtaaacagcctgtacatgtcccttttcacacaacaggatgataatctctctccgttctcctaaatccacaatccattcccccctttttaaggtagaacatttccgaaatacacacgggaaaagctctgttttcagtttctcctcctgaaggtaataacattttgcagttctccttaaataaaatccagcccatgctggatcaataagaatgatgcccatttccctaatggcagccgattgccatttgctattcaaatcagactagataaattacagtacatgccagggaacaggccagtgaattaagacaggcctccagaggaccagcgatattattaatcttttaagacactatcatatttcttcttgacagtgtgcgtagactcacagacacactgcacccagattgaaatatcagctgctgaaaaaaatcaatagtgttagaaacacaataatttttggtctgcagggtctacactaagcaacacttgtacccctcctgtgccatctcttctcccacttcccctttgccatatttgcctcctacctttttgctcttcccttttcattctctggttttaaaagcttgtaagtccaaatgacaagatattatgagaaggtttccactgctaacactggccattgtggttacagcgttgatttttcatgggttgtttgaaatgcaattttactagtctggcaaaatgttttggcgtgggattgtttttcctatgaacttaatatagattttcaacccttatgcacttggttctgtattatgaagaaatgaaaatatttataggggtggccatacctgaaagttctgaggaaagtggaatgcacagaagggaaaataatggaaacctggcccagaaatgaaaaaaagtggggggtattcattgaagatccaggagaataaacaaaacaaaacaaaacaaaacaaaaggctacaggggaggtgtatgtagagcagaacatggtaggaagaatattctacttagattctgaaaacttgaagttgacctctgcctctgctgcctgcacactgtgtggttttgccagttacttacccttgcagagccttggtttccttttccattaaaacaaaacaatctaaccacctacctcatagcattcttgtgagggctaactaacaagatgtgtgtgttttctaaataataaaattgtgaatgatataaactaatttctactagagagaggtttatgaaatgtgtctgcttttttcctttttcatagatacagaataccataaaggaactttagacgttatcaataaataagcaaactgatagccacagaaaggttattgaggttcacattaccagtagctagtagaactttaagtagaccaagatctgttgaatctgagccagtcccttttacattttaccagatggattttaccttttccatgtctctttctactagagatttgaggctttgattcttgtccatgttgcttttccactggggaggcagataaacaaaatgccacataagaaaacaaaaacagaaacaaaacctaccatgtttgtgtatatttatatgctattcttttgatcccaagactccctccagttcaccccccattttgattcttcctttcataacaaaatgtattagaaaaattgtccgtattagttattaccgtatcttcactttctattcttttcttaatctattccaatcaggcttttatccgttccactctaccatatctactgttgccaaatgcaatggtcacattttaattttcatctgactcaacttcttgcaacaatttaacacggataaccgcttcttttcctcctcgaaactgtaatatcttttgggatacccctcttttcaactttctctactatcttacagggcacttaagcctatttaagcctcatcaaatttgaaatctgttactagcaattcattcttatttctgaattgggataaacacagtatatttggaaaaacagtggactgtcagatgttttgatggtctgattttatgactttgatatacaaaaaagagtagaaaatcttattcttggtttggcttgaagcttttttattccacatacctcatggcaaaatttatgaactacttttgaaaattcataagtgatcatttacctagatccacttaattgctccacccagtttcttcaaacacttgttctttgaggtctacatggcaagaagtaaatacgaaaaccatttccaagtgaactaaagtaacctgaatatgttttctgtgttaggttgttccccctacccacagcaaaagcatgaagacttcctttaagaatacaagatatattctaagtctaccagtactccatcttctgatgtcagatggagttaaagttcactttcatctcaagagaaaaaacagtcattcctgacttacaaacatgagtggagggaagtacctgaacacagggattgctttcctcacatctggctctaagatacaaccacgcgctgtgacatataaaaaggtcactgacacgagaaaatatcgcaagatattacaaggataatcaaagccaaaatatatccaaacccacttttggagagaatcccaataacttcttttgaatgtgataataaaaataacatgaataaagatcattttcttaagaaaaaaaaggaacgtttctatcacttgcctgccacttgccacttaggagtagactctggctcccttttccgcttaaattcttccacagagtcagcttgccagactcttaaccaaggtttttcttttatctagactataacaaatactccattttgggtcatgagaacatagtagcaaaattcccagagttaatactttaattatacacatatgtatttattattttgtatgtgtgtgagctgttccactaagttaaactttaaccatattaatccaggaaaaaaatccctgattatcaactaacaattttgtaaacagttatctcacaggttaaatattaactcgaaaaatttaactcaaaactccacacaagcagaaggagccaaaaggccaggaagaagaagtaaagattagctgctttaggaggaacacagccaggaaagtgagcattttggtagctggataatgtgtaggaagtccagggggttgtgcaggggggggaaatagaagcaagaagggagcctggaggacacctgctgcttatcataatatcaaaacataaaacaatgaggtgagaccttaaggaaaagaaaattcatggagatatgaatccattgataatggccacaggaattcaggtgcaataaaggtttgaacctcaatgatatggacatagctaaaagatccaacacaaagctagctggagcggactgcctgcctgccactgaatatcatgaggaacattctggggtccctcttccactagaaataatgggatgaaggctgctctgcctgtcctgtttctgtttcctaacaataaaacaaaactgaagtgtctccctccagtattgggttattaggggcaccgattgcaagttctaagcctttatctaactgtccatcaattctctccctgattaacagaaccatatcacgtaagaaaaagttggaaccagcagtagactaagtcagaaggcttttctgtaccggaattgctgaactacaaatattgttctctggttaggattttgactaaaaaatgtcaagaaaatccacatggccagagaattcgcacaatcttgatatctgaggtacagggtaaagctgatgtattttaatgctgttttaggaaggttagaaactgttaagattcttcctgtcagtatgtcaaatatcagatcagtcctgcttgctgatttttaaggaagtcattaaaaaaatcctcccagtgagtagctttcaaggaagactcccatttgcccggcagatctaaagaaataatgaggccaaataatgcaagtttctcaagagaggtgtaggattgaatgaaaaaagggaagatatagaaatgtaggagaaataattcttacatatataatatatataatgtatatatgtatatattgtgtataatatgtatatattgtttatattcaagaaatatgatatagcttatcatatattacttttgatatttttcttatacatctagtacatgaatacatgcttattggaaaagtacaagtacaaggtgtagtctctattatctaaatatattatttaaatatatatctaaatatattatctaaatatagatgacacctcgtacttgtaaagctttttgcagtttataaaatatttttgcataaaatatcttttgctttcctgacaaccacaaaaagtaaaaagggtgggttctataatttctgttctatagacatgcaagtattactctaccattgacgtaactggtgcagaataaacctgaacagaggaaatagaatccattagtagcctggttatccatatccacatgccaagtaagaaagcagcatgatgactgtggaaatgtaaaggcattataagagtgatttttggagaggattaaggagggagacatcaaaataattcaaaaggaagtttagaaaatcagtagaaataaagggctaaatttggagtaacttttttggaaaaaaagtgtttagaacaaggaaagaaacttccaattcagaccatgtattcatttggcatatactaattgtatatctatgtttgattttctttgatagatgctattgggtaaataatgatgtgtatggagacactgacctgtgcctgacatatttaatatctatttgttgggataatgcccagaaggaattattatgcaataaaattcagatattcagaataggggtttagagagaaaatcatcactgatatgtaggctgacaaaggaaagcttcagtatgatgaacaaatctagttatactttgaaaaacatgtaagatttgggaggtgataagacatttcaagttgtgtgaagggcatgagagaaagcatggaagcagaaaattgagatatgtatttgggagcagcaaataaacaagttagttggaattgtaataggaaacaatgctggaaagatgggttgagtgtggaatgcgaaacggggtccttgaataatgggctgagtagtccactttattctgtgaacacaagaggtctattaaaggcttgtaaagtaggacactggcatggtcacagtgatattctagtataaataattgggaatggtggacagaaaaaactgaaacagggagagcataaaggtaatgagagagaaagagagagagtgcgagcttgtgagagcaagagaatgagaagtgatccactgcaacaacccaggtactatgtgataaatatctgacttcggtagtgtcagcagaaatgtacaggaaataacatgttctagagacattgtggaggaaaaaataacaatatttactaaagttctactctgtgccaggcaccgaactatgtgctttatgtagattaacccattaatctccatgctaaccctaagaggtaagtaactttattgtttccattttacagataaggattaagcaactttttcaaggttatgcagttagtaagtggtgaagcctggattcaaacccaggcaatctgactccagagcctgttctcctaacccccacacttactgtttttcctaggtacaagggatcttttggtggattatatatgacaagatttgatataatttgatgactgactacatatgagcaataaattcgtgggattcttgggattctcaattctgagatttttgggttatattatgaataaaaagaaggaaataaagaagatcttcttgacttcacattgtacatttgttcctaatggtccaattgctttttggacttaaagtatcaatttacaataaaagccacagaagcaactgaaccaccaaaccggaaagctctttgaaaatgattcttctttctagtttcactaatgtatatctggagtatagcacagttcttcgcatataggggatgcccaacaataacatgatgaatgagtcaactggagaagtattaattgtaataagtgagaataagggagtggagggtgtaaaagtcaaaagagtatgacccagagtcagacaaatattggttcatatcctggctcagggccctttctaactacatgacatacagaaagttactttaaacattttgtgtaatatggggtaataattcataggaaagctagctaccttactggattcagtggttttatataaaggcaatgggtgtatgcaaacctagtaaggaatgctcccaaaggctgttacctctgacagaagaaaatctgcaacccctttctctttgtttaacttacaaaaccacatgaagacctaagaaaaaaaatctgccaaataaattccagttacaaaaggaaaataaattattttgaaagtaaaaactataatttcaactgaagaagagattttaattgcagggagatagatcagttgaatggtttaacttggacttgagaaatcagtagcagccagtgggatacatattaaagaaaaaaacaagtttaattacccttaagattttatacagcttggctcttccctcccacacctagtctgcttccatcaggtcagactccttttcaatcacactctcttccatccttttctcagttgctgtcatgacaagccaatgagagaatgacataccgatgaaaacaaggtttgagtaattactgcactgtggctggttgttgtctgggcatcattttatttcttccaatcaaacaggtccttggacttcacagctctgtttcaggtgggggtgatgctgattatattatgacattatagcaaagacaggcagatcagatgaagtgaatttcactcagtaattaaactgcagtttctttcgtctaaagtccagggcaggattaatcgaaacgtagctctttatcattcctattaatgctgggatttgaagagtgagctctgatttgatagctagccctgaatctggctgactggtgtccccaaatctgtctaacttgcaaaaataatatcagatcaagatacatttgcaaggttatacccttcccttttattttacttttttttttgataaggaaatgcaaatagattcaaatatgctgccatttccactaccttgttttctattacaaaaatgtctgtgaaaaaaatcaggtccttccaaaccccacagcattttacaaatggttttccataattccacttaacaccatgctctaatggcttctaattttgtgacttttcattatctgagactcaatatgaatatttggatggcccaagcgacagcttttcagaggctcaaaggttctacttttattttaaaggactcattctgggacttatatagagattttgtttcattcaatcactcttgtaatgcatatgatatcaccaaattctttaacaagtatgagttggatcactgattctcaatcctgggtgtccatagaaggacctgtgaagctctgtaaaaaatcagcctccagcctccactccaggccacactcacagatcggaatctctaggttttagacacaagattttatatattcttgaactccataagtgatttgaatgtgcagctagagttgaggaccagagtcagccacacagtgtattagctgtatttgcaaaatatttattaaaacaagccattgttcagagaaattagcctcacattattgtgagagatctctcaataaaataataaaaagcttattccagtagcctttgcatagaaaaagatatacttgggtttctttccttcttttcttttttttttcttagacggagtctcactcttttgcccaggcaggactgcagtggcgctatcttggctcactacaagctccgcctcccgggttcacgccattctccttcctcagcctcccgagtagctgggactacaggcgcccaccaccgagcccggctaatttttttttttgtatttttagtagagacggggtttcaccgtgttagccaggatggtctcgatctcctgacctcatgatccgcccacctcggcctcccaaagtgctgggattacaggtgtgagccaccgctcggcctcccaaagatatacttgggtttcttaagggaagtagaggaaaaggaagactgtaaaaacagacaggtaactgttgatggggcttccattgttctctctgataacattgaaggtgatggtttactgattgagctcatcacatggtaacactatagctaccaaccatataatttaagatgacagttgactaacatcatagaatctcagagtttggacataaacttggaattagctgtcatctattttaaccccttctctattcagctgcctttttagaaagagaggcagaatttagaagactttatttcaaattctgttttcagttctgtttcagagtttaagaatacacgttctagggtcaaactgaattcaactactagttgggtggcctagatatttacttctctaagccttaattatcccttctttaaaatgcggcccagaatatgtatctcaaagagctatttaggttttatattaattaatttagataattaactagaatgcctggcacacaaaagtatcagaactcaataaattaagtctattgaaggaaattgcaatagtcacttttaaggttgtcactgagactctatgcttaacaactatcagtttggtgactcacagatcagttttctggaagatttgatttgccaaagaaaaagagagtgagtccaaataggaatggctttcacatttaattgagccataaaataaaatacattttattaaataaattttataaaatacaattttattttaatgatcacctggaaatgatcattaaaaatgcaaatttctgggctccaatcccagagattctgattcagtttgtaggagtggagtctaggaaccatccaggtgattctgactcagggtcaagggtcttcactttaataaagacagttataaaggaatataaattagccaagcatttatcccccaaataactacagtgtggcttgacctggaagagaccatgctttctattccttaagtcagaattcagttagatgagtttaaaccatgtgcaaatacaaaatgtttatagagtatatttatgcacacagagttaaaaaatctatttctcttcaattaaatatgccttctcaacaattatcatttagccactaacattatcttcatctcttttcatcactactgggtacatgtaagtatacagacaagggtcagatttgctatcgactcatccattttcttcttacaaaataataaacaggtttcataaaattggtaaattccttgaataaacaaaagcagctatttcctcctctaaatgcattgtagaataaagtattttcaaaacgcattaatcgaaattgataatgaaagtcaatatataattgtgagttgaatattttaaatgcaattgattacttcgctaaaatgaatatactcaacttacacatggagactgttctggatctaaggagaaatttaaacattttcattcccaatcagcgaaatcccagaaatgtgtttagagtttctaatacaatataccaacaaatgtgcattaactctctatattctaaaagttattgtgtaacaaataacaggagaattatggtctctaattgcagttgaacataaaattgagctggggagaaaataaggcatcaacatgagaaaagtttttcagcattatacaacaatataggctagtggccaagtgtaaggctgaaggagaatctttttagtacatactgtgtgaggcagggtaagctaccgaagatctgcaaaagtcaggcacagtaactcactgagggggttgtggtgaccacagtgggtactgaataaatgtaacctattatttattataatagttgacagtttattttagtaacacaagatatatcacagataagactatgtaaccggtaaaaggtgaatggtacaggcactgagagttacagggagccaaaactgagagaatgctggcatgactggtaagggttttgtgaggaagagacatttgaatggataatgcaggagagagaggatttggctagacagaggaacaaagatcattttagacagggtggggtgttttgatatgaatcgcaggtcaaagttaaaaagtgtttaacgactgttaaaaaaaacagtttaggatgaagccataaagataaatttgaagtagaacaacagagggttctggattccaaaaatcacttgtagtttctggtagaatttttaattgtcaaaatattttctcagtggaattcaatatctctttagatcagtggttctcaaattttagtatgcatcagaattacctgaagtgcttgttcaaatacaaattgctgtgttccacctcaaagtttcttattcagtaggggaaagtgaggcctaagaatctgcatttctaacatattcctaggtaatgctaatgctgctggtcacttggagaaccactgctttagaagacagtgagataggccgggcgcggtggctcatgcctgtaatcccagcactttgggaggccaaggtgggcggatcacgaggtcaggaaatcatgatcatcctggctaacatggtgaaaccccgtctctactaaaaatacaaaaatttagccaggcatggtggcaggcacctgtagtccccgctgctcaggaggctgaggcaggataattgcttgaacctgggaggcagaggttatagtgagccgagattgtgccactgcactccagcctgggcaagagagagagactccatcacaaaaaaaaaaaaaaaaaaaaaaaaaaaagtcagtgagataagagaagagttggatgaagagtttcatggataagaaagagttggacgactatttcctaaagtcaccatataatggaatagccctctttatttcctataaaatttcaccctccctttcataccaacacatagagaaacctacatgaagattacctagggatcaaaattcttctttggctttctaatccctctattgggttcaggtccttaactgtgggaatgaagaggcccatgatcaaaaggagcccaggcccaccaacctggaaacttgaagacaacttaatcactattaaggatattcaagaattcaaaataacagacccaagagactaaagaaagaaggtggaatttttattccaaaaagcctctgtcagtttcatgttgaacattttgtacttgggctgcacttaactgcctgccccttaatccacaaactaatatcatctcaccttggttcacctttttcttttcttcaaaaggcagtcagaagcaagcaggggcaatgagaactttctacctaggcatgggccactgtttaagcatctccaccttctgcttcaaaatctttctccaaaacaaacttccactatgtggtaactatactgtaagaaatcatttaaaaggcagaaagaggaaatgaaatgctctgagagactattttctcatgcataacttcgagggcagtatctcacaagtcagtactttatttttgatggcagacaaaaaacatgttgtgtttgaagattcatgtagaaatctttgtgaaaaaaggtcaaaattggatttaaaatgttcaaaactccaaaaatctctaaagaacaggagcttgtttattttctagcaatttatctttccttaaaataagaagctatataattacaaagtataattaataataataacaataattaccacaaatacaacagaaataatgatagtaagcaccatgggcccagatccccatagttacaaaggataagaatttgtctcagtatatttgagaacagacagcagcccaataatacaggaaaaaaaaattggaaaggaaataatctttcttgtgctccctggaaaataccacagaaaaatagacaatcaaatttaatacctgttgttaaatatcttcattgtacagattaggtcaggcaatttaaatagacaacaacatgaggcctctaatgtctcttaggaaacagtttcaatgtaaattcctaggaggtcccaattcaatttctagttaagcatccccatccactcgtaacactcataagaaggagaaatgcatttgtatggtgttttacagtttataaattattctcacaaacgtgttatttgattgtctcaaaaatcctgtggggtaggtaagtagagaaagtattaatagtatacccattagaaggtgaaagaattaaggatcagagaaaaaggacataaattaatctttattaaatatccacattgggtcaaactgtgcagacctggaaagaagtccaaataaagttttacataacatggataggcttggagaatttgttaactgcccaaagtaaaaaaatggaagagctagaacttgaatgcagataatgcagctcaagatgtaatggtctttccatcagaccatagactaaactctcagttgtaaccatcgtctagttacagtaactgcccctctcaagaggaggctatttcattgccaagaaataaaaccgtgaatagtggtcaggttttctgtttttagttagactgaaagaaagcacatactccttgagaagacgtgcatctttttaacatgacttagtctgtcaagagaataagagagagaatgtgttatttcattcatgtagaatactgacttttaaaagtcactcaatttctctaatgatcagtgatgttgagctttttctcttaggtttgttggctgcatgtatgtcttcttttgagaagtgtcttttcatgtcctcaggggagggcagtgtgggggcagagagaatcaagaaaaatagataatgcatgcggagcttaatacctaggtgacaggttgataggtgcagcaaaccaccatggcacatgtttacctctgtaacaaacctgcacatcctgcacatgtgcccaagaacttaaaattaaaaaaataaaaaataaaaaaactgactccagctacccatggacacaagagacaacacggtcccatttgtcaccaaaatagacaacacagtcccatttttcactaacatactctttgcaagaaagataaactaaaagactatccaacattaatagctagattctggcatagtctcagcttaaactattagtttctaaataagaggcaatacatatgcatagtaaaatagagaataacagcaatggatgtattaacaaaatgcattttccattaattgttatgaattaaaaagtctcgaagctatagatcgagactttgaaacttctggaacaaattaacctatctctttttatttttactttatgcatgcatttacttgtgtagttggtgttgctatgttttcttaaatttgtttttaagataattatattctccctctacttttatacatatatcttctgaggcatttaaaggtttgacaaagcagtgtcttctcacaagagacagaggtttcacttagaagccatcttgggaatttgggctgcagaaatcaagggaggtctagtacgtaagtaaatattagtgcaataatattaaatttttgaatactaaaggaaaacatttattgaaagaaaattgctttatatccttaacaactaccttgctatcgaggatttttagagaattgcagaatttcagagttgatgctatatgtaggattttcttttcttttaattttttttttagagacagggtttcactctgtcacccaagctggagtgcggtggcatgaccatagctcactacagcctcaaactcctgggctcaaacaatcctcccatcttagcctcatgagtagctgggatcacacatccggctaattttttttttttttttttttttgtatagacagggttttgcttgggggcccaagcttgtctcaaactcctgtcttcaagtgatcctccctccttggcctcccaaggtgctgggattacaggtgtgagctactgtgtctggccccaaagattttatttttataatgacagaatatcagtgttagcagagtccattaaaattatatatgacaatcatctgtttaacccatttatgccaaatgttgcaattttgtgtgtgtgtgtgtgtgtatgtgtgaaaaatcagaacttggtgatgaccttgagcaacaggatatacataactgccacaagcttagcattccaatagtggaacactaggcataaatgggttatggcttcagtatcctgcaaaatatccctgtaaggtagctgtctatgcttaaacaccttggtcttaggaaactaggatttgtggatattaggcaatgttatgggctgattgtgtcccctaaaatacatagggtgaagccctaagctcctaccaactgtatttggagataaggcctttgaagaagtaattaaggtttaatgaggtcataaggttggcactctaatccactaggactggcgtccttataaggacaggaagagacatcagaggttctcttgagctcacaaagaaaaggctgtgtaaggacacagcagcagaaggctatctgcagccaaagacagaggcctcaggaaaaaccaaacctgatgacacctcagtattggacttctagcctccagagttgtgagaaaccaatttctgtttgctagtccacccaccttgtggtattttgttatggtaggcctacagactgatatggtgcctgtatcagtgcctatatggtgcctatctcatcacaacctgtaaggaaggaattacttaaagccaatttataggtatagaaacagactatggaacattcaagaaatgtcccaagagacaaggattcaataagtggcataactgagatttaatctaggtctatcttccatattattttttaccctcctattttttacctttgaacacagaaggctgctacaaagttagtgtttcatattgacttgagtattttattcttgtaggtttcatcactggctgatggtctatttgttggagtaacagaaagcaacataatttatcttttagatgactgtcattcatatacttgaagatagttattacattccttcctcctgaatttcctgttaatcccggttcccttaaccattgctcatatcacatgtttcagttccctaccattctggccacttatacctgaagatgttcctatctatttaaatttcttgtactgggttggaaagtcatatctctgctacgtcattcatgactagtctttttaaaatataaaggcaatatcttgcatttatccatttagaaaatttcatctgttagatgtagcccataattccagtctttcaatgtctttggaattcgattacttcattcaacaacttttctatgtatctggactcatgtcatctgcaaatctaatgaatatgttttcattccagttattgaaaaaaacttgtgaccaagataaggccgaaaatatccttgcaatatgccacaggaatcccctatattatgatattgagccatttgtttgtacctaatagtgtggtcaatcaaccagttactaatccagctgtacctacattagttactaatccagctgtacctagattagtaactaacccggctgtacctagattagtaactaacccggctgtacctagattagtaactaacccggctgtacctagattagtaactaatccggctgtgcctagattagtaactaatccggctgtgcctagattagtaactaatccggctgtgcctagtttagtaactaatccggctgtgcctagattagtaactaatccggctgtgcctagattagttactaatccggctgtgcctagattagttactaatctggctgtgcctagattagttactaatctgtctatatatctaacccaggagatatcagatcacatattgtagacatcattttactgaagccattctattgtctagcaagcaccacttctttcagtggatcatgatacattgttttatactttattgctttaataatccattctagactgttgctcaggactaacagcaagtagttgcatcatcataaattgcctttctatactttctgtaaatcagaagatttccacatctctagttatctaacattgtttctcttctcctcaaacatggatggtagtaattgactatctcattgacaaatcctctcatgagtatatggttctctatccctatttttaggctcttctccttttcctttttttcctgttatcttccaaggaaagagtcactcatgtttaatcatgaacggtatgttggtcagagatagacctgcaaactggaacaactgagaagatttatacaaagtgttgtcctagagtccctgactgtgcccgtagaggaaaatgtactatgattaggtgaggctttgctctcatctccacacagggctctgcatggcttttctatttcacttctggcagtactcctggggaaggctacatccttttcctattcattctgggtgacttcctttgccaaagattcaagacagctttgtatttttcagtctttaactgagaaaggttgtgatatataatgcctttattttcccatgaagactttctctgaggcatgcacatagccacgacctttacctaatcaagaaaagttgcttgggcagtgggggatggggatgcaggttggactttaaatgcacaaatcagttctaataaaaacactgagattcaggtgcctgaggttagaaatactggagggaattcaattacactaattaatatttaagaagggctagagatcacacactgaatgtgggaaactaggccagtcagacatgagcatatggggagggcaagatcaacagataaaagtaacaaacaaatcatacataaatgctccaacaggaatgaaatagagaatataaaataaatgttccaacagacactgaagaggaggtaaatggtctaccagacataaaagcaaaatgttccaacatacacaagacattttattggtttaatgtaaacacatatattataaaaatgatttttccacataagttagtaggaaatgttacccatttatagaaacagacttacgggttctatgaattcacagcatactatatttgctctcatttcctcactggctcatcatgcaggagtctcaataaggcttgactttcataacaggtagttctccaatgcctaagcctacctggatacccaacgcctgacagaaggctgaaaagctgcagagtgtgcctgcttctgcacaagtttttctagttccggttgctctaatgtgatttggttggtgtcacagctaataccacattctctatttgatctgatttttcatctgtggcccagacagttgattctgatttttggtcattcttttatagacttgaaagttttctagagaaggcactagtggtgccaggactatcttgcttccttctgtcctgtctacactagcatttaattacacttttctacctcttttctacctctatgccctctcaccctccttcatcttgggagcttccaaaactagaagccaagagaattaactaggttgctttataaaaattgtatatatgtagggtaaacatgacattttgatatacattggattgcttttgctatcaacggcatcatgtagaggtagtagtagaagcatggaagggtagaagaaaggactgagactgatatttggactcctctttcaagttttctgatgtacacatagagtaactagatggcctggactgtctatgtacaatacggaattttaggctcctggaggaaacaaaccaaaacaaaaataaaaacaaagtccttttccttcagtagctttagctttagaagaataaatgattcacatataccaaaacccacaagatacggtatccccaaaaagttaaattgtctcttacctaatagaggatcagaaaaagaaaagatagttatttcctaaaaattgtttgaaccaaatttgtggttttcaaactatgcttcatggtccccagacttacaaagagatgattacaaaaagattatcaaatagatataaataaataaaaaaataaatacatatataatatgtagtaaatacatatatatcaatttgcaattgtgataaaaatgacatgcaaatttaaatgtattatataaatttaaaaaacactggagaccaatgtgttattacaagttaattatgtacaataagaataagcagctttcatgcaggcctctaattaaggctctcagattggaatacaagctgttgaaaaaaactgttacaatatgcaactacttatcagtctcatgatttttttgataccatatagtatagtacagaaagtcttcacttattgccatccataggttcttggaaactgtgattttaagtgaaacaacatataatgaaagcaattttaccatagactaattgatataaataagagttaagttcttatggcaaattttgggtcacagaaacatcatcaagtttctaaataaagatcaaaacacttttgatattaaacattgaaataaatgtgagctgtacatgcatttaagaaagattaataaaagcaagaaataaatgtgagctgtacatacatttaagaaagattaataaaagtaagataattatttaatcaataattccagttcagggtcatgagtggatggagcctatctcagcagctcagggactggtaaggtgggaaccaagcctagacaggatgccattctatcttagggggcactcacacacagccacattcactcagacacacccatgagcctaacacgcacatctttgggatgtgggagaaaacccactacccagagaaaacttatgcagatatggggagaaagtgccaactctacacacacagtggctcactgggaatagttcttttttttttttcccatcagcgttatgacaccatgttatttgagtatctgctatattccccatacaaaaatacattgatttttgagccaatacaataatccaatgctgagtttttattcctttgtatatttgccattatattcttattgaatgactttataatattcaatatgataaataatctgaatttgaaaatgagtttatctcaataaaatattactcattattccatatgttaagtttctaataagatttagtttgaaaagaggattctgcttgtttaaaagaaatatgaaaaatgtctggatcaaataatatatatgtatcctgcaactcaaggcagtatgaatctcatatggctccaggctgctcagtttctgaatttatcaacttgctggcttagaccactgtatacagcagatgcattgggcccaaactagattttatatatgggccactattccttcaggcttaagaacagtatttttatactgaggaatagcttatttatcatgaaaccatcatacatcaaaagaagtcacgttgccttaaacttatccagtacatgaaatttatcaccctcaaagttctagattatcagaatttaatatattagtttaaaatataaccagttgataaccaagaaataagtcaatggaaacctctttaattatctaagcagctcatcttgtttataataattgtataacttacagatacatactcatttatttttcaatcaaaatatattatattgaaagacttcagaagatttttttcttaatattaaccaacattacttatagttaggaacagagtgagccaaaaaggattctcaccactacagagaataaaactagcaaacctggggaaagatccattttccaaaacctgaactacactctatgatggtaacgtttcaagtatttataacacttaagtataagtcaagagttgattgaatgaggcctttcatgatgtttatgtagagtagtcaaaccagaattatttatgtatttgtttatttttaaaggctgtcatttgaaagttatcacagtataaaggtaaaggatacaccggagtttccattctagctccacattcctggctgtgtgaccttggataatttagttaaactaaacttcagttttcacttctgtaaaatgaaggaaatagtagaggttctattgtcatgaatttctagcaagaaatcaatgaataaatgaaatgatgaatgaatgttgcttagcatgttgcctggcacataaaaagctctcagtaaatattaactgtaattaaaaaatatctaaaagccggttgctttcttttggttatttttttaatatgacttgattttattcataacttactgactatattttcttcccttctggaatgatgttctattgaggtttctttttcttttattccagaatgttctctgagcaatctcttcatttctgcctcattcatcagataggattgtaggcgttcattttggtagttctgcatttggttttctgtcactgcttatgctgttttcttgttctaactcagtggtttaaaaagtaaaattcaagtaaggactaaacataagagaatttactgggactaatggttatcaaaattgggcataaagggatgttattaaaaataaatcacacagagggagaacagctgatgacagcagctgtgaaatggatgtacatggtgggaatcagtgagccccaaagaaacaaacaaaaaacactggagggccatgaaacttacatgatttacaagggaaacccaagctttatgaacagcctctgaagactacagaggccaagcaagtcacttctggatgaaaatttggataagacagcaatactgaaaggagttatgttccctgatcaaatgggagctacagataagaaaagaatgagaaataaaatgaaaatctttaccgagtttgatttctttattgtataacctgcactgaggggacaccatctctgggtataccactatagatacacttaccaaatgcttagtgattattgcaatagttagaagagaatatattttaagagccaaagttacaaatctatggacaagatgaattaatattagaacccatgttgagatatatagggcccaagtagtctatgacacaaaagtttgtgtttttatttaaatagaactctaaagacttagttgtttgaaatatatttaatgtagagaaacatttttttgaaaatttggtttactgtaaagatgaatggagatgtctaactttttgccttttttttctagatatggacccacctctctattttcaagagcattaaattcagttaaaaactaaaaacaaaaatactgccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaatttttgtttccaaatggaatttaatacatttcatgaaacaaatgaaattttatcagaaataaaacatttaaattaccaaaagcctagcctccttaggaaggctgttttaggaagacatgggtagaaatattttcatcaaagccctgatcatcttccctttttgaggtgaaatcactctactctgctggaaacctacatttagttatttataaaccagtattaaatgtatattgtttcaaatctctatgtaggaaaaatatcccacattcattcccattttactatgaactgtataaacttccaaaatcatcatgaaaagaaaaacatcaccctttctgctaattaagtgttcttgctttttttctagtaatgggtatttgaaaaataacaatatgcaagagtatgatcttacagtgaatatagccactaggtcaatatgataatttaatgtgagactttaaaattgagctttccttttatgctactattctctaaataacttctttatttgctatgattaaaatatcttttcatcaaatttgatataaatatactagatatggtaaatatatttatcatttaaaataacaattgaattgtacaataagcactatatcattgcccaatttttattttgataaaatctttttaagtgatatcatttcatgttaggctttttgtgctgcttaatattataattaataattcatatttttgtctttctcctctctgacaacttttatttttaatcggtgggcatgtgccaaattggtttgttatttatttataatgtaaaatgacaagggaattgaatatgtgaaataagatagattttctttcatatgacaaaaatttcttagtaatggggatgcttcttgcttacccttatagattcaagggttttagagaggttaggtcaaatgtcacacttctcatataacaacatgtggtaagtgcattaaatagactgttcattttttaaaaattcattttagttttgtgaagacatctgggcacatgcataaaaaacaggacaaaacaatatcaaaatttgtaaaagactccctattccgataaatcctatagtgtcaattaagtaaaaattctgaccaaacagatgtatttgtattctttcctaaaaactaaaacaggcaaacgtaataggaataaacagagaacgtttcaaagatacagaatttccattgaaaaaatcaaatgttctgtctgtaggactttatagaacattaaataatcttttcagtactgtccataaccagaaaccacataagctggatgctagactattgactagttatgacaaaaaattcacagtttgatctcaagggcatcagcgatcctgggctcaggtgatcctcccgccttggcctcccaaagtgttgggattacaggtgtgagccatcatgcctggccatcgtgccaacgtattgaagtggaaagaactaatgctgagcagagaatgggccatacctgggtggttttaagaggtgctgctataatgaaaaatcacaggctcacccaagaactaccgtggaatcagaacctctagggatatggccctagaatctgaattttaagccagttcctgaggtgcaattcagtttgagaactacagtcttaaggcaaaacctttctatcataccagagcttccaattgtcaggccctttgaatccaccctttgtgtcaaaccttagataattcaagagacataacaaacgtgatcatgttacatgcttcctcacagatttcagtgtctcccatttcttctattagtttaaaaaacatagtccaccatcacagggccctgtttaagccagctcctcctctgtggctctgcctttgtggtcaacctgtgcaaaactttgaggctgtgacatcacttagtcagtctccaacatttggaacaagagaactttttctaacaatttgatcccaattcctattttaagcttgagcattatgaaggctgtatctgtatataatattgaacacttcaaaacaattttagatcttaattattttgttattaaaatgttgggggtgtttaagttgacattgagtcagatgtaggaactgatatacagtgaagttaaatcctttagggtaaactcattcagtggtagaggctgaactacagagcctaggcattctgacattccaccactgtgcttatcagcttgctccttgagcaaaccttttcctgcctttatgagaatatgcccattttatgggctctgtatctatgagatattttacctatgcttatgtacacatggtgtttatctttcaaagctggactatggaaaagcctaattttacaaacatgttagtaaaagattatgtaatctgaggtgattacgtttaaaatggcaatgataatgatgttaattccagtcctgtgaggtactgtttctgatctggaaagagcagttttcttttttaacagcttattttgtattttcataatccattttaaggtttggtattaatatagacatgagaaataaaatataactgttgccatgccaaatgtatatcaaaaagttgctaatagccatgactgctatttggttaactgtatttcactatttaaataaaatgatggaaaatggtgtgtctaggatctcattcataataatgaaagacaatagaaactattagcataggtatgatgctaatgaatggtaaattttcaatagagatccatcgaccagattgtttgaaaaatgtttcctgtgggtacgaaaaatgcacacaaacaaacacatgcatcaaaatgtccataattaagtttttagggaaaaataacaatatatgttggttaaggactttcacttaaatggcattatagatctttcagaaatgagagttgatttatacttcagtattttggttcccaaaggttgggacagtgggtggtagaggagaagtagagtaaatggaaggtatacatgtatgtgtgtgcatatgggcaactttaagcaccttgaatttaatgaacaaaaaatgtcattattctgtgtttatatatttttgtgtgaaacaagtacctttctctatcactggagtttacatggattttctcatgatatcttttgagaatctctttaaacactaaaatacatttttccaaatgaaaactcccataattctgctttattaatatctgaatgaatatttccattgatttgtccagaagaaggaactgagtactgtttagagagcaatctttttcatgataattggcagcaatgtttccctgctatcagaaagaaaactatagaaatacgaaactttagataaacatggagataaaaataatattatggagtccaactggtatctttgaggtgaggacaggctgagatggactccttggcttccttctgtccaaaaatttcctgtttccctatttcctacggttaccaccatggaacatgttaaaatctcagtagggactctgtttcaacttttcctgtcaaaacacagtgaaaaagcttaatggaaaaaaatgtccttcctatctccatgccaggcacagtgtaagatccacaaacttaaaagccaggaaaatattcttttatgtgccccaaagctgggcaagtgacctagtactacaaaaattcccaaataggcatgtgacctgactaatgtgtgctgtgagatgagtcaagaaaaatggaaccatctgtacttttattggacagtcaaataatttctttctgtccacccaaaaacataatttctatgttaagagtgatacaaggagacttttagaaagtctaatttttaaaatcagagatattaaaatatatgaaaagtataacctattaaacactggtggagataagcaaataggcttatgaaatcattattgctttaaaaatttgttacctactcattgtgtactaaggcttctctacgacatacagaagaggccggtgcggtggctcacgcctgtaatcccagcatttcgagaggctgaggcaggtggatcatgaggtcaggagttcaagaccagcctggccaagatggggaaaccccgtctctactgaaaatacaaaaaaaaaaaaaattagctgggcatggtggtgggcacctgtaatcccagctactctggaggctgaggcagagaactgcttgaaccttggaggcggaggttgcagcaagccaagattgccccactgcactccagcctgggtgacagagcaagactgtaaaaaaaaaaaaaaagaaaagaaaaaaagacatacagaaggaaatcagggaaaatgggaaaatgaagggaattaacaaattgcaataatctttaagaagtagagtatgaacaattttccttttctaggatgaaagctaccaacaactgaactcttagagtgagtgatggcagaaaaaaatagcaatcaagaataggggcatgttagtttttagacatgtttacaaaactctgccttttatttcttaaacccataggtcaaccacccatcatacctacattaccccatatgacaagtggatttgttgtatgtttcaagtttttaatcttggtgggaagggggagggcagagaagtatttattggtaaaatatcataataaaggttgagcctgtcaatgattgtacctaacaataataaatatgtgtaggaagtaagaacggcaaaaatgaagccgggtaggatactgtggatatggtgacagacaagtatctatacgaaatcctgagatatttgtcctccatttcataaattaaagtgccccctcttttgctttacagataaggaaactgaggtgcattataatagcaacagcagctgatgtgtagtagatccataccacaagccaggtacgatgtcaaacatttaaatgtatcatttaatttaattttcatagatctcctacaagacaagtgctattattttcattttacatacgagaaaactaaagctgacagagattaaataacttgtccaaggttgcatagtaactaagtgaaagagccaagatatgaactcagatctgtctgatttcaaaacccaggcccttaaacactaggccagtggttttttaaccctgattgcacattagaagcacctggcaagcttttaaaacctactgatactcagaccctaccccagaacaattaaatcagaatttcttgtacctgggccctgatgtgggtgtttgtttcaaagcctttctgggtgactgtaacatatagcttgggtaaagaagaattgttgggtgtctcccatggaggtcagtatatctgtgccaatatgtgaggtagtacaagactcaagtgtcctcagtctgtctgcagtggtttttcccttgccccatcatgttcactttgacatcttttttttattatgatttttggagaagtaatatacaagtgacaatttttttacaaagcattgtcacagcagaacatggtcataagtccatcaaagagaaacctgttcatatctatgtacaggctatgatgaatgaatacaaagaagactatgtttattactctcatccccaaagggaagtataaagctggccttaaaagctgttcataccaaagctaatcactaaaatttggaatggcttcctcctctcctttcacaaatgcaatagggtagccactggatctaaggggaaaagatccaattaccactctttacaatgctttttcacttaggatctcaagacgactgacagtcattcaaaacataaaagtaaagtgaaaatatctctagtagaagtgaaaagaaaatgtctgtagtaggaagaaggcctaaatttgtgtctatactctgccactttactgcaatgacttgaggccaaaagtaaagtgacagagtatagacacaaatttactgccatgacttgagccttgatttccttttctatatgtacttaagccatatcatccttagggcagtgatccaaaaaatgtggtccccatcagcatcatgtggaaacatatcagaagtgaaattatcagtccctaccctagactctgaatcagaaacttggtgaaggggcagtaatctgtgtcttaccaaacattgcaaataattctgaccacctccagctgactctgatgtatccacctccatggggttgttgtctaagaataaaaggagatggtccataaaattgttattttttttactatctactgaaatcagaaatttcaaaattctctcacagagatattttagagaaataatgttacagcctacattagttagataataacctcatttctgaatttcactttgaatgtgtagacgaggcacaagtcaaccagaggttatgcaattagcttggagtcaaagagaaagcaaggagtagagctgagaaggaaaccccagtgtgaacttgatttttattcaatcaaactgttaaggtaccaaccacgcactttcatctataatcacaatgaaccttttaataaacatgtttctatcctcttagcttaaaaaatataacagtagctttttggattttaaaacagattgacttctatacttctgggctaaaggcagctcaagagtcaataagaatcacaagctttccacagtgagaagaaagtgcaattgcccagtcctctctatctatgaagtgcagacagtattcctcttcctcacctcacactttcgattattgcaatggtggaaaccatgataaataaaagcgcttatctagtggtttggttttcactaaaattacagacttctgtaacattatttggataccataaaacacaaaccaaattttaggagatgctttagggtgttttttcccctgccctcctgtcggaagccctctatctttttactgtaatttatctgatatagctaccaagatgcttgatacttttacatgcaagggtgctgaaaaacaaagagcgagggaatgggttgttaatgaaattctctgattgtaaaaagcactctggaatgatcaggtggtaaataataataagaggaaataacataaagtgcttaggtgctacagcgatagtcaccatataaatgcagaagagatcagacatgaatagaatttgcattttatgcagctgctgtgtgtgtatatagaatatacagtagctaatttttcaataatgctggtaaaatattgttcaaaatctattcttgctgtcttctcactttaaaaggcattatatagaaaaacacccatctgtcctagtgcaatggtgaatgtgtgcaaagagcctagaaaaagagcctctttgcatacgtgaaaaaaaagaactcaaataaaaggagataatgaagaagagacaatagtaacactattagaacagctatgcagacaagcacaaaggtgatctttgaaaaacatcagggataaataactctgttaatgtgtggcagagaaactacagttaagacatacagtaatataccaaaaatatagacatgcttttattttgtctactgggctattgtgatagtgatggttgtttttgaatagaaaggaagaagagagtgggaagtaggatttcgttgtttgttgttactgttgctgctcagtttagaacaacaacatcaactacacaccagacccgtccaacagttccacaaacaatgcttaccatgaatctgccctcaattttcttgttgttattttcccttaatacttattgataacccaatgcccattcattagatatgctaaatcctcgtccatggttactctcctttggaagagactgagaagatgctaagagggagttcctcttacacataagggaagagtctgtttaggaatctgagaaagcagaggccaggataaagagaccactagtcaatcaatactaagcaccgaagactgaatcacccaaagatacaattatctcccttcctttgttctgtctcttagtcaaataaaggattgtttgtagaaccttttctgttcctgatctctaaaaagcaggactggacttgcacatccaactataattcaaaatatctcacacttccaacttgaaagaagacataaactgtttcaaagaaactcagagagagcaaatgcatattcacaaaacttacacttattcctagaataggaaaatggagagagaactaaccacataagaaagggctaatcataataataatagtaataatgatgatatcaatcaatactttggattctagagaatgatttatcacaaaaattcacctgtattaagggagactccaggacaaggaggtcattaagctacatttccatcttcaggattcagccaaactcagactctccggaaagctgtaaatgctctcagaacagactttagtaatgagattggaatgaacactgggcctatggcgtaaaagcatctccctgccccttgttctaaaagttaactattaaaccatgtgcggttcatcctgatttggtttactcaattctagaaacaaggacatgctgatcagattgccctgggcaattgaatacctactgaagcctttgggaagacagtgttcttcccaccacccctacttaaaaggcttctgttaccagactatcaattctgtgttactggtgaaggatagaaagtatcttcttttgaaggacaagtttttcactcactgagttttctgctttgggtatatactcaacatgttaagtgcttaatcttttttcccccattcccctttttctactgtagtgtgttttgtttgtttgttttttgtttttgtttttttttaattatttgaagagtcacttgtctggatgcttcgttctagtagaatttggctgatttttttcccaacaccttttagtggaatgcagtaacagatgcatggagggagaattggtcttaacagtatttttaggtttcatctgtgtcagagagagatctcttccctttattgatttcttgcatacactatccacactacagcttgaaacagctacaacagtgtttgaaaaattggttgttcctcactgttcaaaccatttttcaaaacagtcgttacaagcttcattttactttctgttataaggagggttttgtttgggttggtttcattttccttgtggcgtcatgctagcagagaaacacagtcaggaatatagcttttaaatgtggtatgattgggattataaccatatcagaatctatattgaaaatttattagattgagccatgtgcagttaaaaagaaagaagtcagaagtcttcgatatttttcacaaacatgaacaccatctcatgcaaacgttaaaattcaccaaacaaatgataccccactgttggaaagatattttctcatgtcaacaactcaggaaggagtggggagggaatgggacatatacatgtaaaatttttctctatatttttgataataactctctgtgaatatgttttactacctaggtaatgcttatatttgtaaaaacatatagttatatcagaaagtcaattttgaataaacctgagaatggcaaactataatttttaaaatactaaccttttagaactgttcattttcacttttatttccaggactcactatcttaaagagaagaataaaagttgaagatccttgggattaacagaaagggtggaaatagccaaatgtattcatatttttggccaggcgcagtggcttatgcctgtagtcccagcactttgagaggctgaggcaggcagatcacctaaggtcaggagctcgagaccagcctggccaacatggtgaaaccctctctctactaaaaatataaaaaattagccaggcatggtggtacacacctgtaatcccagttcgggaggctgaggcaggagaattgcttgaacccaggagatggaggttgcagtgagcaaagactgagccactacactccagcctgggtgacagagcaagattctgtctcaataaaataaaataaaatgacgttcatatttttaaaatacagcaatattcatttgtttaaaaaacaagattgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaaaaaaaccaagattgagagcacagttatatagtgacttttgatacatacacaataaaacttattgaattttcaaaaagtgagaaaaaaactactctgctttaaatttaaagtaataaataataatgaagacatatcaacattggtaactgtcagagtgagaaaaggaaattgaacattcaatgtgaccagaggaagggtgaacatgggagatactgcccaggaaaagtgctcatgatgagtaattcaaagacccagaatcttaacataaattttttatagttttcttttcaagggactatttgaaaaaagatggttctggggtttttgttgtagcttctttctttctttctttctttctttctttctttctttctttctttctttctttcttctttctttctttcttttctctctctctctctctctctctctctttctttcttttggctttgttgtagcttcctctttctctctctctctttctctttctttctagctaaaatttcactctaaattccaggaaattttcacgagatccttttagaggttctgacacaaataaagtaaaagtaaacctgttgtggcaaagttactaactagtctacactaactctcagtccttgctcaaagcaaaataatggagtttggggtgcaatctggtgaactcaatggtccaactgcataaaggcaaagaggaaagccaggcttgggcacttctgtagaaaatgaagattactggtttgaaggccagtcttctcactgcttcactgtatgtggtgactattgttaaattagatatccctattctgatgaaaaggcaatgtgctatttttggggtatacatgtttcaagctgtaaactgcaaagtgctgtataaaagtaaagtggtgttaatgcctcataagataaacatatagattgatgatggaggcatttaaaatgctttaattgcccactttaataaagcactaaataattataataaaaacaattcttcagaaaacttggtgggaaaaaggcctacaggatatgtttgttaagaataattagattttagttttggaggaaaaggtaggacaagtcacaggaggcactcgatgagaagtcaggaatgcctagtacataagccacacatattaagttgtagtttcttcaaaactgacaataacatgtcctccaaaaccaaagggaaaatcaaaggatgttgcctatacttatgtaccttttgctactggagatctagtcaatctatagccttggattcatagttctataacatgacaacatagcaaaatctcaccaacactttgttttaaagaaattggcagctgggtgcggtggctcaagcctgtaatccatgaactttgggaggccaaggtgggcggatcacaaggtcaggaatttgagaccagcctggccaacatagtgaaaccccgtcgctactaaaaatacaaaaaagtagctgggtgtggcggtggatacctgtaatcctggctacttgggaggcagaggcaagagaatcacttgaacccaggaggcggagcttgcagtgagccgagatcgcaccattgcactccaacccaggcaacagtccgtgactccatcaaagaaagaaagaaagaaaaggaaggaaggaaggaaggaaggaaggaaggaaggaaggaaggaaggaaggaataaattggctatgcctccaagtgaattatactataaacttctttcccattaccaataatgtaaatatataaccaggcacaagcatgtggaaatggagaaaggatgaacgttagtcttagaaactttggtttgtatcccatttccaccttttaacaagtcatttagcctctctaggtcaagattttcttacctattaaatgaagataatggtacccatctcacaaaattgttttaagaattaaatgtaaaatgcttggcacagagaggtcactcaatacatggcagccaaatcaccacatgcagtaaaacccagataaaatatattcagccaggactgttgctctgtgagtaggtctggtatccatgctacaaaatctattaagcctaaataatttggtcattttagcaatactctttagagattttttaatgacatttcccaaaggtcaagctagcttatggttatgtggaactgctgcatttataagagagtttagtgggttcataaaataagtcttgctccccaaatccggatcataaagaccttctatcataaaggataagagtgacatttaaaaaaccagtttttaaaaaatgatggtagcaaataaatgcagatgatcaggatgacagcaagtaccaagtcaaagcaacacggagaagaaataggccctagcctgcaggttacactttaaacactgaggagaaatgggagagtaaagagcaacactgagcctcatcggactgtaggtgaaaaaagattcaaaatctgactctaaagcaataggtaaagaaatattttaaaatgcttatctgtaggaagaaaagcagtaaagcagaattcctaggaattgagaaacacttaggaagaaaatgcttaagtagtacgatccaaggtgaggctagctgcagaaaatacaaatatttatgggttaaatcaggactgaggaaaatataaagccaaatatgggcagctctgagggggaaaaaataggcagcttggtactcaactgtcatcacaattcatttgtgtttcacgtcccactgtttgtgacattaacagaattttgaatttagcaatggactatttttgtattgtgaatctctgcagccattttccatatgtagctaccactgtaactagcaataacagccttttgagctttaaaatgcttccaattaataagattcaaaataggggtcacctaagagttttccaagttaattccctttgtctactctttgaagcagagtggtattcctgctattcatttgcattgaggccaaattatttgaccatttcagtaagatatccttaggtagcttttgcttttattgtcattttccaaaggattaagttagttttagatttttgaactgcattttcatttaactaaaataactaaagcaatctttttatgagggtatttaaatagatcaaatttataccaagttcctactgtgtgtcaaacattagcaaagcaatttaaaatgttattatttatatatcaatacatacaaatcatatgtgttatatattaatgagcttatagccattatacacaggacttttatgtgttattattgttgtggttatttctgttgttcgcaggtatcagttatcaagtacctattatgttccaagaactctaccaaggactatacacactcaccatgtaatgaagatattattggtttattttccatttgaagatttagtcacaaaaagtaacttgtccatgagcatataatttgtgcattctcttaaaatcacttaaacttccacgtaacacctggattgacgtatgctttttcttacaaaatatacttcaattcaataaagattctttagtcacctactatgtggcacctgctaggatagttatctttgtttgctattatgctaaatcacagatctgaccattagaatctcttccttcctgaaaataccctctttaggtaaaactgtatttcttatcattttccatcactgattgaataaagaaaggtggcactatctggaaaacataagagcgttggatttacaagtttcttttaataaaacaaaccaagttaatcacaaattgttgcaacaaaatatgtgacatgaagggcatttaaggcacatttagacattatttctatctagaaacagaaatttagtccacataatgtcatttatctactgagctaaatcgtattacaattttcatctataaaatccagattcttaatgtgtgttggaaagataatatctctgacccgctctcagtaagaaatgtgttttgaattgttttgttagtaataataatggagttgtactggacaaaatatattttcagcaagtttctctggtaataaaaataactataatagtagtaataatactagtaatcaccaataaataatagatagcatttattgaactctactatgtgccaggtactgtgattagcactttacatgtattatcttattaatttctcaaaatattacatgaggtaagtaccgtaaatccaatttaacagaaaagcacattgagatatagaaatccaataatttggtaaagatcacacagatagaaaagaggtacaagtcaggattggaacccaaggaatctgactctcgtatctatctactctaggtgggggatatagcaggtgctatggtgtttgttcaagagaatactccatttgtgttgttttatctaccttattagggttggggcccatttggtctgtaagccaaatctgaagacagctgaaatgagttaaggtttgaattagtgctattcacactatctgccaattaaaatgctcccttctgagaagctgtagccagttggcataaccttaggacataatacatgctcaaaaaagtatctgatgaatgttaacaatggtttctctaagtggtgattttactttctttaaaaaatactttttcctattgtctgaaatattttcaacatgggcacattacttaggtgatcaaggggaaattcaggactttacttaaaaaatgtttttgttttgttttacaattaggttgttagtctcagttaaaacataactcctgctgggaagcctttcctgttgctgtactctctgaccttttgaaggacagtactccttactctgtctgcctcagaaccttatgaaggccacatactattgttaattatcagtcttctctgctttatgtgaagtcccttgaagattgaccccattacttatctacctcttagagctctaagcatcttgagtgcctaccactcagttcaatgaaaaaacccagaacacacatacaccagaacaagcacaaaagatgaaaaagaattattttagggttgacaatgcacactcttggtatttgcagatgacttgtttctccccttacattatgtgcaggtccccatggaaagaagtttcccacaagaagtgtcttgaatttactggtctcttctctggaggattttacaaatgcatcaaggaatacacacacacacacatacatacacattatgaaataatatgaggataattagaagtaatggggaacacaggaggcaatttctaaaaaatgaagcatattttttatatatataatgtatatatgtatacctgtatataatgtatatatgtatacctgtatatataatgtatatatgtatacctgtatatataatgtatatatgtatacctgtatatataatgtatatatgtatacattatatataatgtatatataatgtatatacacatacatgtatgtatatatatacacacacgtatatatatatatatatatacacacacacttttttttttgagacagagtttcgctttgttccccaggctggagtgcaatggagcgatctcagctcactgcaacctccgcctcccgagttcaagcgattctcctgcttcagccacccaagtagctttgattacaggcatgtgctaccacgcccagctaattttgcatttttaatagagacggggttttgccatgatggccaggctggtctcaaactcctgacctcaggtgatctgcccgccttggccttccaaagtgctgagattacaggcgtgagctaccacacccagccacatttatattttatattaagtaattttgttcctttcctaccccattataatataaacttcatgaaagtagaaactttattttattcactacagtatccctagtccataaaagaaggcatggcattacatcctcaataaatatatgtcgaaaagaaggaaaaaggtatagatgtttccactgtatttcttatatttttctggaaacaaaggggaaaggtgttcccaaaaggtttccaggaaaacttcaatcaccaatgaaactgcaagctcttgtcatgttcctcagaccactacctaattaattcctttatgtgcaatacatcctttctagcctgttgatactcaatttctggcgctgctgtaacttgtggagcaaagagtgccacgtgagaggtgcttgggccccttcatactgtgcctcacctgcgaactggggaggccactgccatttaggctccagcatcttttacaggccagctgagccaccagaagggaaggggagaaagagacatgcaagttctcagaatgtctggtatattcactcacacacatttctcttctcttctcaaaaaggatcctggcaacaaatcactgattaatgatgagagaaatggaatcaggaggaccccatgataccctctcatcctagttttgggagataaaatctcccactgtggggaggaggaagaccctacagggttttcttatgttttgcagcttccaaattgtagtagggtcctattctataaaattgctaccaacaactgtatacttagtgatataataccatatggaaccttgagttttacttaaagagtagattatgtggcaattcatagttatcctagtatggataagaaaatatcctagtaataacataattattctagttatgagtttttttcagacaagaaactcttttattcatctttttatctctagtgcccagactcaacatatgactttgtatatagtagttcttaataaatgatagcttaaaaattaaataatatttttaaaatggtgagatatggcttaaaggggttcaaacaaattcagagttttgtctaatctaggtgtttctagatttatgagcaggcaatcacatattattgagtatgtattagtgttttagttagtgttaatacagtataataaaccctcattgattgttgtagagaaatcctactattttacactcatatactagaaatgtttaaagtcacaattttaaaatagtggacttcaaactttattatgcacaactaacctgggcagtttcctaaactgcagatccaggctacattctcagagcttctgatttagaaattctggaatggggttcaggaatctccattttaacaggtgctctagataatcctgatataggtaatccctaggtaatcctgatacagttggtccttggactacttaccatggactaggctacaaggtaatataataataaatctatacagttcaccttttcaatacgaagagaagagactagcctattaaatgtgacttaactatcaaaattacccgtgaaaagaataggcaatttgctaagacttctcaaaatgaaccaagggaggacataagggcgagaaatattaaatttcaagccagaaatgactctttttaaaacttcaaagagactgacaatctgcttaaagtaaaagtggaagaagaatggcagcagtacagaagtgttttatgaacaatttaggaaagcaacattgattcaagaggtttatttgataacatgttttaatggttattataaaagtgaatgccttctaatctttgatttgctgctaaaatatatatgtatttatttacatgaaattttttttttaaattccccccttaactccctactttccacacatttttagcttgccaacattactgcgttaatggtgtcctttttttctctctctagaaacacatgccctgggattaaaaggggattactttggtctacttccacatccatgtcccagggaaggtactgcttctgcttccgacctgacctttaggtatctgcagccttcaattctttacagtgggagttgctttagcattgatttcttggaaaactaagagctgttttcaaaagccattttcaagacaaataatgaaaattattttcttatgcttatggatgttacaaactgtgtaacaagcttttctctttaactttgctgcaagaaagtttaaaggcaactgtatagcacttcactgaatatagttttatgctgacctcacttctaactccatttttatatcctttcctttattgttttatttttcttacctatttctaattcatgtattttgctgcaatcatgtatttatgtttattttttcattgtcagccattttaattcccttattggtgcaataaatagtaaataagacaaataaacaaaacaaaaacatatgtatgtatgtgtatttggtatttacatcgcatgtactcaaaataaaaaataaaaactaaccacctaaaataattgacatatttcattattctttgggctatagattcacttgactgcagcacttccatttagggagatataaaattaaaataccaccatgaaaaaatccatatgaaatttgacataggtattttcagccccaggtcattaattcagttctgactgacatctttcagttctgttttaaaatttttgtgttcagtctttcgattacacacacaaaaaagttttggcttaatcagcctaataaagtgtatatttctgaaaacatttttatgtaaacaaatatagaagtatacatgatacatacacatacattttttacttagagtcttcaaaccaaatatttcagtcctttgcttccagtattattttcttttaagtaaatacttttcattaagcaacaaagagtgatagtcatctcaacaccaaaaacttgtattcaggctaagtttagtctactttgcatattttcctctgagaatgatccagccagtctcagtctgattctagtaaaactcaggtaatgtggaagaactctaattgagtattagacattttaacaattatattcatattgatatgtccttatacgaccactctaggtgaaatattactatgcttgggacttaaatatgatttttgttcttttattaatttctgaatctcatatccttccagataccaaaggaatacagtaccacctgggaataatgtcaattttcactttaaaaaaatattttgttgcttttcccctcagcatgggcaaccaatagctgattcatactttcattacatcacagttggattacagaagggctctttagtctggcctccgcatgtctcttgcaactcatttgtagacagcccagaaactagcagctggacttcatttttgttccagcagtcaccattttatagtgtttctctaagtcactgtgagtttcactgatgacaagtctaaaactccacaggtattcatatttagtgggttaaatcagagagaaaggattatgcttaactttctataggttcatgtcactcaactatactttgccattcacttaccatacgtcaaaaaggtggaataatactattcttacatagaggactaataagatatacttagcaaaagtaggtggttgcaaaacatttttttaaaaatcagagtgctgtatttttaaaatcttgcatagaactctggttcaatttttgagtccttccaatttctcataactctgtggtattcataataaagcaggcagatggttaagtctctgaacatatgctttaaatgccccctttgctatttctaaataatggaccaaattttgccctcaaatagtcacaggaaactttaaggaggctgcctcttgaaatctgaggacagaatgtgatccagtgggaattaaacctttaaaaaatatattttctaaactttcttatgagctctattccctataccaagacaaattacattttttaataaaataggatatagtaagagaaaaatcctaaccaatacaatattacttggctcaaggaatagattagaaggcaacatatgttttatttatttatattttaaaattctgattttctaaaacatgagagtcatctgattaatttctgtgtgattaccagattttccatttttattattattcctattactagtatcatgtagatgttatattgttaaaacatcttgcaattattaattagttaatttagtttaaattatgattatgcctttgttttaaatcaatgtttttcatagttattaaaagccaaaagcactatttttccagtcacttactttcatttcaaaaacagtttgttgtcgatgaaagcgcattttccaggttatcacagaatatgcaattcatctgcaatggatatatatattctggtaatgttgctcacataacctagctgtacttgtaagagtatctctgtttcttaatgtctatattttatacatggaattaaccttcatttgcacactcatatttctatgtatttaaatttattcctgaaagacctctgaactagtctctcctgtcttacgatgtccacaaaacttagcagtctgattaacattacagataaaaagaccacacaattgacaataaggacactttagttattatagacgtctgaagtttaagtattccaaaactataatgtccctttagaaattctcaataaggattagcttggtcctaatgaaaacagtgtttacttttaaaaataaatgcaatagttgtacccaaatatgttcgaaacactgtatgacgtgtcataatcaacaatgttgaaaataactaaagatctttaaatcaagtgataattttacacatatatccacaaatatctgaacaaaatttataattactattgggacaaaacattaacatattcttctgctaataaagacaaacaactttgagaaaatcctctctcattctcacgtctctaactttcacaataaatgcagcactgaaactaaatttccaactcagaaatacgctgagctccaataaacaagttgattttaaaaactcaccagactaacagttatgctttttcccttatctttcctttgctttcccttgttctttcactttccatgcacacacaatcacacttacctgcacaagtctgaaacatcagtctatgtattttttttgaaatgtactctgtaccgatgcatttttctgtgtttctttctaaccctcgagaatgttaagaatttaggaagagagccacagcttaagagtgcaattatttgccagtaaatactcaatttgcttgtcctgtgatttttcttctaacttgcatattcaataatccgtccctgactgcgtcacgagcacaaaaagtcttttctccaaaggagaagactttcgccaatcaaccttcagccatgccagggcacagcttgtcagggtgatttgttagctttaattaataattcctcacactggccattttcacaaataatgcagtgaggctgggaggctagattgctatgattcagacagataaaactacagtggaaaggggatggggaggggtgtgggggaattcagatgccgtttataaacacctctaatcatactctttcagtttacaatatagaggacatctcagttgaattaccacgttatgtccaccaatttgtattcagatggaaaccatatgttcctccactttatctgctagggactccctggtgccaacacagtcattgggcagacaacattcacaaaagaggtctctagcctctggattgcaaaagtttactgcagggtgaagttgagaaatcagacatatactgcacttctcagtgagcttgggtaacagtctggaaacacagaagtatgagttatgagtgtcagattttctcttatcctgctatgtgatactgggcatttcatttagccttaaaaaaaaaatctcatacctcatcctcaaatcagtttgcaacaatgactgatttgttcatgcattctatgaacatttattgactcccaaatatatgctacacactgtattaaatgctgagaattttgcttgaaagtaagacttttccatttaactgacaatccatgggcttgaacaaagccaccaaacagatagtgtgcaaataaaaataaggatttctaacagtttctgtgtggctcaaccaaataatcagtaattgacaacacacttgagtccattatgcaaaagtaatgctcggggtaaaaaagaatatacagagattaaaaaatatgtttttcaaagattaaaaaatttccctcaaagtgactagagcactaagaaacatattaatatgttcataaacaatttccaaagattcacaatcactttaggaacatacaaataaaaaaattttattaatgtccttaatcttatataagaatatatgcctgtgtttgagactgcaaatttattaatttattggatacatatttattgagcatctactctatttcaggaactgaataatattggagataagtaaagcacagcctcgttattcaagaagctcacaatttagtcaccagactctaaaagagaaaacacacatctcaactgaaaactgtaatacaatatagccagagcaatgacacaaatatacataaacatgtaggatgggcctcctagaagtgatgcatcaactatttgtaaaggttgggtagaagtaccagtggtgagaagaacattctagggagaggcaaacctttgaaccctttctcaaactgttactagaagcagagcaccagttctagaaaagatgggatttaatacatgacaatttcagataaatgtttcagatggtaaatattgcaggatttaaaaataaacttattaagaaacaaatgttccccaaaactataatgtcttgatatcatcaaaaaagcatgcagcatctctagcactggcacatagtaacatacatgtctttctcactttgtgtgtttcagttctctgaggcaaacatgaaacatgcttgacacacactgcctttctgtgttttcttgcctatttatcttcttttactatgggcaggcttctactgcttctgttttcactgtaccataagataaatcatatttgcatgactgttaaaggaaggggaaaaatctgtgtccattttgtggtcacacatctacttctagtcagatagcacatgctatatgggactaagagtgcaaatgttaaatgagaaaggaaataatactcctaaacccccaaaaagctctttcatagatagtaaatactcctagaaactatacagaattcttggtgttatttaacattttgctttatattatatttaacagtgtaaggcaacagccagaatactatttaccatagttcagtaacatctagccatttaaagaatttacaaagtttattaattcattaaatatgtatgtattgagctcctactatatactgagcacttatcagtaaatgtttgatttttattcccacaatgcttacacataataatagttaacattcattgagtgctgactatatgctagggactaatctaaggactttacatatagtatctcatttaattcccacagtaacattatatgttaggtactattaccacctccatttagtatattatgaaactcacaagtagagaagctagatatacactatgtgaattcattctacacaatgagaccagggcaactaatgtccaccaaaaatcagatttattactttatagttacacagtcacaagtaatgtttatgttgtgaaaattaaagaaaataagtccgggcacggtggctcaagactgtattcccagcactttgggaggctgagctgggtggatcacctgaagtcaggagttcgagaccagcctggccaacatggtgaaatcctgtctctaataaaaatacaaaaactagatggggtggtggcagaaagctgtaatcccatctacttggggggctgaggtaggagaatcgcctgaacctgggagatggaggttccagtgagccgagatcatgccactgcactctggcctgggtgacagagccagactccatctcaaaaaaaaagaaaaaaaaaaaagaaagaaaatgatatgcttaatgtgcatagcacaaaatctagcccagaataggtgtaaaatatatggcatttgaagtattcagagttaaagattaccacatacaactaagacttactgtttctggaccaaatgaccatatattattgaagcctatcttagacaataaatgtaaataaatcttagctaaagcaaattagccttggtagtctgggagggttttcctttgaagatgttaataatatagttgaactggttgtgtttaagaaagcagagctgacagacaaaatagagatagatgacacaggaactcaccagttaataatagaaaaaattcttgtttttccaagtgattaatacaatattacattgtatttaatgtagatgaaaaagcttatttggtactcactggggaagccaccactcagtataatcatatgctcttttcaaataatcccatgctgctaactttacagctaactgccagcatttgccaactccgggcactctgatgccctctccacattctttcttctctcttgacattgactaagtccagccacccataattcttgacctaaactatggcacaaatatccatgaaacagaacatttatttttggtgataaagctggttctagatgaaatggtggtatttctttatggaggagctgcaaggaggctctcttcatttgcttgtgtgtgtaagtaaagtttctgatttgggataaaggactgcctggaccctcaattattggtgtttattctatggatattggctgagatattttgtatgggaaaaccagcagatgagttaatgagcatccgtctgagccatactaacctagtggcacctcctgggaagccagggcgttctagaatctgtttatttctcaaatgaaaatcctaattcatagaagttaaaagtatagaagacaacttcacgtactctttcttcatgatacctggattggttacaacttagtaaaattttagcctgtttggtccctccttccttactggctgtctgagtctctagccttatataggaaaaccttgtcttctaattgaaaatgatgacaaacagaagttatgacagacacatttcaaagtagatgctatttttcccaaataaatttcacatacattctaattcctaaacttatatattttcacatactttatataaatacctgacaccttaaaatgttttacttagtgagacctagataatgaaggaataaaaaggtgacttaatcccagtttttctaaacaagaagtttagaactcacgtattttaaacttgttaagtgatgatcaatataatgggctgtatatttggttgagagttaaaaatctaaagttttctcagagtactttaaggcattgctttctcagtggaaatcttcgaccttcacattctcaaaaggagaaaaatgtttcttgtcagaaaactagtcatggctagtccataagaagaagtccaagattgtatcagcttccctgtgaccttgctatgagatttgctacaagtaatttaatgcttttctatgtctcagtttactttttatctatgatacctcaatgatattattaagataatgtggatcaagtgttttgatcattgcatagaacatatgcatagaacatagaatatagaaatccccaaatataagaatgaaaacttaaattgttagaatgacactaactctgctacaaccttaaatagcatatatagtacctcagtgtctccatttttttcagctataaaatgagaatagtcatctttatgtttttcattaaacagtatattggaataaatagagattattacaaaatctgttgaaagatttcaacaaaatgtcatacatgcaagtgaggtgatgaatatattaattggcttgattaaatatttctaaaatgcatacacagatcaaaatatcacattgtaccccataaaaatacataattatttttcaattaaaaataaataaataaaattaaaatgtaatcaaacctctgaagctgattttcaaatatattagaggaattgattttaaaatatcaaagcgtaagaagtaaatgttttcaagcatattcagacacttatgaaggaagactattaaaagacagggagcaggactgccttttctttgtgtggctggctgcattttatgatggattcaaaaccccagtaatgagaaaatataatcagaaaaagtgatttttagcaggctgttgaatgacacataaaataaaatgtattcattaatgagtcagcaaaaatgttatgcatgagctttcagagccagaatttttaagcagctttttcatacttggtacagccatgttcctgaagtatcctctcacaacccccttctacctctctctctctctctttttttttttttttgtcctgtactgccaggttggaataatgaccaaagggaggggcaaaacaaacagatatgctcactgtggcagaagtcactccaaagatcaaagactcgattcagccgtggctgccaaaatcagaaccacagtgggtgctcatcagcacggtgccctcagaaccacatgggctacccttgataggttagcagcttggggtgcaggccccgcatcctgcttagaaccacctgctgagaactggatgtgcacattaccttacccactcacaacatttgatttcaactcaattctgctctagtattatgtttattgaatgacggaagtctaacagacactgtaaaaatccaatttcacatcttatagtacccaaaagggaactgtgattttcctatatcagtgagcaaaatcttgagcaattagtaaacaagatcaccaatttctagtatttctatgagatatatttctttagttttctgtaaggagaaaataatatattggtaccttagtatccagcaatcttatattcatttatagggttatctcaagttaacatagtcaaaaacccagaagagggaaaatagagcccttgggaaatgaaaagaaatgccataaggtacacgctgttgcccaaatacatcattacttaccaaggagactttaatttggaaccaatttattcttctttaatacacagtaacaccagtaatctggaccctccattcatattacatgggaagaaaacactttcggaagaaagtacaatgatatctgtaagaaatgatggctctatctcagaatgaagaggagacagaggaggtgagggagaaataaaagtatgcaaagctaagaactatgtacagcttgcaaacatctctattattgagtcctgcagaaatcattgtggtaaagctctgcacaaaaaatagtgttcataattattatgggtttaattgtgccctcccaaaattcatatgttaaatttctaaccccaagtatctcagaaaatgaccatatttggaaatagggtccctaattaagatgcagtcgtaatggagtaaggtggttctctactcaagtatgacttatgcctgtagagaaaggggaaatttggacatgggcacacatacactgggagaatgctatattaaagatgaaggcagaaatcagggagatgccttacaggtcaaggaattccaacgattgccataaactccagaaactaagcaagaggcatgaaacagattccctcccacaaccctcataaggaaccatcccttctaatagcttgatctcagacttcttgcttccagaactgtgatccaataaatctctgttgtttaaacaacccaatttatgatattctattatggcagccctaggaaactaatacaataatgattatcaggaaatcatcatgtaaagactaaatcaagttcagaatatattgtttaagaaggttgaaaaatataagattcattgcagaaaacgaatcaatatgcttttgcagaaataaagcattcagtgtttgagtggcacaaatatcgaaacaataaatgatttctttacatggaacatatggttttcaatttttcctaatccaatgagatgttgccatctttactaaaaagacaaactgaaatatactctacagaacacgtcaaagaaagagtccccaacctccaagaagcattttgactaagaaggaagataaatatcaacttatttttatttgtttgtttaaaatacacagcctaatatggatgaaacggttacaaagagaagttctgggtaaagaagaggttgtctacttagaagaaaactactaataaatggggtttgaatctacataaaaattaaaaggcattcatccagatgagaagttaaagagaattctaagtatgaagaatggagaaacatgagaggactgaacaaagcaagagtaagagaaggtaggggcagaaacaacagcagagggaatatgagaaggctagctggtattgagagtgttatcaatctgaaatgggcacagaaacggataaaaaagcctgtagacaggtaagaaagacaagaaacagtaacattcccatatttaaacaagaagttgaaaacatctagtgcaagaattaagctctaatctttaaaacaggtgctcttaaatgcttttgcatgaataagagactgtaccttgatttttcttcaaaaggattcaatagtgggatggaaatgtgtgtgtgtgtgtgtgtgtgtgtgtgtgtgtgtgtgtgtataagctaagctgttactgcaggtaggtcaatgaagaaatacttcatggaacaggaagttatagcgttatacaatgtgttccctggagaagtttaaaaaaacacacacaaaatagccctatgaagtttgtttgctctgttaaatagctttaaaattctacccctactaattgttcttaacattttatttcagccaattatcaatttaatctgggagaagaaagatctacttgactttctgacagccaagtcaatccaactagaaaattcaaaccctacaagaaaactgctttgcaacatttttaactgacaacagaaatccatgataacataatcacctttttctttctttcccaaactcattctctctaaagaaaataaacaatggtacaaagatacttggatgaaatgaaaaagtgaagagagctattccctctttatggtaataggatgttcttgttcaagatggttaaaaatgtaacctgagttctttttcaattctctatagaagttggagatggtcttgtctacatatctaaagtaactgaattatatcagcaaatataagaattacagcttaatttcacccattttctatcttaaataattcataaattaattagtctctttattttattcattggaaaaatgttggcttagatgatgatattcaagtagggacccaaaatgttaaaaacgaagataaggaataggttttgcatagatactaccttttttcccactgatttctatggattttctattacagaaataacttctgcagagcactagtacttctgcagaacagagtaggatattctcaaaactgggatggtgataaaatgaataaaatcagcatcaagtgatgagaagcagatgagtaaaggaatatgccacagcactaaaataaaatgggcccttaattaaaagtccttgattaaattttaccttatgaagagaaatattgaaaagaaaaaggaagaaggagagatgaagggaggaaagatggaaggacagaagaaaggaagtgagggagaaaggaaggaagggaggaaggaaacagaaagggaggagggagggagaaaggagaaaaaagtgagttaaaaagcaagaaagaaggaaagaaaaaaaaggtaaagccattatagaggtattttctcatcctttccccactggctggccctctaatcttccttctctgcttcccaccccaatccaaatgtctgggacacaagtaggatagttgggaaaaaggggaaaaaaggaaaatttctttctccagctgatgctcactttggtaccaatagctctaactcaacagttccaagtgtttttaatctcatgtggtcctttgagaataaatgaaacttatcaaccttctctccaaggaaggggtggggagaaagaaaaagcatatttacaaatacatataaagtatacatttagataaaatataaagtatatttgcatacattttcaaagggcttatataaactctgaaattcatccctgcaccatctaattatccattagcttaatatgaaaaaccattggctctagaatctggaccaagccataataaatggttggggatagggatttggagaaatggaaatgagatacaaaacaaaccgagcaaaaacacacacacattaaaaataaaaaggtgttccttctctccaagtcaacccttaaggatctggctcttcattgttcctggaatttagatcaataaaaaatatgacttgaccaataactatttaattaataaaaatagataaaattatatagcaatatatataatattgtagcaattcttcatgttttaatcattaattctacattactccctgttaactgtctttgatagtgcactaatatataatactgccctgattttgaacattagtctaatacttacaataacattgaaaaccaacaccatttaatattgtgattagcaactcatcagacatataggaaattacaaggagactctgcaacagatacaacaaagcaaataaacaataataaactaatttcaatgttttaatggctatatgtaagaggaaacagaccttgccttaactgtactaatgggaattgtttatatttgtttaaaacataataatgtttcgcatagtaattcataatcttcaaatgccttaaagtatatttagctcatctgatgtgactatcaactctggaaagtaaataggagagatatcattatccttttttcataagcgagggaagagaggctacaaacgattaaatgacttcattaatatcacaaatctaacatgtggtagagcaaaggctagaactcacaggttctgatacccagtaattttgctaccatgctacacagtactcaaaaagtattcattacacatagcttgcttaggcacatgtgttgtcttactttggaaatgaggacaatagaatacaccctcaaatgagttgatacccatagcacttattctttcacgataaaattttattttggcacacagtaaaacagaaagtatattagctatttaacaggtgcaaatagatatttttgaacgtgtactgcatatcttatggatgatgtttgcatgtagtacgtgtccatgtgtggggactagtgtacgtttaatcattttgttagaaaaataataccgttgagttaagcctgtgttttattgttaatcatgcatttagtaacagcacaagttgacaaatcacttataattgctacatattatagcagcacaattcacaattgcaaaatcatggagccaacccaaatgcccatcaatcaatgagtggataaagaaactgtggtgtgcatatatatattatatacacacactatcatacatatatactatatacatactattccatcatatatatatgcatatatctgatgcatatgtatctatttgcacctggtaaatagataatatactttcaaatatatctatttgcacctgttaaatagctaatatactttgttttactgtgtgccaaaatgcatatatatatatatatatatatatatatatatatatatatatataatggaatactatgcagccataaaaaggaatgaattaacagcatttgcagtgacctggatgagattggagactattattctaagtgaagtaactccagaatggaaaaccaaaaattgtatgttctcctgatatgtgggagctaagctatgagggtgcaaaggcataggaatgatgcaatgggctaggcatggtggctcagacctgtaatcccagaactttgggaggacgaggtgggtggatcacttgaggtcaggagtttgagaccagcctggcccacatggtgaaaccctgtctctaataaaaatacaaaaattagctgggcatggtggtgtgcacccgtaatcctaggtgctccagaggctgaggcaggagaatcactttaacctggaaggcagaggctgcagtgagctgagatcatgacactgcactccagcctgggcaacagagcaagactccatctcaaaaaaacaagaatgatgcaatggactttggggtcttggaggaaagagtgggaaaggggcgagggatagaagactgcaaatatggtgcagtgtatgctgcttgggtgatgggtacaccaaaactcacaaatcgccactaaagaacttactcgtatagatcacctgaggtcaggagttcaagaccagcctggccaacatggtgaaaccctgtctgtagtaaaaatacaaaaaattagctgggtttggtggtgggtgcctgtaatcccacctactcaggaggctgaggcaggaaaatcacttgaacccaggaggcagtagctgcagtgagctcagtgagctgagattatgccattgcactccagcctgggcaacaagagcaaaactccatcttaaaaaaaaaaaaaggaacttattcatgtaaccaaataccacctgtaccccaataacttatggaaaaaaaaaagaatccacttcatgtagtaatatatgataagcacttagtaaatgccaattgttatgttcttgcctgggcaacttttggttgtcaactgagtagaaaaaagcgccatcttttagaaatctgtaattccttcttatctgtatgttaccttcattttcataaaaggtaagcagtaaagtgtattgtatcatacagtgatgaattttggaaattatgcataacattttaattatagcttgaatatcctttatctacaatatctgggagcagaagtatttaggagtttaggcttttttcggattttggaatatttgcattatatacttaccagttgagtacccctaatccaagagtctgaaatctgaaatactacaatgagcatttcctttgctcatcatgtccatgttcaaaacatttcagattttggagcatttcagatttcagattttcggattagggatgctcagcctgtattttaaatatgaaagacatgcacttgttaaggacttttgcagagattttactttgcaattatgagtcagcccatatatgacttctgttacgcaattgcatatttctcagaactctattttttttcatttgtattacttaaatgtttacttaactgggaaatagaagatttgttttttgttaaagtgcaaataaatgacaaaacaaacctaaataaaaaattagttgatttaaatactcaaaaaacccaaaatgcttcatgaataacatagtagaacatactttgagaaaaaaatataaacatacatatatctgacttcaactatcttgttagttgatttgtgattacttaattagatttattaaataactaaaaactgacttacaaatttataagcatatattcaggtttctgttgtaattaaagtaaaaaaaatagttaaaaatttacaatcttattgtccttatctttcctgtttttacttgggaaattatccttcttacttaaaaattttacttcctgtttttatctctgaaatatatagtctaatatgaaaatacacaagatggcagattgcaggggtgagctcatttcttccttaaggaaatgatataatagaaattataatctagtggatttacctgtactatatttctctcttaatattcaaagcaacccttccatcccaaataccagagccaaccttgaacagaattccaaagtgtggatgaaatttacctccagttcctcttccttatcccctctttgtccacgtttccttttgaccttttggcccttcctttgaccttatctaaagatgtatttctggtgttagaaagtgttagaactttcctcttcattttcagcttaaactgaagtctttatttaacttggattcctaactattgcatccttagcccatattaccaacctatgaattgaaatgttgccatctatctgaccaacctaataatgtcttgcatcctgctctcaataggtcacactctcttagataccagtgaaagacttgagatttttctgtttcctgcatttatctcagccttccatgtgaatcacctgtattaaaattttagtaatccccactttcggaggctgaggcaggcagattgcctgaggtcaggagttcgtgaccagcctggccaacatggtgaaaccccgtctctactaaaaatacaaaaaagtaaccgggcatggtggcacacacctgtagtcccagctacctgggaggctgaggcaggagaatcgcttgaacctgggagatggaggtgcagtgagccgagattaggccactgcaccccagcctgggtaacagagtgagactccgtctcaaaaaaataaaataaaataaaaaataaattagtaatctcatttctgattcacttgatctgggcttacttccttttcccagctgggctctctctatggttctagtatgctttgtagtgattaaaaggattaggataaataaaaccactgccataaaccaaaaaatttctggtctacctcaagccctaatggtcaacttggttttccctcgcccctagttattctgtttatcaaacagaaaataaatactctttaccaagtttcataacatatatattaaaaaaatctactaatagcatttagaaggtgagaattcatactgaatcttctacttctagatcaaaagcactagaatactcagagtactctagaaatgtatgatggaggtaggtgactcattcttttagaattcatctgtgggaggcaaaataattgcaccccaaaatgcccactgcctaaagcccagaacctgtggtacatggcaaaatgttatgttacatgaaaaagcgactctgtaaatgtaatgaaggttgttaacactaaaacagggagagtatcctagattatccaagctggcccagtctaatcatcttaaaagcagagaacttttttggctggaatttggaaaagaggtgtggtagaaggggaaatttgaaagatgtcaagtgtaataatgattcaaggtgctgctgctggctctgacatatagggacagcacacatgcaaggatctaaagatggttcccagctgatagcaaggaaatggagatcttagtcccacaaccatgaggaactgaataagcatgaaagtggattttttttcagagtttcctccagttaagaatccagccgacaccttgattttggccttgtaaagcctacagcagagaaactggtagagccaatctaaacttctgatctgcagaactgtcaaataataaatttgtattgtcataagctgctaagtttgtggttggtacaacagcaacagaaaacaaatatattatccaacatactatcccagtccaaaggccaacagacacattagtttaaaatcatagagtaaagaattgggacaggaaccactactatgaaaaaagaaagttcttaacactataaatacattttccccgatattccttcttttagtcatatcctcagagaaagtaaaatacctcgagactaaaggaaaaagaacacagggagtgtatatctactcaagtgcaaattgtcctcaccaaggaacttcacaaatgtgctcttcctcacaggcaagaatactatactaacagtgcaacattactcaaaccaactaaatccactctcttcaacaggaaaaatctgaaaagagcttgaaagtttataaaggcatgaagataatgaacatttaagaaacaatgaaaaaaagagaaagaaagtccaggcaaatgtacccaaaattcacagatcacatgcctactggggtatgttttgcctactatacaagttgtcttataatcatacctttaaaggaaattatcttcaaaaactatgattatttatttttatatgtcatcaccaaagctagtttttaaaatttatcttccaaaatgaattttctttcttactcatattttttacacagctagcttctggtcttaactgaacaaaggaatattggaagaaaggcagttatttccaatgattttcggcattgaagatttagaaaagttaacctttgaaaatttactcaacttcagaacctaaaactttttgaggtataactaccaacaacatgctgaaaacaaatacttttgcaatcgactagaaataattttcacagtaaaaggtaaattctcagcacgctgcacatattctactttataattatatcacagtatgaaataatatgaaagaaaataaggggaacaaaccaatataatgatttaaaattcttatagaaacaggataaatgaagttaattttatttttctgttgagatagaaaatatactgagctaaaaattactaataccacactttgaatcttcccttttgtcttccatggaggccacacatggaaggatagctccaatgacctgggtaagggcaatgcaggatagaaatggccacgtgagaaaatgtacacacattcctttcttttgaataccacattctgcttcctagaggtccctgtaaacttattaaaaacttcagtcattttgtaaggagataccataatttcaaggggctttgaggctcatttatagcaaattaatccccattttatgtctgtccccatttaatatttctaaagggggtggataacaaatctcgccaactctctttttaagggctattcagatactaaataaaccaggaacatttaaaaatacaatctcacaaaaatctgctttgcttaaccttctctccttctttaaaaaataagaaaggcatgatgttctttttttgttaattaattcattttagacaattccttaaattttcattttaataaatttttgtgtgggtgcattaattactctcaaagatgctttacaactgttacctattaaaagcctttgttagtgaataaaaaaaaagaaaagaaaagaaaaaacttccagcatgctcccttccttctctattctgagcaggtccttgctatcaactgctggagtatgcttgctttgcacctagagctataattattttgctttaattttacaaaaccttttgttccattcccacgagcccacctgatccttatattacactcgctctattaaaacactcatgcagaacaaagcatggctgtactgattcataagtaactttttttttttcctcagtaaaatgccactggctaggcttcgggacacagtcctgggcttcaccatcctatgccaattttcatatgttagaacaaaaaaaatatgttgtatcagagtgttgtactcttccccaagatccttcctttgccccacttgttttttgtgtttttaaacatattttatcttatacttaactttactctggggcaatatacatgacagaatgttgaggatggtggatatattaaaagattgtaatcatgttgatatttcttttattcatgtggttaaaattcttaaaaatgacttctgttgccttatttaattttttttttctttctccttactccacctcttttccttgagatcttgcaatacatgtgggcttttggcaaaaaaaaaaaaaaattgcagtgactcatcaagaaaactgtttgtttgctctgaggagcaccctgaggaccctctgggctgcacacggagccctttgatcctaggaaatttatttcttccagatgttttcccgacagccacctttctgcaatgtccctcttcattatgtagcataagaatactcaagacccactgctatggtacagttttcctgaatggagtgtgacagggagttgacatttgattgagctgttggattcttcttgccttaggcacaatgatggaggaaggttaacactgaggaaaggcagaactgggtctgttcaggtacagtgtctttaggattaggatggaaattatgtgaaccaggccaaagaaattatgtaaaatctacaaatctgcagaccattgatcatggacctagttttcttcaaccctgtaaaatcttgatgcctggatctgccatgttgttactcctccaattttttttctttttttttttttttttactaacatacaaagtgcggacaggaaagttaagcctttggacaactcttgttttttcttggcctggctgacagtgctagcggaaaggagaagggagaacaagggaagaatgcagagcaggtacaaaggtaaacatggtgtggtgggctgaataatgacatctcaaaatgtgtccacgttctaactcttggagtctgaatattaatttaaatgaaaaaaaaaaaagactttgcaggtataattaaattaagaattttgacatatggagcttatcctggattatctagatgggccctaactacaattctatgtatccttgtaacaggaagattccacatggacagaagaggccaacttaatgtgaccagagaagctgagattgcagtgatgtggccacaagccaaaaaacggtagtggtcagcagaagctgaggaaggcaaagaaaaggattctcccctagagcatccagaaggaatgcagccctgctgacatcttgcttctcgcccaatgataccgattttggacttttggcttccagaactgtgagagaatagatttctgatggtttaagtcaccaggcttgtggtagtttgttatagcagccacaggaaactaatacaaatggtaaccatttcaaaactccattgttcagagcatttgtgaaatcactgaagtctcaggttgaaggcacagtggaaaacaggatgccaaggcttgaagacaaaattctctgtggagatactggagatattaagggcacttataatctacagcaagtagggaactaaaacagggcaaagagagtgcacaagggcattcaacagaagattaaacagattatgaatgtaaatgttctaattttctaatgctggtttgcattttttatgaagtaggacaaatctatagtattttccatttaagttaatgcttacacacataatgtattaccagccattttccccctaaatcaattatcagtatcattaactttagtgacatttgatttggcaaatataaactatatttggcacatatatactgtattataaaaataaagatcctctatctgcacttgaggtaactttcctttagctattcaaagaaaaatctatttttaaggtttaacccaaagataatatggaacctaaacccaagaattcttaaatagatatattaaaacaataacttggctgggcatggtggctcacacctgtaatcccagcactttgggaggccgagggaggtcaggacttcaagaccagcctgactaacatggagaaatgctgtctctactaaaaatacaaaattagccgggcatggtggtgcatgcctgtaatcccagctactcgggaggctgaggcaggagaatctcttgaacccaagaggcagaggttgcagtgagccaagatcacaccattgcatgcagccaaaaaacacatgaaaaaatgctcatcatcatgggccatcagagaaatgcaaatcaaaaccacagtgagataccatctcacaccagttagaatggcgatcattaaaaagtcaggaaacaacagatgctggagaggatgtggataaataggaacacttttacactgttggtgggactgtaaactagttcaaccattgtggaagtcggtgtggcgattccgcaggggtctagaactagaaataccatttgactcaaccatcccattactgggtatatacccaaaggattataaatcatgctgctataaagacacatgcacatgtatgtttattgcggcactattcacaatagcaaagacttggaaccaacccaaacgtccaacaatgatagattggattaagaaaatgtggcacatatacaccatggaatactatgcagccataaaaaatgatgagttcatgtcctttgtagggacatggatgaagctggaaaccatcattctcagcaaactatcgcaaagacaaaaaaccaaacactgcatgttctcactcataggtgggaattgaacaatgagaacacatggacacaggaaggggaacatcacacactggggactgttgtggggtggggggaagggggagggatagcattaggagatatacctaatgctaaatgacgagttaatgggtgcagcacaccaacatggcacatgtgtacatatgtaacaaacctgcacgttgtgcacatgtaccctaaaacttaaagtatgttaataataataataataataataataataataataatacacattcaaaaaaaaaagatcacaccgttgcactccagcctcggcaacaagagcaaaactccatctcaaaacaaaacagcaacaacaacaaaaaacccaataacttaaaattggaaaagtccaatagcaaaattattgtgaccaaaccacccagtttatccctttctctagttcatcgttaaaaacacttggtagcagcattattaataaagaactaaaaatacacctgaactctatgattcttcttagctatatggcttttcaacaaccaaaccattaatcttcgtaatcaccatgaagctaatagatgtagactacagatacagataaagaaataagattatggaaagcttaaagagattctagatcaatcagcaaatgagaagaactgagaaaatcaagtagaaatgctggctgcgttctctagtacctttgaaaagctactagagatagaatccttcttttggagaaaatagtccaatgacagaacatgtaaaagatggacagagtcatttattttttgctactttcatattaacacagagtattcatttggcagtagttttcaaaacaagaagaacagtctatttttaaataaaattaaaaaaagtaactgatgattaacataactactgtaccaaaagaaagataacataagtcattcaaagtaccaggaggctaaagaaattctaatagttatccctatacaccttcatttcaataaacatgaaaaatgggaatctcaatgtgttgtcttttcaatttcctaataataccagggggactcaaggcagttcaaatctcaggacttcagaggccactgagttccactatctggggtgctgagcagtcgatatgaattccaacttcatactctccttgtctccttgttctatttgctttaacactatgtacacctaacttatctttagaaggacaggatgcatatcctttctataaaaaaactatgcagattttcatagtgccatataattacaggtactctttatttgtttatgaacccttccaacaacccaataggcaattgttaacattcccatttatcactatctcacctatttctgagttcctagagggttgagaacattcttttcctgttactatcttctcttagttctatcacccctggtaagaagttaagtagtaactagttgacatagaactcacggcaccgaagaatgggtggccaggatcagtgcagattggttcatttgggtttgtaacctttgtgataaattattgagtgctatagagataaaatataaaataatttttaaaaatcctactacaaaactaccttaacccttttagcacagattatgatcctgaaagctaataatctgtactgtgctataacaaatataagaggatgcctttagtatgataaagtttgctgtgatggagaaatggttgagataaatgggactttaaaatcaagagtcaagaacatttggaaagatatgagatacacttaggaatcttacaaatgaacaaggacttgtctctagtttcttagtcataatgtttctaagacacaaattaatcaaaatcccaggttatcagttacttaatataaattttccaataaacaccccttgattacacacttaggtcttcaaagtgggtagatttatacaattcccctctacacaggcaaattacatacacaaaaattatgaagttatttttttctttgaagtagtttagtgaatttttaaaaatctgtaatgaataaaaccagactttaaatcctgaataaaaccagactttaaatcctgaataaaaatgttctgtatcaatgattgtcatgatatgtgtcttggtaatagattattgcataatttttttcttaataaaatggtatctccatcaaacatgtagatcatggagtcttcccatagggacttttaagatcatgtaatccaatccttcattttacagatgaagaaacaatatgtgagtgttttaataaagcctactttaagtttttcattaagacaaaaatggttgttatatgaagagaaaaggagaaaaagaattaatagtagaaagttggaagtgaagagtgaggaaaaacagaaaggctttttcattggtgcagagcactaagcagagatgcattctctaatatatatccatgtcattgctagagactagcttaaatagtacaaagttggtaacatccttctcttttcttttttttgagacggagtctcgttctgttgccaggctggagtgcagtggtgcgatctcggctcactgcaacctccacctcccgggttcaagcgattctcctgcctcagcctcctgagtagctggaacaacagacatgcaccaccatgcccagctaatttttgtatttttagtatagatggggtttcaccatgttggccaggatggtctcgatctcttgatctcatgatcagcccaccttggcctcccaaagtgctgggattacaagcgtgagccaccacgcctggcccgtagtatccatttttaaaataatcacttagattataaacacgtaaacaatttagacaggtttacctctagggaatcatatgacttaccataaataagcaaacatattctgtattaccaacatgctaactgttcattcatttacactgtatattacctctcacttccccagaatatgcaagttgaaggaaacataacaaccattgtaaaactctatcttaaaataaatattattctataaagaaaaaacaaacatttttaagagtcatataaaggcaaattttaatttgaagacttgatactaaggaataaatatatatacctaatatgtattcacaaaagttaaaaactaatttttttaatgtaggctgtggaatcagactccctgggactgaattttgattttgccccatccttgaccttgggcaaattttttctctctgtgcctcagtttcctcaccagtaaaattaggataacaacagtgactatttacaagagttgttgtgaggatggaatgccataaatttacatataaatcttttagaacagggactggcacatagtaattaataaatgttagctgttacttctaatatgtacaagcctgttaaacattttgcaggggggagataaggtgtttctcattaatgggacttgttaaggcattttgtctttcaaatggctgcctaacttaattcataccaatattttatttcagtaggattaatgaaatagtatgaggaaaagccttagtgtggtttctttagacatgtttgagacagatattctcatccttttaaggggagtaatctaaaatgctacacccatttgtggcttaaagtaactgagaagtgactctcacaagatgacatgatttagctgtgtccccatccagatctcatcttgaattgtagctcccataattcccacatattgtgggaggaacccagtgggagataactgaatcatgggggcggtttcccccatactgttctcgtggtagtgaataagtctcatgagatctggtgattttataaggggtttcccctttcgcttggctctttccttctctcttccctgctgccatgtaagatgtgactttcaccttccgccatgattgtgaggtctacccagccacgtgaaactgtgagtccattaaacctttttttctttataaattacccagtcttgcatgtctttattgtgagaacagactaatacacaaggcaaaggagaaaatgggggagcagaagaggcttagcaggatgcatacatcttctgatatggagaacatgaaagcactcactgaggaaagtggaggtgctggctcttcagcaagcaaatgctccacctatatgctcccacagtatcttatacatgtctcaaagcctttaacctgctgctttgtaatgatttgtttacatatacttttttttgttattatatggtcttctacttgaagacaaaaactgtcccattcacttttgctcagtagttgctcagtggcatatttctggattgaatgacttagttaattaataacagttactacaatgggggaggctattgattttaaagcgagagctaagactcacaggttctatccaatggaggggcgtgttgaagtagaagtagctagctattatggtactgacaatggatctctgatctctgtgctggggataaatgctctaagtgagcatgaaatatttttgaagtttatacatgtgtaagttttttttccccttaaccataataactttcttttttaaaaatgcatgaatatttgagtaactaagtgcaatgttaatgttgggtgcaaatataatctgcctaataaaccatggaaaaagcctgaaaataaattcaataaatagagtcctagataatgtgttgtgggagatgagagaataagcaattaattatagatggtggaattaaggtaattttagtagagaaggtaatatttgagcaggatcttgatgcaaatactaaatctaaatctgtgaaaatagagcttatatccttaatgtagaaactggctgatatgcagagataagttgaaagtcctgtgaataggtgacataaacatcaaaggtattcctaattcccaatatacttgaaaaattggctattatttgatgcatatatccctgtatggcaatcagtccagtaaataaaataataataatgtcctttaaaaaattcatttattcatgaatattcattcatccattcactctttcaacctaatgtgataatctactgaatatcaaattccgaactgtgctgagtacattggaaaccacggtggtcaagacagaataaagtctctgcataagaagtaggttcagacaattaaattaataattataatgcaatacatattatgttaggtaaagtactacatgttatggaaatatgtaattataagcaatttatacttaaactcattacataaatatggcagaactatatttggataaagtgctggtggtttttattgaccttgaatttcttctgatttggtcttgtttacctacagagtagactgccacatctgggtcttacttatactgtttgctattcaaaatcttgcctcttgaactacctatttaattatggattcatgaagcacaaatcaatttattttcttaaattccttaagactaaacatggcagcatttttcctactccagtgtttctcttctgttaagatacatcttttggccaggcacggtggctcatgcctgtaatcccagcactttgggaggctgaggcgggtggatcacgaggtcacgagatcgagaccagcttgaccaacatggtgaaaccccgtatctactaaaaatagaaaaattagctgggctggtgacacgtgcctgtaatcccagctactcaggaggctgaggcagaagaattgcttgaatctgggaagcagaggttgcagtgagctgagatcgcgccactgcactccagcctggtgacggagcaagactctgcctcaaaaaaaaaaaaaaaaatacatcctcaggaagatgatggtgatgatgtatgaaactgaaaaaaatatgcttagttttgtgagattagatctacagggctgagaagagtaaaatcttgtttggactagtatattgaacaaaaaccacataggagtcacagtggaaacaattataggcaataccaattcttatcattttaatgaggagaagttaaagttggtcttttcgttgtggttcttaaatgcaaggtataacctatagtccataacaaatttttctttagaaattatcaagtacacagtgggttttctttagaaaccacaattctagattttttaaagcagaaaatatgctgtcctccttcattttaattcttttggaggaatagaactttttttttctttctatagttaactagagttgccacaggcaagaggactaacagagtaaaatactaactgatccaatatatactgcatttatctaactggatttcatctagctcaacatcatggctttgtagtctaagcagtagatgaacagaaacaataaactgggcaagtaatgttttgtgtgaataacagaaaagagtgaacagaaatataacacttcaccattgcacaaaatacaattaaatatgatttttaaaaacccagccactgatccactgcccaatcataaaagaattgtaatcagttcaagtagtcttaaatatagtgaaaatgtcctcaagatacacagcatgagagaacaaagagttttcactatcatctgctggactcagggaaggtgtgctatgtggttatcatttgagtgctctgtgtttaagttaatcaatattataaattatgcatgtattttagaagttcataatttctattaacttgtaaagttattgaaaagaaggatgaataaaccatactacaaaaataagaatgtgaataaatgccagtttttcctcagattacagatgatataacatcgctgctattttaagaaaatgagactggatcagatgtgaacatttatcccttctctttaggatagcctatgaattcaacacattgacactaattataacaatagctaacagttaactggagtactaaccatgtgcaaagcacactgtaattatttcacatatattatctcatttaatgctaacaacaatactatattataaacaaggaaactgaggcaaagggaagtcatttgctctagatcaccagggtagtaacgggtggatgtaggattcaaaccagacatactccagaatccatacaatatcagaatagtctgaccccaaaagacacacacacacaaaatggatctaaccaataccttgggaacatcatctaacttttctgggctttagatccttcagctgaaataggagttgacaaaccttttccaaaaaggataaaatcttaaatattttaggctttgtgggtcaagaggcaaaatcagagatgtcatgctatttaggtaattatataattggagagaaaacttgctgtatctcagccagttagatgaaaaacacataatacaacaggaaaggataatcttcaaactattaaattatattctctttgtacgtctaatgtggagacaaattatattaagaacacggtagctgaaataaaattatttcagattagcacatcaggtgttgaatgttatcagtggttatcttagggggtgacagaagaagattttagggacagagggaagttttttcacttccagttaaaatttattttttaagtggtggaattgattgttatttattattattatattttactttgtgttttggagtagttttcagtattttttcctggttttattgaggtaaaactgacaataattttacacatttaatatgtacaatgtgatggttatcaaatacacattaccacggtcaagattattaacatatccatcacctcatatagttaccattgtgcatgtgtgtgagtatgtgtgtgtgctgagaatacttcagatcttactctctgcgtaaatttaatggatgcaagtcagtattattaactatagtcactatgctgtatatttgatcaccataagttattcatcttataattgaaagtgtgtaccctttgacgaacttctcctgatatccctgtccccagctcctggcaatcaccattttattctttacacttttgaaatctactttttttttcttaatttaattttaagttctgggatacatgtacaggacgtgcaggtttgttacataggcaaacgtgtgccatggtagtgaacagccatgttttcaatacatcacaagccatagtagtgagaaacaccatttctttttttttcttttttaattattattatactttaagttctgggatacatgtgcagaactttcaggtttgttacataggtatacacgtgccatggtggtttgctgcacccatcaacctgtcatctacatcaggtatttctcctaatgctatcccttccccagacccccactccccaacaggccccagtgtgtgatgttccccttcctgtgtccatgtgttctcattgttcagcttccacttatgagtgagaacatgcggtgtttggtcttctgttcttgtgttagtttgctgagaatgatggttttcagcttctttttaaaaagattccacataaaagtgaaatcacacaaaaaaaggaatttcagaaaaactaaaaaattgaattaatatactgtcataggaaaaaacagaatttccaagaggagtgggggaaaataatagtatcagaaatataataataatagatctttttcctgtggaaaatagtacatagaaatagaaagtactgaaaaggagaatcagaaaagattatggctccagaatcacattatcttctacagtttgaagaaaaaaaaatgtggctaaaagaaaaaaagtatttccattacacaccttttataatgactagaataaaaaaatactaatatcaagtattgacaaggatattgacaaggatatggagctactgaaactcttatacattgccagtgggaatgcaaaactggaaattacccaaatgtctttcagtgaattaatggtaaatgatcttctgtatatccatacaaaggaacactacttagcaataaaaaagaaacaaatcgtgaaacatgcaatgatatgaaagaatattttattttatttttttaaagacagggtctcactctattgcccagactaaagtgcatgatcatggttcactgcagtctcaacctccctggctgaagtgatcctcctgcctcagcctcccaagtagctggaaccacaggtgcacatcaccatgcctagtcaattaaaaattttttttccttagagacagggtctccctgtgttgtccaggctggtttcgaattcctgggctcaagcattcctcctcccttggcctcccaaactgctggaactccaggcatgagctaaccatacccagccatgaatgagtcttaatgcatcaagctgagtgaaagaagccagtcttaaaaggttatatatatatatatatatatatatatatatatatatacacacacacacacacacacacacatatatatacatatatatacgtgtgtacacatatatacacgtatatacacatatatatacacatatatacatatatatccatttatatgacacgtatacatatatatccatttatatgacaactcttggaaagacaaaactataatgataaaaagatctgtggttgccatgagttagtggtgagaggatggataaaggaagaagttcttcagtgtgatggaactctttcatattctgatagtggtggtggtgcttgttacataaatctatatatatgttaaaattcatagaactgtataccaagaagtttattaatgtcagtaaaaatattcaacattttcagaggaaaaaagggagtaactgattacatattgaattattggaaaatacaggctcaaataaagccatggtttctcctactaataagataatttggtaagagataacactgttgatgaaaaagaaacctgcagttctacctccctgccattagttgaccaaaatgagaatgtctaacatagctacaaatttaaataattctctgcttgtttaaaacatagtctctaatagttcattacagtcattactgcctgttaatcaaggataacactagtatttgaattttgtaagtatgacagcaaggtaaagactgttacttaagccaataaattaccatatttcataaaaatctaatgattctgtgaacagactatgtagttcaatttttcttctaaaccctgtaactgcaatgtattttcactgatatttttaaagagttttcaaaggtacatttttttattgtggtaaaatatatattaaaaattgaccattttaaccatttttaagtgtacagttcagtggcattatgtatactcacactgttatgcaagtatcaaaaccacctccatctctagaacattttaacttttccatattcaaactgtgtaaccattacataataatcccatttccccttcctcctagcccctggtaacctctattctactttctgtctctaggaatttgactatactaggtacttactcggcacaatgcattaaagttttatccatgctatagcatatgtcagaattttatttctttttaaggaggaataatattccattctatgtatggaccacattttgttaatccatttgtccattcatggacatttggattgttttcaccttttggctatcaactgtgcattccttttgacattattgtcagccaccagttttttcctcactagtcagactcaagtcatattctgacactctttaggaatataggacatttcatttacaatagttaggtttaaacaggatgtattcatttgctctcacactactaataaagatgtacccaagactgggtaattatttaaaaaagaggtttaatggactcacagttccacatggctggtgaggcctcacaatcatggcagaaagtgaaggaggagcaaagacatgtcttatatggaggcaggcgagagagtgtgtgtgtaggggaactactctttataaaaccatcagatctcatgagacttattcactatcatgagaacagcacaggaaaaaccgcccctgtgattcaagtacctcccactgggtgcctcacacaacacacgaagattatgggagctacacttcaagatgagatttgggtagggacagagccaaaccatatcaggggacctttcaagtttggtcacaaggtctaattaattattttcatgcataggatctaaagagcaattgtatatttatcaacttatgtgttcaaatttggtcattagcttaacatatgtgtttgtatgcatgtcacatgcatatctgtgtgatgatacatagagctgtattatgcataatgttaaagctttattattgtctggttagagaagcagtcactatccagaaaaatggtttccaatgtgaagaagcatgttaaatttgacttcactgaattgaaaattttaagatgaaacaggagttgggttcctataagcggttagcgtgcaactagactccatcttttaacaaccaaagcagaacatctgggtgggtccaatgcattaacattttaaaaaaactttataggttttaatatgcagctagaattaggaacctctgagacaaaatgatcctgagttgggggagctaagagtaaacaagtgaaggtaattttaaaagccggttagggcctggagcatactgagatgaagggaagagaaatttagaattataaatagcaaaagatccactcaagctagaaaagattaagtatccttttagagttaagagtagaagaggcatcagttacaaggataattaatatctagattataaggatctgctattataaaacttatactagaacaaaagtcatgaaaatggtctgcggaagtcatgaggtgagaagaagataaacaggtaaatatttaagcagattatagagttctggaaatgtcatcaagtctcttgattgtgtatatttttgttccatttaaacacttgtcctgaggtttataagtgaaacatgatgtaatttatcatctaagtaaacatttatcttatacaccaaagcacggtgaatacacacacacaaacacacacacactcatacacacagacattttcattaacaagaactagtaccaactacagctcaggaaatatttgttgattaaatgaatcagtctgcttacagtatgcattttcttttgtgctgcagaagttgcaatacaaatgaaactaaaacttctgtgtgctgattacttttctcagtctgcttatctgagaattaaagaatttttaaaacaattttatgtattaatttgcaaacttctttaataatagatgttcattgtaactggtgaaacaataaaagctatttaaagaaaaaattaataatctttcctgattcctttttttgttcccaactctgtgaaataaccaatgtgaagaatatggtatgaattattttctatagctttcttcatgttcatataaacatacgcaacatatttattcataaatactcattaccctgaaaattatggtcattcttccaggttaacagctatagatataattcattcttttcctaatggctgcattatcttcaataacatggatgaatcatctgtccatatcatatgatatgcatgtagtccaattcaagaaatcagtatactttttttttttttttttacaaattttactaaaagtattactaaatttttacacaggatgctcaacaaacactgaagacctatctggtaccagctttggtgaccaagaaagaaaatcagtgaggtactcctggttttttgccctccagaaagtcactgactatcataggggagacataacagtaagttttttttttttttaatttgagagaaacttctcagagaatttatagtaacaaatgcttttaaagcaactatttaaaagaagtaatatatcactagcaattcattcttcattgtttccaatgcatgatcagtatttagtagcaacagaagacttccctatatgatgactcaaaaacaaatttccaaccactaagaactcagataaaggaccttactcttgagacctcaaagtgatttacatttccactagtacttctattgtaatatatgatatttataaactagccttattccatggaactctaaatatttaatgcttcacatatatcatttgacttttctgcatgtgtcattaagataggagaaagtgtcccctacagataaggaaaatgatgttaagacaaaactgacaacacctgaatcaagtctccagatagccccatactctttccttccaattatacttgctgccttgctagtggtaagcaatgataacgtagacagtattatgtcatcaattagagagtctcacttagcttgatataatcagtttttatttaaaaatgagagctttccatgcaaactgtttttctatcttctaaaaggcttgtgactaaaacttcactgacaagtttttcaggtgagatgagtgtaggttaactactgagcagccagagtctagtcaggcccctcacactttccagtgctacaagaagatgagcagatgtggggttagatgtggaacccaggttcatagctgtacctgccaaccctaacctagagaagggaagagaacactgatggtaaccatggcaacagtaacaatgctacacatctatcacttattgattatctaacaaagtcttaaaatatcaagtaatgtaagcaaagaacaattcagtgaaattttagcaaaggttaggcaaattttatatggtcaagatagtacatttgcaaacaagtagaagaccttgtcaaaaatctaaatcttctaatatccagtaactctcttgtctgagccaatttattttcctacatctttgaagacattttattaaaaaaggttataactgagaattcgacagtaatcagaagagtgatcttcattctgtattcagtgtctcttgaccccctgaaagaatctcagctcagcatggcttcctcccttttccagttgactcagagaacggtgctttcaaattgccttttgggatacatgaaggggtgcatttagagccaacctgaagtgtaacactctttattgttcctgagaaacgtgtgcccaattccctagaaatttactgtttcaaagagtcacaagctcctgattgcttctcatcagtcttgaagagattagataagcttcctccctcttacaaaagctttttcttcattcaaaattcctttgagaacaaaacattgaaccagaattggatttttaacaaaatattataagattgttgaaaacatttttttttctcctgaggagaccaaacaattcaaaagatatattaatgcacattctgatttagggctactagcaacatattgcaaagagtaaggtggtgccaaagaacaaagtcccttctgctaagcaggaaagatattttttaactgccttactttagaagatttcaatggactgctaagggctttcacacagataatctcagaagtcaaagctcaagaagtagggggaagaaacaactactggaggaccctaacaggtagcattgcttctaattaccgtaaaattgttatgtatactgatgccccacatcccattcccagactcagataattattctacagtaagagttggctttagaatacttgttcaagtgtgtcagtaatagaaaatgacctcttcagaaatgggggtgtttacatgcagtgctcctaaagttggcacacatggaaggtaattcagggttatgtttgcagtggcacccatcatcagcaatgtttcaacccccgtccatctctctgtcctggttttaccaagggattcacttcaaatgtattcctcactggtctttagaaaacagtgctagcaattcataagtatgtttgaattttcaaagtttttctttttctttttctttttttttttttttttgagatggagtcttgctttgttgcccaggctggagtgcaatggtgcgatctcagctcactgcaacctccgcctcctgggtttaagtgattctcctgcctcagcctcccaagtagctgggatttcaggaacctgccaccatccccagctaattttttttatattttttagtagagacagagtttcaccatgttggtcaggctggtctcgaattcctaacttcaagtgatccatacgcctcagcctcccaaagtgacgggattacaggcatgagccaccgtgcctggccccaaagttttgcattttgatagcagcaataaggctgagtaccttcataggcctttacctctgatcacactataaggctttaattaagttagtcttaagaagaaaaatgtacaccaaaccccaattattaaacattggaattattccttcttattggtctaataattacaattttttacttctcattcatttttcaaaggtttttttcagtagatctaggttattggaacgattatatgtgatatgatggggtattgggcacagacacagtaaatcaagatgatgcagaaatgaaagtctaatgctaaagatcttaccaatcttcccagatccccatttttcaaaggaggaaatgtatagaggacattacatttatttccagccattatgatataattataaagccaacctctcaacgcactctctctttttgggaagtctatgacagcaggtattacaattctactttgccagatgaggtgcgtaaaccatagaaaactaactagcatccaagagaagaacagacttggatgtgggtagaataataggaagaacacttacagtcagatatatcagagtatgaatgcaggctcaagcttttttccactaaaatgtatacagcaatgtaatctcactgagcctcagtttctgatactgtgaactaaagattatgacatcaatctacagtcaatgctgtgagaattaaatgtgaagagttttatggagagggcatctgctaaatgtaactatttttcttaccctcctaaattttttcagtcttttagacatttgggctattagagaactaatgacctctgtgaccacactagcttaggctataactaaatgcaacagatttaaaaacaccaagcaggagatagcacagagtttgaatcagtgaggtctaatagtaatacaaacctcacttactggctttgcaattttagatgctacttaatcgttctggggctcagttttttcattataaaatgggaatggttcctactttgctgggtagttgctgagtgtggtagcaaggattacagacaactctttatacagtatctggtatattaggtaaatggattgtaatatatattgttcagattttttattaattaaggtttgtacatagactcatctcctgcacttaatatttctttttctacacaagaccttgaaagggttatgataggggctttgatcacatattagctggtttggctgtggtaatttagctcctgagtattgggattacagtaccagcccctgccattgactatttaactatgacttggataggaattctaggcctgaattttgttcgtctccaaaatgaagaggttagaataaataattcctaagattccctgtcgctataacattttctggttccagggtctttttactgagctatagcagataaatcctcatatctttagagcttaagctacttctctatggtttaatttccacattccctctactctatttcttctttaattgcaaaaggggataatttccatcactttgcaaacaaaccaatatctctattctggcttagtggcataccatgttattaatgcatcatacttaaaaaaagcctggattgttcttcaatccagaaatccagtcatgttgtaggtagtaataatgagaataatgatgatttattttcaaggttttctatgcctccaggtgcccggtcattgcacatgataaaatacaccaaaattaaaaatgagattaaggtttaacagataaaaaatacattctaggaacaaaacacatttttggtatgcatctctacattacacaacagccacttaaaaataaacaaaaacaagaaatccgttaaccaacaacagaattttaataattattaactagaaagaaaataaaattaacttgaccttatcttagaaggttgtcagagatctactctgtttatgcaagtgagaaatatgttttgaattataagacctctatttcagaagtccaagctctcctcaaactcagaggtaaaccttcaggaaggatttaaaataaatgtatggattttgttagcatgtgtatattatttacctttgaattaattttgatcttgtcctattcttgagctatccttcaattggtatttttgtgtgtatctactatgtgctttcccactgcattcagaataaaattaaaattcctcactctggcatttctctgaccacacctccagccattctgctttgctcactttgctctggccactctgaagtccttttagttctttgaatacagaaagtctgattcaaagctttgcatttgaatacaggattttgtatatgcagtttctgtctggagctttctcccctcccatactccgttctctaccccaaattcttcacctggctgatattattttctgtccttcaatgttcaaatcaaaggacactctctctgagaattctgtcctgaacacccaaaggacagtataagagatttcccccactcaatgttgtcttgcatacataacactttatgtggaccacagcttgtaatgttgtaattatgtttgcacttattacatgtctaatttccttaggagactatcaatttcatgatgaaggtctaagggatcatttctatatttctactattaaatatagttgaataatgaatcaatgattctattgtggtagactcagtagggctaagaaatgttaattaaatatggactattcccttaaaattttgttttctagtaaaggaataaggcatacacataaagtgctataaaatatagaaagtaattcctgtctcaataaaagtgtagatgagtattgcattagtttcttagagctgttgtgacaagctaccacaagcttgttggcttataaataatacccaatatttattatctcacagttttggaggctacaagtccaaaatcaagttgtcagcagggtcactacaggtggtaagtaaatttgatagttaggggagagtggattgtttctgtccaggtcaaggaaagaaggattcatgaaattcataacattggaaatgaacttggtaggatgggttggatttgcatatgaaaaaattgaatgatggacattccagatgctggaacaatatgaataaaggtgagtaagagaactcggcctgagtttatagtacatacaacccggtaggtgacaattaactaagaaatgggatcagagttagattttaggatgtcatgtatattgattagggattgttatacacagaattattgaaagttttatctgaacaaaggcgacataatcttagtactcctatattaggaaagttaatggggcagcagtgtttaggataaactgatctccctgctccatctctttcaattaggagatttttgtaagcaagagaagataaaatcctgactggaacaggtatcaaagaaagagaataaatgagacttggccacttactggacatctaggatgtattaagaggaggaaagaatgatatattttgagtaaagatgtcctagagaattggagttagagaagctaggatagtcaaaagcaggatggtttttaagtagaagaataaattaagttttgatatgctgactcagagaaactagtgtgatttctagttgaagatttaaataaggatgttggaaatataggactaaagttctgaagacatatcaggactggagatataaatttctgagttatccatagtgaaataattgaagtcatgtaactctgagaagctgtgtcaagtcatgagaagagtatgaatgtggagtatgacagatgtgatcacatcctgtgtctactatttacctgttgtatatcctggggcaaattgcttaactccaccattttctcatatataaggaagaaaataattttatcccttaattaggattacatgagttaaatatttaaaagctctgtcatgtttaagctgcttttatattttggtgcataattctcataagaaatacacttattttgccatctagtatcttaaaaatatgtgatgtgctttaaaaaatatttattttcctgtgattctagtatatgtgatcttttaaactttcatgacctactaatgcgttgcaacccacactttggaaaactgatcctcccatacattatggttctcatccaattcctcctctagtcactgtccccaacaagcattctatgttgaaatcacaccaatactatcaatgttctcctgactttcatttattactccctcttcataggcttcttgctagtatcacattattccttcatggcctagaaaaaaatgataaccatttacttcctctgctattccatataatgttttgtctataagaaagatgcgattttcccagataaattatgaattccttaataacagaaaatatgtgttatttatctgtgtatcttggtaaaatattttgttataggaggcacagaacattaattcattattataaaggaaagggagaagaggtttgaagagagaactttgttgaacatctacatctaggaccctgctctggtatcaccatgtctcgattcctccttctctatatgccaaagcttccatggaatttttaaagggcagaactattgtctctttgtctttgaggcacaaagacttaaggccactaactttcagtacatggtggagagagggaagacctggatgggttaaaataaaggaagaaactagaaaatgtccagaatttagctttgggtaaaataacaggtttttaccgtagcctctttggattggtaaatgacagaatccaatgaaagcaatgtgaaacaaatgaccagagcaagtaattcattttaaaatattaaagcttatttctttttttttctgactctggaaaacttttctctgatggaaatgacccctggcaacagtgacattctgacaccatgcgtcgtacacacccttgggaagtttgaattccacaccactatggttctgttcagattactggtttcatcatgtctgtaagcccaattaaactactgaagttctaatggtcttatgtccactttgtaaatcatcataaagaatattaagtcaaccaaataaatttgcctctacaggactcgttgctcaaccaaaggcatgatactaggaacaaaattaaaaaacaaaaaaacaaaaaaaaacacacaaaaaaacctcttttgataacaaccaatgttttcaggatactcctttatatatgaatttgagattctgatgaaggggactacaattcaacaagtctcaaaaaatgagcccaaggcaatttgctcctcaggaaacattgcttagaccctgattgtagtggaaagattgaagcctcagattgtaaattcagatagactatcacgtctaggtctctaaggatgatctgcgatggtggtcaatatggtttgtgtaacctttgtgccctaccctgtgcctcaatttgcttatttaaaaatgaagtcactagactttgtttcttacatcctttcccactataatgtttggtgatgctctgcccttacatttgcctaaacttttcaatcttaaaatatataaaatgtttttataaaattcttttatgtccttaaatgttattgaacatgataacagtagaattcactaagcctaaatttcatcattttaatattgcctcagaggtcaagttttatgagagccttaatttgcatcaccagaagctcatttaataaaaatgaaagaatcccttttggaaataaattttaaaaactgatggtggggaagaggggcagataaatgtatgtaaaaaagaaaaaaaaacaacttagaaggtgtcaaatggttctgagttctaaagaatattgtggtcatattagtgttgaaaagttggtcctagctttttatgcactaaaagtacattctgctaatggttccttcccaaatccctggcctcttgacccaatacttattgtaccacttgtcccatttccctgaaacaaaatctataatatggcaagacgaactgaggtatcagagcatcatctaccctggaattgggcatatttatttgtggagttgattctagtgtgtgggatataaaacacacaacttaagtggaaaaatgctgaagaccatttcataggtgaaaaggatgtggtatgaatggtcaattctcactttggtcaggaaaaagaagtgtaaagtcaatgaggtaaggggctgggagatggatacctcgtatgatatgataagcagaaaggttgtgtttggcaaattcctttatcatcttcttcctgactgtcaaaaactgtattcaacctgtgtttacaataaatattctctgacagaatgaaccctggatttctgacttttaaaaagttttgaaattaaactaatagcagctatttcatgattacctattattgtgccaagggttagaaattacaaaaatgagtaagaaagagagagcccctgctcttagagaccttactgtctgtgggtttgaactgttgtagttatgacaacaataacaataactatcatttattcactcataccagccaggcaccatgctcagtgggcaacatacacaaagtgccaaagtctccttcatttcaccagatgcaatcacagtaaggtaaccttgctctgtccgtgcatcatcgcttaacaaaaatgaacttagcaggaattcagaccataggcagagacatataagcaactccagaactgtctactgtcaacacacaagaactacagtcaataaagagtgcaatgaactacagtgaaaatggaagcaattgtctgaatcacctttagtgtactctgttgactgggggctgtgacactctaaaaaccacgatacagtagactccacatctggcattccaacaatagaagggtaagtgttttaagactcttagcgaaagaacttgcaatacattaaactgtaaaactgaggaagacatcataagcttctggattttattaccaaaatgtacattttgatctaaaattaaaaataaaaacagattgactttccttgtagtatttcacaacctttgagtgcagcattaaaaatgcttttcttttttttcttcaccaactataagcttctgttttcttaccctgggcgtctgaatcttttatatgcttgggttctattcactgcctgttattcagacgttgaaatcccaaatgttaattgttcttccaagtacattgacaaaacagcagctaaataagggtagaccagactgtggtagactctgacatgcatttatggaacaatggggctctgagagacagccttgtagctcacgggaagacataagatgtgctattttgactgcttcgtagcagaatggggaacacacgcacacaagggaattatgcattttacttagttttgcccaaagtcctcaaggcaacagaatcttgtgatgtcatcatgaactttctttctctccatttccattgacacaaaggctaaaaatttctaatgacatcacaaaggaaaatgaaatctactttgattccaaaagaaatcttttaccttcagtgagactagtaaaaataaaataaaataaaataaaataaaataaaataaaataaaataaaaaagcaagaatctttccagacagggtgtgtgtcactgtgctcatgcacagtgggtgacaccctccctaatgaaattcaaaccagccaaaagaaaggattcacaatttaggttggataaaaaagacatactgaatattgagaccaacaactttttttttttaagaagaaaatcatttaaacatatatttcttcagggacattcaaatttttactcatgtctggttactatgttaccaatgtttttgtccttttttgggttggtcacagaaacacagaagaaggtacagaaagctttgacttacaggaatacagtgcagctcaatcttttgtttttaaggtgcagtgatttcagtctctaaatgtaacttcaggcagtctgaaaagaaacaggttaaaatctctttcagttataattggtatttcagatttaattaaaaattaaactttcataatgtttcaccatccaaagcaatgcattatcagtcaagcgtggcttttctttttttcttttttttttttttttctgttaaggaaaaaaaaaaaaaagaaaaaaccctcttcccagagtagttttttaatgaaaagaaaaggatctaaagaggagaaaaaaagcaattctgaaaaacaaaatacgcctccatgttaaggacttcataatgatatgactagaaactcaatgtttctgaattttagctatattctgattaaaaaaaaactcctaaacaatttctacagcctaaagattacagaaaatattaagttcagggaataaagaagaaaatctatgggtctgaatacacatattaaagggaaattatgacttcaaatggaattgtaagaaatgctagatctcctactttccagtgactgaattgctggtgaggtagatggtgaagaagggctaaataaacatatttaacaacacaaaatggccattgaaatgtactgtattatgggtttagcgtgccccatttcacatcatattgtacatcttgtcacatgcagccactgctgtttgaagcagcacaggaagaccaagagagtctgaacaacactccctggtttaagtaactgtaagcatgttgcttattttttaaatatgtacttataattccaaattaagtaacagtccaggcattaagagctccaagtatataataaatattaggcttaaaatattatactattttttgaatcatttctttcttcaaacaacaccatctataaataatagtattttttaaattaaaaaaatcacatcacacactagaattaaatcatccttacttttagctttgaaaaactgatacaatgggatttagaaaaatttagtttttaaaatataaaatgaggtaatataattcgctttcattcactttacagcgtggcagaatactttctatatatttataacactaaatgtcatatgtttacatccaatttcacattagtgcaaggtaatattttaatatttccccatatgagagcataatcacaaatcaccccttaaattgtactattattagaaagcatatgtagttcttacttgggattcctgttttctttttctcttgaaatgtatagaggaatattttgggtaattggtctatttgatgtacatagattttaagcgtaaacatgctcaggttcacagtaaattcactcatgaatgagattagatttaaaaaaaatcactgacattgactaactaaacttttccccctcctctcacatgcctgaattaggctaaaaatgaaccagcgtaaaggcagaaattatggaggcgtcaccagggacaactgaatgagaggaggggagtgcacattatttccttataaggcagcaaaatattcataaaagaaactgacaaaaataacttgtgctcagaaattatgagatataatataaatatattgaataacaataatctctgaaaaatgattcagaaatttaaaactgcccacctctggataaatctaattcaccaactggcattgttctactcaccaacaaaatatggttagcgaaacaaattcattctctagtttagacgtgaaaaggtgatagaaactaggctgaatatttacatataaacatataactaacaactagtaattcaattcattcagtcaggtttccttctcctcaatttgccagatgttgaatgaattgaactatcagctcaaaataattaaatcaattatatgaatagatggtcagtgtaccaattttcattccccccccatgccatttctccttctcctctttgatctttttcttctatttctgcttgtttcttctccactttcactttctttcttattcctttttccttcttttttttttttctcttggtgagggtaatgaggctcaaaaataacatcttgtatcctgttgagggaaacttggtcacaactatccttccagatgacaaactcattcttaaatgtctgtttcccaatccaaagaaaacagagcaattgaaaaaatagagactcaacatcacttacaactaccaacaccagccctcttaattcccatgctgtactactcatcacgaggagaactgaaatttatttacattatacctaacctcaaataggaccacaaataagactaataacaggaccattttgtggcactcaggcaaacggctgggcaaaacagatggatcttactttgcgccaggactcaaaaaatatagtcgccaactcactgttggcgactacatatcttggcccaaagatggacctggaagtaggaccagttgtctttgatatgaatagtgctcctcttcttatctcctcatggaacaaatcagtaactctgtcactatatagtggggttatcaggtagaattgcttaaaagactggtcatcaaggatgtaaaatattctgagggaatgtcaggtgagatgaaggaacagaaagtcaggacaaataccttatttttggcacttttgtctattttcaactttctgtttttttttttttttttaattcaaattcactactgtacactgaacccacctttaaaatagatttcagagtatgtgtcatcaataagaaaacttgtttctcacatttcaggttccaaaatctgttaaaattttaagtcacatagatcaatctcagtcattattaaaattgaccaccagtgtcagacttctttaattggaagaaaactatgtaaggctttatagattacagtcaacatccaatgatgcactgagcaacagctccgtaatcaatgcaatatacaaaatccggaagaatgcttctctggcagagaccctttagcaaaagagttgtacattctgcactccttaaagattctgaatggctttccagagaagtagcaaatgcattatattgcagtaacctatcttgtaagtcacaaggccacaaacaaagcctctagtcaataaaaaaacaaaacaaaacaaaacctgaaggggggtgagaactacagatcttaccattgactacgaacaaagggctgcttctgaccacattctactttctaaaatcctcacacagaaggagttttagatatcaccaggtcacagaacttcaaggaaagaacaacaaagcattccagcttaggaggtctatgttaattcaggcacttctcttattgctcttccaactattcagtactgactgtatcttgctcagattgcttttgagagttcactcatctctctataatttatttattcagacattgtgcagatttgatttttaagagacagccctgtttgtggtcagcatagaaggctaattataatactttaattatttattttagtatttttttctttccactatttaaaaactttttattataaaatatttcaaatatatgagagagggcagaatacagaaaaatgaactctccagtacccatcacccatagtcaattgtttttccaattatactttcacctactttttcttccaccagagcatctgaaagacaatcccagatagcttattattttatgcatgaatactttactatgtgttactgaaagatgacaatcataactaatatcattccacatcaaaaataatagtaattctttaatgtcattaaatatcctgtccatgttaaatgattgacttttaaatggtcttttctttttataactggttagtttgaatcaggatctaaataagatgtacacattatattcaaacgataattatcctttaatctataaattctccatttgctttttaaaattttaactttgtattttggaacaattttagaattatggaaaagttgcaatgatagtacagagagtacccatatttccttcactagtttttcctaatgttactatcttacataaccatggtaaatttgacaaaattaagaaattaatattgacacaatactattaactaaactacagactttattcagatgtcaccaatttttccattaatatgttttttctgttccaaaaatccaatccaggataccatactgcattttaattgccatgtctcctcagtctcttctgatctgtgataacttcttggtcattccatgtttttcatgactgataattgtgaagactagtggtcagatattttgtgaaaccttttacaactttgatttgtccaatcccgtaactagattcggattataggttttagagaagaatacaaaagaggtgatgtgcccttcttataacatcaaaggtatatgatatctcggggtatgttaaccttggtcgcttgcttaggagaatgtctgccaggtttctctatacttagttttaataaacataacagtttattgagatataacttatataacatacaatccactcttgttatgtgtataactcaatgacattaagtaaatttagagttgtataaccatcacctcaattcatttttagaatatttttgtcaccctacaaagatccttcatacccttagggagtcaatccctagacccagacaacaaatattttctctctctataaatttgccctttttggatatttttattaatgcaatcaaataatatgtgatctctttcatgtagctttttcacttatcataattcatttttaagattcttttatgttgtggcatgtagcagtagtctattcccttttactgatgaatactattccactgcatggatataacaccacattttatttatccatgcatcagccaatggacatctgaattgtttccagttttttactgttacgaataatgctgccatgaacattcacataaaatacgtctctgtgtggacatattttttttcctcttagatacctcaaagtggtattgctggatcataagggtaagtttattttaacttttaagaaacttccaaaccactttccaaagtgactatactcttacatctcccctggtaatataggaggcttctaatttgtctttatcttccaacacttgttactatctgtctttattacagccattctagcgggtgtgaagtagtcttttacggttttaatttacttttccctggaaataataatgttgaccatgttttcaagtgcttattaggcatgacttcatcttctttggtgaataacttcggtgaattgtcaaatattttgcccagtttttagctgggttgcttgtctttttattattgaagaattctttatatattatgcgtaaaaattcttatcagattatgatttgcaaatcgcaatcttgcaaatattttcgcctgtctttggtttgtcatttcatttctttaatgggtcttttgaagtgcaaaagttttaaattttgttgacatcctaattaccaaggattttattgaatcaagcttttggtgtgatagctaagaactttttctaacccaaagtcatgaagattttctcctgttttcttctagaaattttataattttagctctcacatttaggcccatgattaaatttttgtgcaggatatgaaataagaactaaaatatgttttttacagtcctaggttcgtgaatattcatttatatcgcatataatcctagcatcaattacagagcactgcttattgaaaagactatcccttcccatgacaaattgccttggcacctttgtcaaatttaattgatcaaaaatatgatgaattttctgaactttcaattccattccattgatctgtatgccaatatcatactctataaagtaagttttaaaaccagaaattgtacgttatctaattttgttttcctttttcaaaagtattttcactattttggatcttttgcatattcgtgtaaattttaggattagcttgtcaatttctgtaaaaacgcctttattctttttgacaggattgtgaattgaactgttttcttaatttcattgtttgttgctagtatacagaaatataattgatttctgtacaatatctcttcttatattcagttaacttgttgaattcctttattagttcgtgtgtgtggtgggggaggtgtatgtacattgcttagaattttctatgtacaagattatattgccggcaaataaatagttttactttttaatttccaatctgtatgccactgattgtttctttctgctggtctgtctaacccttctctttcccttcccctccccctcccctgcagctgctgctgcttcttttttttttcctctaatttgcttctctctctctttcttacatgtatttatcattctgcactggattgaatctcctgtacaatgttgaacagaagacataagaactgacaaccttgcctcttttccgatcctaggagtgtatcggtcaggttttcatcattacatacattataagttcttcatagatgccctttgtcaggttacagaagttctcttctattccttttgttgaaagattatatcacaaatggatactggattttctcaaatgtttctgtacatctattgaaatggtcatgtgttttctcttttattctattaatatgctatattgcattaattaattattggatgttaagtgaaactcacattcctgggataaatcctctgtggtcagcactgtataatgcttttctactttgccacatttggtttgtgaatattttgttgagttttggtgtctatattcatgagggaatctggtctgcagttttctttcattgtgatgtctttgtctggctttgctctcagtgtaatattgtacaaataattgaaagatgacctttcttgctctatttctagaaaagtttgtgaaatactggtattggatagaattcaccagtggagtcatctacatctaggattttctcctaactataaattgtataaattgtatgtctttttattacgagtctgttcatattttctatttcctcttgagtcagttttggtaatttgcgcatttctaagatagtccattttatccagctaattgctaacaattgtccagttgctaacaattgtctaattgttaagcaatgacaattgaggtcaaccaatgatcagtcacaggttgtatttctaactatcaagcaatgaaaaggattatgaggttataatatttgttcatagtatagtatgagatcaggaatgagagagaaggtatcaccaccaaccccatagaaatgagaatgattatgaggttatactatttgtttataatatagtattaactataactatacctcataatccttttcatttctgtggggttggtggtgataccttctctctgattcctcattttggtaatctgtcatcttctctcctttttccttgatcagtctagcaaaagaaaaactaagttttggttgatcttttcaaaaaactaagttttggtttcattaattttctctattattttcattatctatttcattgatttctgttcttatctttgttatatccttccttctgttcaaacagaatttagttttatgtttatatcatgtctatacttacctaaataatgacgtgatgaggtccttttgtttaggtgaattttagatacatttttatcatttcatttccacttaaaggatttccttcagtatttctggtaaggcaggtctactagcaacaaattgtctcagtctttgtttatttgggatatctttattttatatttatttttgaagaacaattttgctaaatataaaattcctaaatgacattttccctttttttccttcagcacactgaatacgtcatccctctacctcctggctttgtttctaatgagaagtaagctgttaatcgtagtgttgttttcctgtatgtaacagtcttttttttcttgttactgtcaaaattttctctttttcattcaaaagtttgactataatgtgtctatgtacagattttttttgtgtttatccaacatggagtttttgtgcttctcaaatgtgtagattaatgttattcatcacatttgggaagtttttggctattatttcttcaaatatttttgagccctttctttctttcctcctcttctctaccattacacatatgttagtatgcttgatggtctctcacaggtctccgaagctctgctcattttttcattgttcttttctcttcaaattagaccatttctattaattgatcttcaatctcattgtgtctttattctgccatcttaaatattctgttgagattctcttgcaattttttaatttccattataatattttttaactccagaatttttgttccttttaaaataacacttatgtttatattgatactctctatttaaagggtaattatagtaatactttaattatttaacatgatttcctattattttgaacatatttataatagtgctttcaactctttgtttgctaagtttaacatctgctatctccacttcaacccaaatataatttctttttttttcttcagacactttcttttaaccacttcttaaattgggtatgagtcacactcctgtttattacatgtctcatttttttcttgaaaattgacattttatatagcatattacagcaactctggcttctgacttttccctgttgagggttgttgctgttattgctgtgtttgtttatttaggacttgcctaacataactctgtgcagcctctcttccccatgctgtgccgctgctgatgtttctgctcagtttgtgtaatttccattttcgtttttgagctgggactttcccctgtgttaacacagtttagtggtcagccaacgatcagtcacaggttgtacttaaacacctagggccactatgctaacgcctctaattgatatatacgtgtgtgtgggttgtagaatgcactcaaagttcaggcagtttacaagtgtttttttgatttttactttccatttgttctctcttatcttctctctgtgtgtccaaagccttaggtcttccccagagtatgtgtgcagcctttcagacctctaggaatatgtggtagcttaccaaagttcactatgatagtatccttttccaattctccctgctaaatttctggccaatctgccagttcttttctactctgaattgtaacttcaggctacatatgatgtttattctccctgcttgtttgcccctgagattgtcactgttttgaccacacctaagggcatggggtttttctatgttctgctccatcaaattatcgaatcaccccctttcagcagtgaagttgtgggttttcatgacttgtcctgccctggcagaactactgatacaatggaactgtggggacggataataggaggaagcactcccggctaaaacactgtgggctcctaactgtgctagttgtcccaacataacttttaatttggccactttcactcccaaaagtatccagcttctgtgatatgatttatgaccttttaatctatagtgggcataaacgacttatgccatatgccatttcttcagcgaatgaccactgcctaattcttttcttagtaatgcaggaatcaggggcctagctgcaggtatccatgcatgtggggtggcgggggggaagtctaactgccattgaatgaacgttttcataatggttacatgtgtatagaaaatcttcaactgcccctcctactacatctctagaaagtttaaaggtttgggggggattaagaatttctagggaagtgtatgggatatagggataaggttaccaaaattctcccatgggagataaatagttttgcctcactctatagagtttggagaaaccactcagcgagaaggactagaattactttggttaataatgagttgctatgaactttggagctggactaacctattctaagcaattgtaaagaatatgtcatttagacttaatcttatacaaaacaataatagctcagagatctaagcaggtccaaatacttacttggatcaggttagtatttgccagcttattttctcacagattcctgggctcactcaggttatacttccttgggaacacacaaagggaataagctccttttggaactcaaataacttgtaaatcagaaagttcccatatggatatagagaataatatttactatataataatttttcctttacatgatgatccacaataaagttcccttgagaatacacttccctagagcatttaaattatgaacggatttacaaaataactcctatcacatgaaaagagataaacatatagtatctgcttctaggaattatctaaactcattttccttcagagacttaaatagatgaaaaaaatcagcaaactttgtttaggaaaaattcagaatgtataaagcattaattgtgaatatcttactgatatctttggatcaacataatacttcacttttacaacatgttgaggaaatcaaagtattcaccaaacttcatctcattaaagtgtcataacctttaatctaggaacccgtaatagtaaagattactgtttctgtctggaaaacaagaaatctaatccatgaaacaaaatcctgaaacatcacatacattgcttaaagatgtaagtctgaggatggagaatgtgatggaactccgtcaccttgttgtataagtgtgtccggaattggtgggttcttggtctcactgacttcaagaatgaagccgcggaccctcccggtgagtgttacagttcttaaaggcggcgtctccgcagtttgttccttctgatgttcggatgtgttcggagtttctgccttctggtgggtttgtggtctcgctggctcaggagtgaagctgcagacctttgcggtgagtgttacagctcataaaggcagtgtggacccaaagagtgagcagtagcaagatttattgcaaagagtgaaagaacaaagcttccacagtgtggaagtggaccccagccggttgccactgctggctccggcagcctgctttcattctcttatctggcgccacccacatcctgctgattggtagagctgagtggtctgttttgacagggtgctgattggtgcgtttacaatccctgagctagacacaaaggttctccacatccccaccagattagctggatacagagtgtccacacaaaggttctccaagtccccaccagagtagctagatacagagtgtcgactggtgcattcacaaaccctgagctagacacagggtgctgattggtgtgtttacaaaccttgagctagatacagagtgccgattggtgtatttacaatccctgagctagacatagtttctccaagtccccaccagagtagccagatatagagtgtcgattggtgtacttacaatcccttagctagacataaaggctctccacgtccccaccagacttaggagcccagctggcttcacccagtggatcccgcacccgggctgcaggtggagctgcctgccagtccgtcgccgtgggcccgcactcctcagcccttgggtggtcgatgggactgggcgccgtggagcagagggcggtgctcctaggggaggctcgggccgcacaggagcccacgtaggtcgggggaggctcaggcatggcgggctgcaggtcccgagccctgccccgcgggaaggcagctaaggcccggcgagaaattgagcacagcagctgctggcccaggtgctaagcccctcactgcccggggccggtggggcaggccggccgctccgagtgcggggtccgtctagcccacgcccacccgggactcgcgcttgcccgcaagcaccgcgcgcagccccggttcccgcccgcacctctccctccacacctcctcgcaagctgagggagccggctccggccttggccagcccagaaaggggctctcacagtgcagcggcgggccgaagggctcctaaagtgccgccaaagtgggagcccaggcagaggaggcgcccagagcagccaggactgtgaggactgccagcacgctgtcacctcttataaggttatcaatagggcaatatccaggctacaatgaaaaagaaacttgaagtctcgaacacctattgtgtatacattagagtggattcaaaataaatatttaaacagatttctgttcctgtggaatggtatttttccagcaaacctctccagcgattgtttttattaggctttgcaatttctataaaaggatatcaaccctgtcccaacttcattactatttctgctattaattaacaataaaaaaaataggctaggcatggtggctcacatctgtaatcctagcattttgcaaggctgagatgggtagatcacttgagtccaggagtttgagaccagcctgggcaacacagaaaaatcctgtctgtacagaaaatgcaaaaattagctgcgcatggtggcgcatacctgtagtcccagctacttgggaggctgaggcaggaggatagcttgagcctgggaggcggaggttgcagtgagtcaagatggcaccactgcactccagcctgggtgacagagtgaaaccccatctcaaataataacaataacaaaaaatagttgtatttcaagtaatataatctagataatctaatataatataatctagataatctagaattcactgtcattcaatgaattatatctgtgtgaagtgttctctatttggtccaaatcttttaaaaatgggaatactaaagttcacagtaataagatgttgtcagtctacattgaggactacaaagaagcatttctataaaatatcctttgttgctaatgaaagttaatatttatcttgatatttacattataatacagtgatccctatacatactgaagagcatcctagaaaattgatttttcttagtataagcattgtatttctttaaaatatataatcagagcccaatctgtaaatgtaggtaagatcctttataggatgctttttaaatgtaggtcaaattcttgcctccttctcatgtttttccactgtttacccattttattttttatttacttaatttatattatatatttcacttactgtcatttatatttatataaatatatttatacataaatatatttatattgtacatgtatgtatcatttaagctatctcaatttctttttgtaacaaagagatatctatctgtctctactgtatatttgtctatctacccttccatgtaacaattcatctaaatttactatatgataccccaacatttcagatgcaatctgaaaatagcaaccttagatcctctataaactcatctatgtttttgtggtgactttagttttcttctaccttcgaagctattcaaatcagaatagcctcaaatctgccttaaacttgtctgagacaaagtaacatatttgtatcatcagagctcagtattaacttaaagcttaactaaccacctctttgctaagtcacctgaagatgattcttgcctttctgtgcacgaataaaataatttgggacctatggaacaacaccaaccattttcaaataactaataaggcatataacatagagcagacacaactgattatatagtttgtaccctgtccaaggcacctagtccaggagtgtgtttcactcaataacccacgttccctagcccaagctgcatctgcttgagcaaagggtttcttttaataatttgcacaaaggtgtccgaacaggcagcttttttctaagttgtattgaaactccatatgagataagaaaggccctctataacatgtttctatagtacttctaacagaatataattaattgtattaatattagctggctctctagctgttacatgtaacataaatattcaggtaacttcctagtaatgactaacctcatgagcttaggtctccatgacttgcactaaagaatgctttaaaaatagaatgttaacaagttcggagacatggattatttgtacaataaaatacttttcttttaaatttagcttctggctcccattccttcaggcagattttatatattagtagttaagtcttaatgaattatctacaggtaggctatacataacacatttttacattaacttttcgtgactatgacatgaatacatgcccattgcaaaaacaaaataaaacagtacactgaaaatatagaaaatatgaggaaagattacgagcatcaatagtctgatgacacagagacaataaaccactactggaccttcaggatttcattccaacgtgacacattttaatcccaatttggcttacccattttcccctgcacacaacgagtagcctcctatttttactatttggtattgtgcttaagcaacggaaatatttcaagtatttctatagcaattgttttctataaaattaatttagtaattgatcaagtactatcatatttaatagccctgcaattgatcattattcatgatactactcattgttattgcttattacttcatgaatttggttttattcaatcatgtcatatggagattttatacacacacacaaaacacgcacacgcacacacgaccggctactacataaatattaaaccatttctccgaaataatatggaggttagaagtagcttctagatgaacaaaatgaaatggcaaatttgatgcttaaaagtcaaaaatttcatatcaatgccaaagatacattattttagataacactctttttctttatttttatttttactatctttgctacaacactacaacattaatatgaagaactgagagtcagctacgcctataaaggtaaagtgccataaaagccccaatgcatctctctcaagagtctaatcttattctatctgaggagctatcctctttctgtgaactctgtcatgtagaattacatcatctcccatggctcagattatctccaatttataaaatgctttaacaaaaactgttacaaagtgggctctgttatatattcatataacttcctcttcactttggttaatacggaaatacacaatacatcaatatgtttcattaaaacgattgttttgatatagtaataagctgggcaaatagaggaagtatgctgggtgcaatttatttacattttaataagacctcaaacaaatgataccacacaggaagctcagaattaggttaaggagaaatggtggctaaaaaatgccttgaagtttggaagctgtaagtattatctaatcaatagtattacttttgaattaagatagaataaccattccacagggacaggtattgtggtctgtgacaaacattattcaatgcagacattaaaaatttaggggagatagaaattttcaaaatttgataaaattttaagactaaaccttagaatatatgccaaatgctaaagtttaaaatgaatgggcctatgaaataaaaatctcatgaaagcccaaagtatgggagttttcttccttaatataccaaagcttactgctaaaatccccatttaatagagatgataacttcgccattcacattttgggtttctcctactatgcatgttaactctttgtgaatagttctaaaaatcaagacaagtatgtactttaatcaaataggagattcagaaagcaatgatttcagtctacaattatagtagcctgcactattcctatttccaaactctgagcaggttcacctttgtttgagacaaattatcactgataatatcttacagattaatgtgcatgacatttgtctatccagtgtagtttccaagacaataaaaaaaattgcagaagtaaatatattatttaagctgcaagtgaagaaacaattataaaagtacaataatgataggaaaagcatgaagaggacagggtgaggtaaatatacaaaaggaatcttgtaagaactgacacatttgctaaaagaacaagaatatgactccgtgtgtgtgtgtataaatctctctctatattaagtctatatgaaatatatttatacaacttatacacacacacacacacacacacacacacacacacacacataataaattgggcgtggtggcttacgcctgtaatcccagcactttgggaggctgaggtgggtggatcacctgaggtcaggagtttaagaccagcctgaccaacatggagaaaccccgtctctactaaaaatacaaaattagccaggcatggtggcacatgcctgtaatccgagctactcaggaagctgaggcaggagaatcacttgaacctgggaggcggaggttgcggtgagctgagatcacactattgcactatagcctgggcaaaaagagagaaactctgtctcaaaaataaataaataaataaataaataaataaataaataaataaatatctctctatatatacacacatgcagaggcatacatatatgcctctataaaaataaatatttcattaggagttttgcaatttccttatttgtatctatccatgaactagaaagtaagttccttgaaagtatgacttatgttttctgtgttgtaattcataataactagcatgatactgagcagaaaattggttctcaataaatatttgtgtgaaatacaaaaaatctaatttcattcatgcacactatgtaaaagaacaaaattaaagaattcccaaaaataagacaaatgataccattacatggggaaagcaagttagattatgctacactacactaagccaataaaattaataccaaaaaaacccttcaagtgaaaataaatctatgtaaatacatgctgaaatcctcagatgattcagactccagagaaatgaaaccccaatgacagcatcatgaaaatgagttgccccaatatcacatatcgtttttgtcatactctacaagaagtggtcaggtgtgattagaaattccaatttcctaatcttacagaatataaacaatctatattacataagtctatgaattttctgaggcattataaacttttatggacattttttattagaatctgaacacaatggtgtttcaatataaaaactcataatttcaattgtgaatcaccattttacatttaaacaattttaaaaattcacattgtgacatgttataccattaggttattaaaaaaactctgaaagttttcttaataagatcataaagttttttctagttatgcaagagcaatttgatagtggaaaatcaattatgctaagtcctttgctgaactgtcacatttcaaattatcctataatgttttaaagggaaagggctatgcatcttaatcccaatgtctagtgaacaatttctggcatatagtaagtgctaaataaaatgtatgatgaattaatttgagttgaaaaatacatctcaagaaaagtctatgtccatgagttacaattggacaatatttaccagaaaaaaaagattaataaaagtcaacgtccattcctaataatcaaataaggattcagaaaatagtatgttaatccactttaccaatatatcaaataatatctgtcttaaatcaacaaccaatatctgccttaaatatgaaaaaaaactagagataataccacataataaaaaacaagaaatatgccctctaccacaacgattacttaactgttttggaaattatagtcaatgaaataggatattaaacaggaataagaaaggaaatagacagtcatctttgttaggagataatttaataactttgaaaccccaaaagaacttaaaagaaattattaaaactattaagagagttgaataaaataactagataataaatacagatagtccccaacttacagtggttcagcttaagattttccagttttacagtgggtttatcagaatggaaccccacataagttgaggatcatgtggattataaataggaagtggcttttctaccaaagaattataaatgaaatataggcaattaaggacactaacaagaacatagcatgcctatacctaaatatatgaaggaatttggggatctatatgaataaaaagatacaatctatttatgtatgaaaacatactatgcttctgaatgggaagactgaatattgcaaagatactaatactgatttataggtttaatacaattccaacaaatattccaatgaaacatttttatgaactcaacaaactaaacaaatcctgactagtaagtaggtgacaaaagccaaagcatttttgaaaaaagaaagataaggaaggattttacctaaaagatacacaaacttattttgaagctctaatggaagcaatatagaaccggtgaaagaactgaaaaagcagatagtccagaaatagatcctaatgttgataaaaattagtaggcaatcaagatgatgtcaaaatcagtggggaaatgattctggaacaattgattaaccattaagaacaaaagtaagtaagatgtttacatcataacatgctaaaataaattctgggagaaacacaattaaaaatataaaacagaaccatgatcatactagaaaaaatggtgaatatttactaaatttcaagctatttaaaaaagaagataaaagtaatgaacatagtcacagagaaaaaaatacacaagaaattgaccatacaaatatttaacattttctcacataaaatcttacaaatcagtaaaactacatgagtaaagaccacaagcaaacaatttataaaaataagaaaacaatgacaaacatgtaaaaaacattctagttccttattaaatcactgcaaattaaaactatgtaaactagttattttgcctgcaatttgtcatatatttatataatgctgctattcaaaacagttaagaatgtagttagaaaagcacttttacatacaattggagaagaattctcaaaggaaccttgagaattttacatcctctagcccagaaatcaactttctaaggatgtatgctaaaaacataatccaagatgcagataaaaatttatatataaaaatgatcctcagagtaggagaaataatagtggaaaatgacctaaatgtcaaacatgaaggagttaattaaaattttttggtacataattaagatataatattacacagctaatgaaaatgagtattttatgactcagaattaataaaattaatgctaagtgaagagatcactatacagactatacaatccaaaatgttgtttagaaatatgcaaacaaacacatatatataaacacctgtacactttagaaacacccatacacttggaaagaggcagagcaaatacttagaattgtttatccatgattggtggtgtcaagtgatttaaatttattcgttatatatattttctattttgacacatcctttcaacaagtgtacattaccttttaatctggaaaaaaaagttattttaagcctaaaatgaatttatgtgggttagaaattcacttaagggaaaaaaatcagataccgataaaaatcactttcatatacatgtagaattactgtgctctttaatctgtgaatctccatacttttgtgcataaagaacatctattgagatattgagatacttgacttttttttagtgctgaagaacacaataattttcctgaattaaaacccaaagaaaataaagtcactcataaataccatatttgactacagcattcacccaatgctctgatggcctttcccgttgttgacttattgataaaatttacctacattgctaatattaataattgttttggtaccaatttcaggaataatcaatctgagaatgtttacttggcccatttagacaataccaaggaaaacacccccaagtaactgtaaccagcatagtgaacagtgtatttgcgttttcacatttcttttccatggaataccaaccttgcctagtattttgcgaataacaatggatggaacttggattttcaacagtgcttaaaaaatagctgccaaagtcaagacatgtaataaccttctaagtaagtttgctggctccatattgtgtttgaaggcacaccccctccaaacgtctgcagtcaccatctgctactcaactgcagaataatgcactgaagtctggtgttgtttggcatgggcaaagacagccaatgtccaactccattcagacatgtgcaccatatcaggaaccttatgacacagtcctcaacatcaatgcagcactttcaagccctgctgcacatcaatcaagtatgtatgacagtcaagctgatagataaaatctaagccaactctaaatacctactgtgcatggatctctctagtttgcctgcagctcaccttctattaagatgatagctttggcctagtcttccatgccaaaataagtgcatggagtcactctggcaagaagaagcgtctacatcaatgtcaacaaacaagttccttgcgcccgaccctaccatctgtcctcctgcttcccacctaccgtactttatgtggaccttgatgaatgagattctaatagtccaagactctagtttagccagcctttgcagatggggtcaacatgactgccctctggccaaatacccagggtgacatagctgatgggttacctggaaagtgcctttttgcaaatttaatgtcagaaataaagcaaatgaaggcgttcctacaggttctgagtttcgggtttatggaaaaaagtgatgcattcaatgcttaaagtgaagataatttttcttttaaattatttgaaaatcttataatgctaaagcattgataaattccatttcaacactacgggtaagggaaataaaatgaatgaataaaagtaaaactggggctattctaatgtatttacaaagtaggtttgagagaaagacttgaaaaaaatctcagaaatatgtagaaataagacttgatagtgtaacattaatatagaagcagattatttcattctgcgttagatgcaacaatattagagcatattgcacatgctaaatggggaataatagatttcatacctattctacagaagttgtatggcacttgcagatttcaaggtagagcagtaaaatttaatataatcttaagtatgagatataaatagtttctggaaaaatctaattgtttttgccttaaaaagatattacatgaaatatgataaatcagtattgtcataaaagtagtaaataaaattattttgttttttgaacatgttgacaaaccatttcaattaggtcattaaaaaaacacttaaaatggagcctgagggcatatgaaacaaacagaaatttcaggaaatgccgctagttccaatccaactcaatttaataggatgatacaatgataagaccttatttttccttcaaggaaagctaaatgtatttctagaatggtctctggacacatcaaaaatagaacaagcaaaaacaaaacaaacattctacctaggaaacaacatcatctgaaactctagacaatttaagtaataataagaaagtgaatcttcaccaaatgagaaaatgaatgtgaaaatatgttacatactataaagcaccatacacagaattattcagagcatctattaaagtgctttgtacatagtaagcatttactaaatgtttgtagaattgactagaatttaattgaaaagagaagtataatgagacttctacaagtagaatcagatccttttaataccatgggaaaaagtttcagtcaaattatatgactaggtacatccgttgtctttgatgttatgaatcaagatgagatcctattatatcaaaagaaaaaatattgttgaatttctctttggagaaatcacagtaaaatgaaaaggatgattatttttaatttctaaatatctccaaattttatagcattcttcggtcaactaagataatgctatagaaatcctacataaaacttgaacttacaatgtcctggcctaatcatctggctaatctctttgagttttcctgaaatatgttcacatcccattttctatgggaattctcccactgattaacacagagaatgagaatttggcctgtgctctataggcaccattgaaatgtggccacctgaggcatgtagggagggcatccagctggcacaccacatgttgccctggagtagtgtacaatgagagggatattttggctaagaatacctggatgatctctataaaggtcctgattatgaaaaggacttcagcattatcattgtctcatgggcataatatgagccagggaaacttctgtttctaagttcatatattttccaaagaaaggacttataagaatataagaaaaaatcaaagaactctatgaaagagaaacactgggccattgatactagattttatgtactatccatatcactagaagaaacttttttgagagctccatgcattttaaaacttatgctaaagcacactatagacttgaccatcaaataaaacataatgaaatctgtaaaataaaggatgcaaaaacatagcgtgaaaatttatgcctgcagtgcagttgttgtactatattttataaaaatcaattaagttcacatactactcacttaagaaatatctgctgattttatttttattttacgcaacttgtgaggaagaaaatccatgcatttgaactgtagtgccaataaaacaattttgtcaattttgagtctatttttttcaaaacaccatacgtgattaaaacacataatgcactagtatttttgccaaattttgtttttaaaccaaagctgtttttgaattacataagcacaaaatcagaatttcaaaaccagcaaacatatttaggggtgaattttaaaataagcccacttgattcattgttagacaaactttgagtgccagggacatttttgtgaaattccactggggtaaatagggtagctaggaaacgctcctcaaagtgaaaaataagtatatgcattattttcaataagttttgtttagcattttcaccctcatactaagtggttctggtgatatttacaatacaacatgagcataaatcttaaggaatttatgatgtcatcaaatgctaagagacaattacagctgggttttacatttgtgtttatatgttattttgcatatagatcccaaaaaccaatgaagagaaactttgatacaaaacatatcctgaaactaaaagacagcttctatctatcaatataaccagttgatagtatttctaagacagagtttgacagtaagtgaaacaaacaaacataatgttttaaatatgccacttcagccactccagctgtcactcaagaggctttttttaatatcattaattcaatgccacacaaacaggaattcggtctttccaataaattttggtgacaacttgttggcagaaaggaaactaatatatatgtggaaacttttattttgtcatcatgtatgtttgtttgaacttgcttaaaatattgtaattgtgggcctaatttacaccttttttcctaaaagctcaaacaaatcacaatgatcacagtgtccctaagactaatgagtcccaatttataccacagaaaatagaagctcagagagctaaagagtactggcagaatattatactgcaagaatagcaatatagcaagtatactcacttgaaatcctaataaaaccataaaaactaccactttgtatttttcattagcttatatttttacttaatgcaaaatattttgcagaaaagttttctagctagctttattgctagtaagagaataacttttattaattgaattaatttttgtaatttgtgaccaatgaggtttgactcacatcgcacattttctttaggaactcagatacttcatagatcttaataccctgatgaaaatttaagtcctaaaaggccaggaaatactgagattcaagttggctcctctaccatctttactgacagaaattcagagtgccaaaagtcagcactgctggttgctgatcatcatatctaaacattgattcttctaattgtgtattttgagacttgcttgattttagaattacaggtggaaagtcacttctctttgatataaattgcatgcaataaagaaggaggcagtcctacacaataaatatgtaaggaatggttttccacctctgcatgctgcagaaaatcccactgagttaagtagggttctaccaaggccacttaaacatattagcctattatgctccacatttctttattgttctcaaaaagctaatgaaatgttccagtgtaatgttaatgctggagtacttttaaaggcattttagaagtgatgtttctctcataactccagaagggggttccacttcctaaaaacatttaggaggccatggggagaccatgcagcctctttactcagactgtttagactcatagctggagaagaaaatccttaaagataatcacttaagagtttcggtgtgagctatagcatcatcgcaaagcgacaggaattaaaaggcagtgtaccgtactactgaatagataggtttaaaatactgtgtactgtctattcacagataacattgatttacgttggtaaatctattggttcagcacatcagtgcagtattaaggaatcaattgtttctccagagtcaattatttttagaaaaataaggaaatgtgacctatcactgaaagtcagtatgtagaattaaacttggccagttttcttcctcgctggggtcttaattttttcaactgtaagataaatgaatcagacttgtcagtatctatgatcacttctagcattaaagttttctagttttaagattctaaataccaacactgtatgttgaggaatagcaaagtaggaaaagaactgggaataaaactatcactgaattattaactttccaacaatcaaaattctgtaattttgcctttagttgccataaacaaccacctcaccttctgaatatcaacaataatatgaatgaaggaaaggttgtatactaaggtcacaggtggtatggttgagattaaagccaagactgagagtatagtaatgaattgagaaatgaatcatacacttttgacctaatatgtaatatgtcttcccaaatcgtcatttttatacattcattttcaatggaaaacaacaacttgaatatcttagaggttttttcccccaagaaagacatcaggctgtaatctccccccacaaaatttaatacagttcatagctcatacccctaccggataatccccaaaatgtcttgttcctttttcaaattagacatcagcattcagtataacaattaatcaatgccaacaatgttccatatgctttattagcattcattcaccgaatccttccatgaacactaggaagtaggtactaataaaaacagaaacaattttgaagtacagaatctcagaggtggttatcagtaattctagaatatcagtctgacatatgggtccctccactttttttcagtgcacaacgtgaacactgtgtggcacagtgtttcaagaattaatgtttgatttatatcaaagcattatgttttttacttcatcttaatagtaatcacaagagtgacttaagcctcctacatgaaagcagagatagaaaaaagatgaccttggaagttacatattttcttttcctgtaagtatgaagacatgtctataagttattagaaccataaaaaaccaaaaaactaataagaataaaattgtgaaagaatattgaaacctccttaataagcaggttcttgtaggatattgaacaaggtatgtatgttgtagccctgatgctatatttgtgtcatgctgagcaagctacttaacatttaggtgcgtaagggtttttttccctaaagtgggaggatttagatctctaaattccttaccaatcataattttagagcaaattatctataaagtcaattaataatttgccttgcttcatgtattacataatagttgctaatcaaaatgaatagtattatactcacagctttaactaacttatagctaagatcaggcttgctttgtaaacatctctctaaaaactcagaagtccatgaatactaagactttttactcctcctgtaatttttgacctctactggaaatctcacctgctacccctgacctcgaatattgcaagtattaatacagtttctgtatatagtgtacttaagccaaaagtcagaggcatgagaaaggtaaaggccgggacaaaggtactacaattcagctacacacttgtaatgcttcccattagttcgttagttatattagttccagaaactattttaacacggtaggctgatactgcaagcaaaaacaaaaatcatgagaacaatgaaatagtaggtcttagcgcttaagcatatctactagtagtaatacttgacaagcagcccaccttctttgtgatctggaaatgatttgatgataaagccaaattctagaaatataactgctatcttttgggagatcaaaggtcatgtgagggggagagctaaggtcaagagcaagccccttaagcctactccagaaatttcactagagggtgctcttgggctttcatgacttctcagttcttcaataagaaccaagtattgcttagataatatattctgcctagtataacttggactccatcatggatcccatatccaatacttcaatatagaattaaaagatatctccagcagaccctgggcctggttttttattttcctgtgtaatttccttgtttctactgatagtacacttgtgagtttcacaaatttaagacaggtaagagatcttaagaggtctccaaaagtctacattctattaaacaaccacagaaacttcctaatacatcaaagtaagattaaatggggattaactgataaatctatttttgcaaatatatgttttacaaacatattttaatcttataataggttcataatttatatacctattggaagaattattattccataagatctgtagagaaagtctgattgtcaaatagaataaatttcaattatttatatatgtattattcatatgtctcatgacatcaaatattgagcaccaagtaagtactgaataaatatttcttgaccctttattgcacatacatatttttataacacgttccaacaggatgacatataattaaattttaatctctacaccatatgtttgaaattttttctataaatgcagtttcacctttctggaattcacgtttaatgacttattctgtttatttctaatgataatcgctttttatatactttccatttttgctacgtttttaagagaaaatgaaacatggaaattgttttgttatgtgattaactttttaatgtttctatttgtttattagaagattaagaaggttatttatttctacattaaaatattggcaatggcatatatcaatgcatagtgattttcttaagaattgcaatgagtgactcagtaaaattcttcttcactttcaggatgtaaagaattatggctactagccattatgcagggtgatgttcttatcacacataattgaaaactcaatagttttagcatctttagggttgacagtaaaattctgaggttgactatggaatgctaagtctttgaaggcacttccaatttggctaaacttacagtttcattattccttaattgaattaagtttaagtttctcttaaaatcagcttgaggcttttgacaaattagaaatttgggtcctgaatagtagccctttacaatatatgaatctgcataaagatgtgttttaaatgcctatttgataaaaagataagcctggtcacttatggattctagctcctttcaacatcctgcatggattgcaaccagtgtgaaaaattggggatctttaaagtggtctcagatctcttataaagcagtcacctgggctcttaaactgtatggtgcttctcaaaaagggctccttaagtatcctatctgatgtatgttattccccaattcaacttgcaaaggacagagtcaccagcatatattcaaactgtatttcatccaagtgggttgtcaataagcttaaatcactctatgaagaactggcaaaattcccatggatactgtgaaaataaagggaatcaatgaagagatataattattttagtctcagatttaattaatttgtgggagaggtcattttctctcaaatatattcaagtttcttcaaacacaggtcaatgtttgccagctgataggaaaaaagaaaacatttagtctgagtttcccacgtttatattaatctctgtatcacagctaaataaaatgtttcataaatcttcatataggcaaaagagagttcaagctaaggcagagtaacaagtattgccaatagaaaataacctcttaagtactgtttctactatttcctgttctaatttttctattggagagaatgaaacaaagtaatttcacacctggttttatgaatcagctcactaaagattctaggtagaagttacacgggagatgcaagtataacttcattattttacaattagaacactaagacaaagaaagaataaaagtggcgtgctatcccatgccatgcagttagcatatggcaggtcttactcagagtccccagttcctaatctagtgttctttctactgcaaaggtttccagtgctgcttggtttttcataaaggatctgtatatcatgtcaaaatttcatgttgactttccttgaaatttcagagaaaaagaaggcagtataagaaaaattactcttcattgtctaactcttcaagtcagacagcattcctatgtgcaatgatcctcgatacagtctaggtcaactgatctctatgagttttcatactcattaaaatgtatgcatcacaaagtacaattaatgttctcactgactttagggaccttgcatgtttcatccgttccctaacctatgccatcctgaatccaagaggcaccctgtatttctctgaaagtcagcccagcatgaaaatactgaaataagagtgcaggtgtactctttgctttaagaagacacaataagccaaattctgaacttaccaaacagacaaattatggggtgattattcacattttaaaaggattcaccacaggatgcttttaaatcataagctgctctattgcattttaaataagttgatttataaagcttcctttacaaggacttttcactatccagggttcatggttccttatccaaaggcaatgagagcttggtgagcataaagtcctattacctgctaagccaagcttcctttcccaaataagagaataattaggactgtagttcatttttgaaaaattaatgagtctctcactcctgaaaaatttaatataccctgagcacttattatgtgcctggcacagtgctaggcattttagataatgatcttatttactcctcctcaccacaactctaggagattagtacaattatcccaatcatggatgaggaaactgggactcagagaagttagagttaagtaacttgactaaattcttgcagcaaataagtgatcgtgccaggattcaaagtcagatctgtctggagctcttgcccttacatattttacaatataatttcagatgaaatttaatgacgtctcttacctctgacctaactgagcataattgcgctccaaatgtactattccagtgcagcaatcctgtctgtagcaatagggaccagtcacacagcctgaatacaaaaagatagggggctcactaacaaggttgcctattctggtcactgcactgccatattaagcccggatttatctcctgcaattcctacctattggatctaactttgctctacagtcattgagaacaattaaaatcccttccccccatacctatcatatttctcttatggtttctttcttctttttttttttttttttttttttttttagtatccagtgcctccaacctttttaaaatataatgggtttatccgctatttacatatattttattctttcttgaaactggttcttctggagcacagagaacttataaatgctatttctaagcgtttatgcaactaaaaattattggaacaatacacagtatagtggataagggcgcaagctcagaaacccagactgcctgggttcaaatccaggctttaccaattaatggctcgatttccttggtgaatatatttaaagtctctgtgcttcagtttcctccttcaactatgaaatgaggacaacagtacctagttaatgtggctcttgtgaagatttaaaagaggggcaatattaagcaaaaggcaatataaggaaaattactctacagtgtctaactcttcacgtcaggcaacattcatacagcaatattcatatagcgcttacagcctgctaggcagcaattagggtactgcctaggttgtaagctttatataaatgtttgtcattattattgatggtataggagtgaatgaatacttaactgccttggaaaaatatgacctatatcattgtatgagattgattttattatccagatataaagaagtcaagctcaactagaaaaggcacttgactggagaccagagatgtgcttctagtcccaactctttcaaacactccagatgaaagatcttggactttatctacctcatctttttaaacagaggaatgggactgtacctctgcctctaaaatgatatgtttttattctaggattctaggatcctattccacctggaccctgcttaaatttcattactcattatgtttgaaaactaccattacatactaacattttatctgcatgtttatatctgttgacatttcaatcagcttatctgcattgttttcacgaaacagaataagcctctgagagtctatagacaggtctgaaaaaacaaaaggtgttgtgatagcacagagaggaatttaatgtcactttggaggaaataacctaaagtcctactctgccaagccagtaaaatcctgtcctctgcctgcaacacctggcccagtccatgctatcttgctgaatttcagtgcagctctttggataaactcaaattcaggtttggatggaataccaggttgatacaacagtcattttttttcaacagaagtgcaggttggactaccttttacctaccaaaatcacctcattctttgatatatagaacatttagctaattttattatgacttagtatgccagtactcctcatatactttattgtccatccccagatctagtgaaggcatggtgactggtatcagtatcaaggcaattgtcttcaaagaatgtggcaatctattctaacaaagtaaattccacaagggaacaaggggacagccactctaaattcactaatgacaaaaactttgatattttgtaattaagcacaatgcattattctataaataaaaatgatgtccttgtaaatctaaaagctatgaaacgttatattttctatttctaaaattctctaggctcaaagtcaatatgtaagtctaatttttttaaatgcacaaaaagctatgatatttcaaatcttagatactaaatttgtgaattgagtgaacctggcttctcccgcttagacgtgaacattcctgttagtacataaatattaacgaatattttaggccaaaattttgtgtttggtgattgacttatggaatcagtctaagtaggtgtgaaggtgactagacttattttggaacatgtacaatttcataacagtaacacggccgttaaataattctctttaaatgatatttaactctcattttaactgttagcccttgcattatgaagcagcttgatgctgaagtaaagctaagatttcagtaaaaagaataagagctttatattctagaaggtagaaatcctagaaaaatcaaagaaattaaaattttggaagtttttgattcatttcttatattttaaataggattctaaaataacatatctcttctatacataagaaaatagtctggttcacatattttgatttattgaaaagttattacagtacaactcaggttgccgaatactaacattgctataccagcgttgttttggtaaatgtttgcattataactctggttgtattacagcaaaacactcagaagaaagagagtaacttttacacatattacatagcatctgtacagtcatcccttaaaatgcaacaatacaactgcaacactttaaatactttaaaatacaaatgcctttgaagaacataacttatatactatttattaataggattaaatcaacatttttatggctctctaagcttatcccagaaactcttccattatttcagtgagtaacaagagaattttttttattgtttatttttttttagatatggtttcactctatcacctaggctggagtgcaatggtgtgatcttggtacactacagtctctacctcctggactcaagtaatcctcctgccccagccttctgagtagctgggaccacagatgcataccactacacctagctaatttttttttttttttttttttgagatacaggttctcactatgttgtcagactggtcttaaacttctgagctcaagcaatcctctccttggtctcccaagtactgtgattacaggcataagccactgcacctggccgagggtcttatagataggtaatattaacaccattttgcaaaattttaaaaataaggcaaggaaaggttaaaataagttgtacaagttcaacaagtagtaagtgaaattcagccagactttgaacatagacatcctgttttagaatctcaatgttctttctatttttcccaaagcaatctcactaactaatgtacgtattagattgcactgatatagtaaggacaaagaaaacccattttctgtgtatattgctattgccttagaaaatacaaatagctactgaaaagaccaatgctatgaagcagtttggtaatacctattaaaaattttaaatctctgctacactgtattaatattttatatcttaaaaagttaaagaataatagagcctaacttagatccttccaaatttgtaactcttcaaaatctaaaatgaatttctaattcatggcttataactgctcaagtaggaaacttatgacaaaaccagagacaagcccttccaacagtgcctatgacatcacagatatacaaatctgccccattttacagtacccaaagaagaccggaattcagctgttatcagacaataataaacttcttctggtaagttcgtctcttagtcttagatttacattcccactgtcagcaagaatttttaagttaaacatttttgaaaagtaaaaattcaataaatagcatttacattatccacagaatgtattttcattgctttggtgctaaaatattttattttaggctgttcttttttctcttttccatccacctcttagctcctttgctccaatccttgcacctttccacccttgttctctctctccctgaagcctcagggaagagggctgcaaactgtctggatgcctggaccctcacgctcctgagattaaacccagacccgcccatggcaagagtcccgttctttgtctgaagcaagtgtctgattgagttagatatggagtcgttatcacattgaaaagaaagcctggattttttttatctttggtattaaaatatgttatatttgtattaaaatattcatctaataaactctcccaaagaaaacagtttcattatattttcaccgtattttctcattccattcttaaagccacagtgaaaggaaagttgttgtggtcaccccaaaatactctttcccacttctaatcaaggtctggttaggacaaagctaaacaataatttctactttgtatttaaggacaccagctactgtttacccactgatgttatttatactaatagggggtctctgaagtgacacctaaagcttgctaaaggtttcaggagggcttttgtaaagtcaattttctcccagtatcgctttatccccacagagtaagcagatgggagagttctttttccctcaaaataaggcttatagcattgactagggaatttaaatgtatctttacaattctcaacttgatctcccaggaagagcttttatagatttggatttttttttgtcataaagtattctatttatttcccagcagctggtgtcaaaaaagttgtttttttaatattccttttaaataaataaaatctgttttcatattgtgtaaaattagttttgcctgctgtgagtttgtggcattatgaagtgatcatttcttcccatgaattatttaaagtgaggatatcaaaatctgatggaacaatacaatgaactatacaatacaatttaattttataatacgccagttcataatagtatctcaaaatgcacagtagttgcaatacattggttcagaattagcagatcaagtataagcccctcagtttcatattttagtatttgagaatcagttctaaattttctagtggactagagaatcatgcatatttggtagtccatagatacctaaagacctttttgctaattcctcatgccaggcactgatgtttgcccagcctagatgacattttttttctttttttgtaaatctttaagacattgagtttgacagctgttaaccctttcattacaaaacaatattggtattaatagcatttcccctggagttctctgatcactttgtcttagggaacaaatgcacctatgtagccacaattattcttactacttattctcactgcagagtttctagaagaagggaaacaacgatccattcaaatgccccactgcacttataagacttacagcaaagctgctaaaacttaaattttaaggtgagtgaggtggcataagggaaatgaatgagctgctaatgaatagggcaagacatgattagaagctataacaaagtctgactcaaggaaaggccaaaggttatcttgtatttgatatgtgtgttttaataaattataatcaaaatactacactgactttttcctcagtggattttctagcattctataagagatattttgtctgattaacttgctatattgaaaagtgggagtcagtatatattacttacaaattctcaaatagcctctgaaaaaattccaccacaaagattttaaaaaatggaagtatatggaaacaagatgctacaagatgttggaaatggttttccaaagcaagaactggcttaaaacatagaatagcaataatgagcacttttcttgttagttctacatactgtaaactaatttatgccccaaacagaactctggtttccctattatccatgttgccacttcctcctctaatctaactgtacttctctcgtctcagtgaaaggtgccaccatctgccctgacagttgatcaggccaaacatcagcaactctttttgcctcacccaccacatctaatccatcaataagccgcattaacccaaacacaaaagtacatcccaaacccgaccattcctcactatctctgctatcacgaacaaaaatcacaattatctcttatctggtctcctaactgatttctctgcttccactgttgcaccttataatccattatctaaacagaagctagaattcttgaaatgcaggaaagatgatatcattcctttggtaaaattctacaagttatatatagtgcaataagaagaaattaaaattcaaaaccatgaccagtaagtctctccattatctgttcatgaccatctttctgttctcatcttctaacatttttcctttgttcaccgtgcttctttgcctattctgtctctaaaacaagccaatcttattcctattagccctggtctagctatattgcctctgcccagactgctctgttcctacatctctgcatgactgatttcttcactcgtagctcaaatattatctccacagaaaggtctttccttgtgtggccaagatagccaaagcatccccaattcattctaccctgctttacttttctcttagaactaattactagtatcttccttatttacatcctgtatgtatgtgagtatgcacatgtacctgtatgttcataatctctattacagtataaattccatgaggatgaggttcttggatgtgttagttatctattacagcataacaacttacccccaaacttagtaacttaaaaaagcaaacaccattccacagtttctgtgggtcaggaatctgggctcagtataggtaggtgcctatgggtcaaagtttctcatgaggttgtgatcaaactgtcagctagagctgtggtttcatctgaattctcgactgaagaggaggagacttgccatgtgggggtcttcacatgtgaaggtcttcacacaggggtcttcacacagggctacttcatgacttggactttgctttttctcagggagagcaatccgggagagagtgatagagggactcaagagaaaaaccacaagctttttaaaaacttaaccttggaagtgacatcctatcacttctgtcctttattaaaaatgagtcactaagtccagccaatactaaaggagaggaaattagacaagcaggtgaaaatagaggatgtggagatcaggtggggccatcttagaagctgcctattataattgcttaccagtacattcttagtgttcagaaaaatttcggactttcagtaaacaaattaatttaaaaaatgactctctcatgaattagttccattggacattttgccaatgatcaagaaaaagtagtgaataaaatctcactcaagtagtgacattcaaaccaaaagagatcaccccagtaggaaggtttcattaggatgtgtaagcagaaagtagcagtacagcctcagtttcttcatctgtaaaatataaagagtagttgtaccatactgtcggagacctaatgaggcaattcgtgagggcctcatgaatcaaaggcagtggatagatgttagctattatctattcttaataagtataaatgcaagggaagcatttttagggaaaataacacaaatcatgtttttataatgatggtatttgatacatcaggtttaactcaaaaaagaatttaagaaccactttcaattgtttcctaattatattagcttaaatatgagactgtaaccaaaaagactaataaaattttggaactcatcaagtgtactgaaaataggctagaaagctttccatatatttatgtaaagttttgacatcttcgaatggacataatgatgcatttgcaatctccacaatcatgagggcctaaagggagagagatgtgtagagccctggaattgaagatccatggtgtgactggggggggaaagtctctgaaaagttaaaagaagacagggcactgaaccctgatctaatatgtaatggggttatgaaatttaggcagagggtagtcatagaattattcatgaaatcctagaatagtaatactagaggtcaaacttcatattcagaaaagtacaaatagggtcaggtaataaagcactattccatatttttttttaatgcctgccttggaaggtagcaaaacttaagtaagaagttggagaaattcatagaagatataccaaaatagactgtagtggatgtatggattggagtttgccatcagagaggcaaacaaggatgtctttaaacttatttactgatgtttccatttacaaccaaatggggtagatgcatcccacatttaaagaagccattccaaaagcaggaacagcacccctataagatgttatcattcctgttctattaattacagtgtcactcactcttttactgatagccctgatggagaatcagcatgaaccagccattttcctccctgtatatacattagcaaaactttgaccattaaatagttcaaagataggcttgcctcgctgtctcatgcctataatcccagcactttgggaggccaaagtgggcagattgtttgagctcaagagttcaagaccagctttggcaatgtgccaaaaccccatttcgacaaaaaatacaaaactgtgcttggtgtgttggtgtgcgcctatggtcccagctacttgggaggctgaagtgggaggatcacttgcgtgcaggaggtcaaggctgcagcaagctgagatcacaccactgcactccaccctgcagcctgggtgacagagtgagagcctgtctgaaagaaagaaagaaagaaagaaagaaagaaagaaagaaagaaagaaagaaagaaagaaagagagagagaaagaaagagaaagaaagggagagagaaagaaaggaaatctcagatatatctataatagaggaatctctcaaaacaatttctgcaatatccagtgtggtggatctaatggtgaccttccaaaagaaacgcccacattctaacccctgaaacctgagaatgtgaccttatttggaaaaaggatctgtgcagatgtaatgaggttaaggatttctagatgaggtaatcctggattgcccagggaagccgtaaatccaataacattttcttataagagaaaaaagagaagacagagagagcagaaggccatgtgaagacagaggcacaaactggagttacatagccacaagccaaggaacctctggagccaccagaagctggaaaagcaaggaatgattccccctcacttagagtcttctgagaaagtgtagccctgccaacaccttgatttcagacttctggcttccaattctgggaaagactaaatttaagctgttttaggccatcaagtttgtgctaatttctaatggcaaccctagtaaattaatacacccagaacaagtaattatgttttccagagaggtaatgcaatgtagtaaaaaaaaacattttgagtgagacagatttaggtttagacctggggtttctctatactaattgtgtgtctttgaacaagttactttatatctctatcttcaggttcttctttagtaaaatgatggtaagtttcccttgcagggtcgctgtgtgatatgttatttctgctcaattcagtactcaattaacctgttaatgataaattcacgcatgtgcaacatgtctacagacgttaaaaactgttgttttccttgaaaatcaacatacattttagcaaggtattaattagaacatatgggattgattaatgtggaaactagttgtacaataccaaatgttttaacaaacctttattacaacctgactattcatgtcatttcaaataactttcctggttgtcagtggaaccatattcagtctgttcttttactgtctcatctgtaatatcttccatagtttctaatagagaaataatgaaaaagccagagtattagtagaaaatgtttgcgtctagcttgagcttaagtcagatatagagtcaaaattgtgatcacagaattctcctaaatgttagtctcagaaaattgacaagggcataataatttctaggacagagtagtcaaattcatacccaccattgataccttcctatccctgacattaaaacagacaaaaaaaagtagttctcacaataattttatagaggaagaatataggaatcatgcagtttaggtatctcttattctggaataactccttaatactaaattgaggctctagtgagagctattcaaaatgcataaatgaaagtaaaataaattttcaagaaccgatctttcttacttttctagcaacaaacttttgaaaaaaattaaaaattttaaaaagtaaaatatgtaataaattagctataatatcatttgtagctattgtaatttattttttattcattcactcaacaagcattattaaatgcctagtaaatgtcaggcattgtgttaggcactaaagacgcagccttgaataagacatactactccctaccttaaggataatttaggcaaaacaatcaatgataataaagtgcacattacaggaatgcaatgtaaggcaattataattagggaatcggggaaggcattccatagaaaataagctttaaattgagacttgcaagattggttttatgtcagtggaggtgagcacatgggggaagaaaagagtaatgaagagtattcaaaacaaagagtagaacatatgcaaagaccagaaatgagagtgagcatggtgcaccgaaggcatgaaaacacgtttagtatgactagagcatagaatgctagggggaaaggggcatgaatcagtctagaaaatgagacaggagccaggctggaagattaatattaaggaagtcagaatactgttgcaataacttaggtgagataagatggtaccctggatgagagtagtagttctgatatgaagaagattgaacagattaaggacattcttaggaggaagatcaaaagtaccaggtgattgactgcatgtggaacagtacaggatatggaaaaggtaatgtcaagtttctaatgtcggcaattatgtagcaatactggaggtgagagcatgtttggggcaaagaggtgagtttagaacatgttgagtatgaggtgtctgtgagtcatccaagagaagaggtctagaaggcagtgctcagagagaagcctgagctggagaaatatgtggtggtcattcagatgcagatgctaatgaaacctatgggagaaaatgagattgcctgggaggactgcccaatgtgaggagagagcctaagagagagttcagagaacatcaactttagtactgcaaaggttaagtaagactagcaaggctgcctctaatgagactttatacaacccccttcatagtaagttctcactttctacagcaattcagggctcacacttctcttctctcttttgactctcaaacaaaattataagataagcagggtgggcaacaggacttcttgaagataaaaataatctaggtttcaagaggttaggcttgaggtcatggatctctttatttccagattagttttctttccatgccattactctactcccaaggattagctccttatagcttcttctttgttgttagcctggactgttgcctaggtgtcattttagaggggtgaagtttttttgcattatattatattaaaaattttctccatctggaactgatgaaaggacagaagggctaacctgaggcaaaactcgagagtggcagaactgtttcttagagcttccaacctccctcatctctaccttaccccttctttaaaaacttttgttcatttactcaataattagttattaagataatttgtggatatggaaattaacaagccacaccaagtctctaccttcacggagcttacacagtagtaaaatggcagacataagaaccaatgcactaaaagttaagaaagaggagtgtagaaccaggagacaccaagggcatacctaacctacactgaagaggttaaggaacacttcttagaataagtaatatttcaactaagatctaaaaaatggttgaagttgactgtcttggccactgttgcaaggaggaaaactgattcaaccaacgaatttagaaaattgtaatggaaacgtataggttagtgtgccatcctcttgtatttttcaaaaaagaaatcccagaatttgcaacatttgatccaaaaagaatgaatctcctcaaactgtggaattcctgcactagtactgatatggtttggctctgtgtccccaaccaaatcttaccttgaattgtaatcccagggacctggtggaaggtgattggagcaaggggggcgattttccccatgctcttctgtgatagtaagtgaggtctcataagatttgatgcttttaaagttatttggcagtctctctcttctctctctttttctgtccttctgccgccatgtaagacgtgccttgcttccccttcaccttctgccatgattataagtttcctgaggcctccccagctgtgcagaactgtgagtcaattaagcctcttttctttataaattgcccagtctcaggtagttctttatagcagtgtcaaaatagactaatacaagtactatccaagtataagagaaaacattactctcacctatctcaactcataccatgtaggcaggcccttaatctatctccccctgagtccagatttgaaggcaaggaaagaactataagtaccttgtcttatttatttttcaggactctaagttatattatctccattatacagtagagaaaaatcatctgaaaaattacgcaaatctgcccaagatttcaagccagtaaatggggagctaggtcttcattctggtcagttggctccaaagcatctatttattctaccttgaatatatatacacgtatacatatattttacagatggtgtttcactatgttgcccaggttggcctcaaattcctggcctcaagtgatcctcccacctcagcctcctaaagctctgggattacaggcataagcccccatggccagccaagcatatatatatatatttttttttgagacggagtctcactctgtcgcccaggctggagtgtagtggcacaatcttggctcactgcaacctctgcctcccaggttcaagtgattctcctgcctcagcctcctgagtatctgggactacaggtgcctgccatcacacccggctaatttttttttttttttgtattttgagtagagacaaggtttcaccgtgttagccaggctggtcttgaactcctaacctcaggtgatccaccccccttggcctcccaaagtgctgggattacaggcgtgagccaccgcacatggccatatttttataaagacttgtgcacagatgctcattgctactttatttgtattgctaaaaattgtaaacagtctaaatgcccatccttaagtgaatggataaacaaattatagtatgtctatacagtggaatactatgcagcgaaaaaaatggtgaattattgatacatgctatgacataaatggatctcaaagtcaatatactgagtgaaagaaggacaaaacaagtacagaagattctatttttataatagaattcaaatttttataaaattctaggaaatgtaagctactgtgtagtgatggaaaatagatctatggttgcataagaaaattactggagtaaatatatatatatatatatatatatatatatatatatatatattagctgagagtggtggtgcatacctacagtcccagctactgggaaggctgaggcaggaggatcacttgagcccaggagtttgaggttacagtgagctatgatcatgccactgcactccaggctggttgacagagcaagtccctgtctcaaaaaaaaaaaaaaaaaaaaaaaaaaaaaaaactttcatttctcttgtgtaaacatgtaggcatgaaatggctggataacatggtaaacatacatttaactttttaaaaactgtcagactgtctctaaagtggctgtaccattttactttactgccagcaacttatgaggcttccagtttctccatatcctcaaaaatcttgctatgctcagtcttttaaatgtcagtcattctaaaggatgtgtaatagtgtctcatgattttaatttgccttcttctaacaatgattgatattgagcatcatttcatgtgctcatcatataccatctttttctttttcttttttttttttttttggtgaagtgcctgatcaaatctttgcccatttaaataatatgttgtatattattgagttttcgaagttctttgtattttctggatataagttctttatcagatatattctttgcaaatattttcttacagtctgtggcttaccttttcattttcttaataatgttttcaaagtgcagaattttttaattttcatgaaatctaatttatcaacttattcttttatgggtcattcataaatgaattgtgcactaatcatctcctaacatactacatgagttacttatcttttcactgatggatcccaagtggctagtaaagtactgaatacacattaggtatcaataaacatctgatggataaattaaaatttcaaatagtgaaagcaaaattatagaaacttagttcattggcagcacagaaaataaaatagcctctagtgcaaagccatattcaattttttgttatctgatctagtatgaagtttgatcgatacaaggacccaaatttattaaatcttgttaaagaacctgatgctctctctctagagacaatcctttcttccccaaaatagaaatgtgaaattccatagaacttaaatgtaaagcagtaagtcccctacccacctctgtgcctcacctcgcccgtgactcaagtgctatatgaacccctgcaaataaatcaaggctgctgaattctcaaaagctctaattgtgccaattgtaaataagcctcaggatgaatttcaaccagcagtgtccccaaaaccattatctgcaactataatccattacttttctttcataattaatttttctaataggtcagtactatttgttttgtttaagcgctattccagcaatcccattttaccaacaaccaatgtcaattgtaattatatacatattttctattatatacaacaaatacattcttatattatgcgaaacactaaattgggcagtgattttttaatgagtaataaggtaatatgctacattggtgctcaactgcacttgtcttgaccatatgaattaagagtctagtggaaatttataagcaccttgaggacttccaggtatgtgggtgcttaaataggtactcaaaagatgctgcttattttcatagattttaatgtctaaatcactgggaacaatgacaattaccagagatatagataggtggttagataaacacacaagagatatgtatgttagagacatacacattatagagagtataatagggttgtatacacacctacatatacctatataatgtgtgtgtctgtgtgtttgtatgcatgtgtatgaaatcaaaatgcaattcactggaacactgaagacaaagcggtcaagcagctgagagaattcaccatactgatgagctttcctcctcagagagcttgctcctcaggccctcactcaaaggctctttattctttttagatacaattctaaagagtttgatatctacttttccatccacaacagactaaatgctgaaaactcgagagcataggtgagcttgtgtttgatgctagctgcaagcagcctgacacagggagaaatgagagctctcctagagccaatctggggagtgtcctggtgagggcactgagacctgctagttaggaggaggcctagtgcaaacaggcaaaattgcttggatgaagggtaatcaatctgagcctagttcttttggatgaaacctttgagaactcaatgacaagaggatatggatccaacaggagactagtagagaatacaaattcattattttgctatacaatgctagttgcattttaaacaattgtttctctatgaattttactaccaggcttttctgaaccattctgtgtgaattcaatactgcctggatttttaaaaccacttctgacactataaaccagagaaatctttcttaaaagataataagaagatggggccttgcatttctcataaaaggaaaatgactccaccataagtgtattcattacacactgttgaggcatgaattcagggaaaattagactgaatatgagattaccatcctaactttctgaaacactcccagcgctgtcaccagagttcttacttcaaatatttactcttgatctaaaaatatcttagtccaagaaacggaatgattactccacagttaaagtatatttagtgatctgagagaggagaagtttcatttcactcaagcaaatggttttagtaccacaaccaattaatagcttcatcatgtgtgagccatgattataaaggaatcggactaattttttaaacaaatctataggcttctcacaagggctatttttcacaatggtcaccttggaagaaagtcactccagggataccgtcattacttcagatttgggaccttacctttagaattggttcatgagaaaaaaaaaaaaagaaacactacatgcttcatagttaccctccccacctaacactacatatccctgatcaccaactttgaatatgcctcatttacactgatcaaccaaaagcctcctggaaatggtaacacggcctatttatcctgggctttactgggagggtgggggatgaagagggtttataggaattaagagagtctatttttaattatttcatctgtgaaacatatgaaattcctttggccaaaaatgcaatataaaactcagattatcaagggccttttcgtgggaccagtgaaatggagaaaaaagtctccatgacaaaatagaggacttttgggaatccttttttttctgaggtttgcatgtgtgtgtttctagcttggctctcacctgaactgctctttcataatctactgtagtcattgggtacctggaatctgggaaaactccaaccttactccagcacttgtgcaataacacagtaaggcacatggagtcaagtttaagcacttagtccagggttctttgcaccctgtgggccttcagtaagcacttgttgattgactgaatgcgtggctcactatcaatgtgaattaactatatacatactgcattaaaatccaacaacccaaatactttctagctttcaggaagtaatgcatctaattgacagaaccactcttatgcctcctaatccccacttcctacaaaccagctcaaaggaagagagagaatttgaagaaacaaaaatgaacataagaaaaacaattagctgatgcactctgcaaagcctgtaatattatctagaatgacagcatagccattgttcgtgctgccagagccccgcgtgtttgctagctcacccgaggtcctgagagaataataaactaagcagattagatgtagactgatgcctccatgccaccaccaactcacacaacacacacactgttctgagtgtctgaacacatgcgggcaggtaaacccagaaaatgggcactccatgttggcaggaggggaagaggctgccaacaaacagggcctgtttattatttaacagttggtactgctagaggcctggcaccgctatagagcactctctgtttcagtgcaagtcagcctgattatgagagcgtgtgagccaaatcatgtttaccatagtctgtgagaacctctgtgcccccaacagacatggaaattcttacaatagctctcgtccaaacagagaaaaatcactcctgagatggaggtaaagggccccacgtgcttaaattttgtctgatcagctggctcagtgtctctacatgtagttgttttttccctgctcaagacaagtcattcctctctaatgatacagtttctaatcctctgcctttggttactttactttgggacctaaatcaaccaaatactatgtcaatcacccatctactaatattgcttatgctgtcctgcacgctttggcttttcagcaaaagaatctgctgcccagggcggctacctcctgcttctccttcgccagggctgcctctgcagtaagtctcctctctgccaatgtgggccacaggtggatgccttcctacaaatccaatcagcaggataatgtgctactatcacaagagtggaccttaatgacaaagagccctgcttagatggtcaccccattaactttgatttgattattctgccccagcagaacacttggcttcacaaccacagatggcaacagtccaacataaaacctgtagacagagtagtcatgttgggttcatacattttcaaaatattaaatttcatgtaaaaatataaacatggtaagtattgagagagtccctggttccctaggaaagcactgttttcttttcttttttcttttttttaacaaaccaaggtcagagcactgagacaattgtgctaactaggcaacagggataatctaatcatttcttttgaaattcaacataaatcaacatttcttttaagtgtaagaacctggcttttatcttccatatacaaccaaggcaatctttgatactttatgtgactctattctatacaactgtttttaaattcaagataaaattggctctatataagctagttcaatattttgaaatttaattgtaacttggatacacttcctctgtgaccatgagtaaatcattaaaatgctttctaccaatgagaataaaggcatagcaaactataagtcttacctgaaactgtatgcagtgattgttttgtgttttgttttctaattgacagttgatatttatacactaaattatcaaactactatttgtttttaattaattcctcaactttgccactcaaggaaaatgatatatgctttgtattgttaagtaaatacataattttatacttatcatgttattatggttttcaaagaaagtagttgtccctaggtcacagattatatacacatgcatagcaaaaagactttacaaaaacaaggaaaatatgaaaaaataattgcctagcttggatcaagttaacccctggtttaatttaatcatctcctctactgaggatctgataagagattcttaataacagccccaaattaaggcaatagaatcaggaaatctttttttttttttttttttgagatggagtcttgctctgctgcccaggttggagtgcaatggcgcaatctcggctcactgcaacctccacctcctggattcaagctgttttcctgcctcagcctcctgagtagctgggactacaggtgcccgccaccacgcctggctaatttttgtatttttagtagagacgaggtttcaccatgttggccaggctggtgttgaattcctgacctcgagtgatccgcctgcctcagcctcccaaagtgctgggattacaggtgtgagccactgcgcccggccaaaatcaggaaatctttcccaaaacatcctgtatatagcaacactcataactactactttatggcagaataatggacccgattacaggttcacatggaaaaagttgatatttcagccacgaccaaaatataaacaggatttttcatagggagtagatggtgtgttcatagcgagataggtggtgtgttcatctctgtgctgagatacttcatcttaactagtaagaaacatagtaatccctcacattcattaagaggtatgctgtaagagcttaatatgtatacacccatttaaccttcataacaacctttattttttagtgactactatttacagtgattactattattttctccattttacagacgaggaaactaaagcacagagtggttaagtaacttacccaaggccctgcattatgtaaataaaggggctaaaatttgaactaaggtggtctggctccagagtcaaagtgtaatcactgtgttctgcttctcataataacgatcactctttctgaagcttgtgttcaatttaaaactgtatattccctgaggctgtagaatgttagagctgaagtaatttaaaatgatctaacccatggcctaaagctccaggtggagagaggatgtttgggaagactgtgtagcctcaaaattttgtggataggcacacttttctgggaaaagaaatgagccactcatctagtctaaatgtctcagttgagggattaaaaaaaataaagccacaaagcaatggctgtaaatgctgcatattttaaggaagcaatataaaaagaaccaagcccagaaaccagggctgttttcattatcctgtctacccaaactctcttaggtggctcccttaaagccagaagaaatctgtgtgagggatgccgagtcagcctgtttctctacttggctccacatgactcagtaaagcaaatcaatgagacaagatatctactcatgcaagaaaaaacagaaatctagtgtgatgttttcttgactattcaatgctaatggaaaaaagttggtaacacatttaagaggtaagaagaaataaaattgtctctttacaaagttgactgatttattcatttagtagatacacacacaggtatacacacatacacacaatttatttattttagtggtagcccagaaactttctgaatttcttttgtatttctcttgagtcttttcctgtaatttatatttacttaaaatttatcccttatgttcaaatttttcacatatatatataaagtattcattataatcattttaatttcctccatttctctggttatttccccattgtatttccaattttgtgcatttgtgggatttctcatttagtaattaaatcatgtgatattggtttgtttattgttctgttattctctttgaaaaaaccaactctttgatttattagtgtgtctcttttttattttctaattccttaacttctgactttatttttttaatcaattccttgtttctactttgcagatttgttttttgttcttttaaccaacttcatgagatgaatggtaatacgtttataattattttctttcctgtaatagtcatgtttaaagatatggatattcctccgaacactgttttatctatatctatacatacttattttctgtaaattctgtaatgcctcttaagcaaaaaattaattttaaaaagttattggtcttttttcttatcaattcgcaggagctcttattttttggagatactatttttgtctgagatacgagttgccaatcaaaatgatcactttttcatatcatgtaaaaactgttttttaaatttttatttgcttgatttttcttattcacaattgtggtaatatcagtagaagttcttctccttcctctcccagctttttgcttcctatatggtttttggtcccattagagttttattttcttcttctacttccttcttgttctctcacagacaattttatttctccttatttgtcttatcacttattcaatcctgtttatctagtttttgaactttcattttattttattttattttatttattttattttttgagacagagtcttgctctgttgccctagctggagtgcagtggtacaatctcggctcactgcaacctccacctcccagcttcaagtgattctcctgcctcagtctaccgagtggctgggattacaggcgcccaccaccatgcccggctaatttttgtatttttagtagagagggggtttcaccatgctggccaggctggtctcaaactcccgacctcagctgatccacccgccgcagcctcccaaactgctgagattacaggtgtgagccacaccgtacctggccttgaccttttattttaaggaggccacaatgtcttctatttatttgctagtatggaaaatagatattattttcttgtataattcttcttgtggtatatgttttgatctggtttctttgtattgcttttgtttttgtttaaagctattagctttgcttagctgatagctaaatctgggtccaatgcaggttcctttctgattagttttcatttttcactgagttaattctatcagctgtttgctgcaggaaagaggctggcacagtaaactgaggacttcagggagtttctttttggtaccatatttcctgttatgttttacctttctcaccaactcgaccgtgcacattgttcaagagatatggatctgcttagtgttctcagtgtcttgtcttccccatttagattagcgggagttccaaagggcttgcacaaagtcctgcctgatacattttccaagtcatgatctaatatttccttatttctcttctcctgaaggtgatcaacagtggcaaaggctggtgtggtttatcttctccaccttgccacccatgcatcctgcttttggcacatgtggcaggctggtgtcattcctcattcactgccacctcctctgttatcatctgttgtagaacaagccttagcaacccttctgcagaccacctatagcctcacactttcctgttgcatgtaagtaactggagcatgtgtccatcaacttttggatgttctacctgctgcctatatttaaaatactctcgacattgtccctgttctaaatttcgaaatatcccatggtttctgatttgagagtgtacctgccttctgtaagaaaaggcttttttatatgcatctcattttctatttaattgtttgttgcacagcaacatatgcgacagtgttgcatttagtttttcatctgtggcctcctaaatggcaaaaacaaaacttcacttattagctcctctccaatccttctctcaatcaagtgcttgcccgtccttgtccttaaacccctggactaatcccttgtaaggtgtcctgttgtaaggtgtcaactacagcattcacattcattgaccatttatatttcccctcataagcatatttgcatttaaataggagattttaaaaatctaaactaaactttagactaccagatgaagttataaattaaaactttgattgtagaatgacaaataacatggtatatgtggaaaagaagttagaggaccccaattagtatctgtaaaatgacctcatgtgagtagcaaagttatgtgtgagttgctttaatctttaaaattagcttctgcaatgcttcattgttttctataatagaagagtaataggaaaatgaggcatttgttgtaagtaaattttctagttacctgtttaagcagttttcttttaaactttaagatgaaaatctttacaatgagttcctattttctgaaacaaataagtgacttgatatggtagaaatgtactggagtgagtagttccagattcttaagttctttctgttacttattattaataaagttttgacacatcatttagcccacccaagcctcagttctcccatctgtaaaacaggaatagcaatacttcctttcttgcaatataagttttctgtgagtggaaaatgacataatatgtgtcaaaatactttgtatactaacaactagaaaatgataagagccttaataataaaagataatccaaataaaatattacactactatcaaagataatagaggctaacagggaagttatataaatactttcatgattcttttgtgtgttttttcctagttgtttagccaaggtactcacttctatttcagttctcattgccatcagtgagtctgcctctagaaaaaacactttctgttttcccgcctcctcttctccagtacatttgtatagtttttgtctttgtttctttggtatgttttctgtggctttaaattggctgcaaaagattgcatagggtaatgaaaagagaaagcagctttggagtcagacagacctggtttgaatcctgactgtgtttttgtgctcatcacttaacgtccctgaatctgtttccttatccataaaatgaatttaatcactgataccctgcagggctatctaatatgtgaagttcttggatttcatcaaatctcatttgccttcttaaaagtatattttgcttatttctgtgtttttaattgaagctttatgacatttgacaatggatacattgctgcactctgatcagtaattattttattcaatgaatcatttcactttttttctaaatgtcaccaaagactctagcttccttaaaatctactttttgttaatttccttgactaatcttatagttccaatagtttctctgcttcaatcagctttcttttgtctaaacttcttctgttttctcttgtaaaataatttatcctaatcttaaatctttacgacagagaccatatcttctttggccataatgcatcgaatattctgtaaaaaccacatcactatcaatcaataattatgtgtgtgttataagtatgtaaatgttatagatctcatagaacttatccactctgccttagcttattcctagaagatcacagattactattatatagcatttgtataactctttatcatttgtgaacctttcgtaattatttaatggaggtcttcaaactactagtatagattgattttgttatttctattgttgggaagggaaaacaaagacagaatgatgaaaacttgtcagatatatcccatgttaccaggaaaaacaggattagcacacagtctcttattctctgatctgctgatagtctgttgagctagtgttttcctagcatgaaaggaagaaacatctattcatttccaattattattttctggaaaaggtattatggagatggttctctttatgttcaaaataaataaaatgtccgagtgattcctggaacttgggagaaaggggaaggtaaaccaaaaactagggccagagagcaagaaggaggtaaaggagataaaattcgtggtgggtgaatcctcatccgtcattacatgacagaagtatttaaaaaggaaagctactacctctcctcatctgaggcttcctccagaaccctgtaggagaggaagatacactgctgagtcttcatttggggagcagcaggagaaggcagtgcctccttagccaaatgaacctttcctgacagctgtggggatatgtgtttgtgccaccaggccccttagaaaattatccctaaaataactaatgtttagtcagtcaaaacaacaacaacaacagaaaaatagcagcttcaaagcgaaagttatgtggcgagagtaaataacccaaacttaacgtgaccttcctagcattattttagggaggcgttagggtatagagagtgaaaaacaccctgaggtgggatttacaagtcttaatttcagtttcagcagtttcactttctggctgtgtggtattagacaagtggcttaacctctctggacctctctgatccttcagatttaaaatgagggggttgattactaagtgacgtctaagagcccttctagagataaaaaattccccaatctatgataataataattaacatttgatggtcctttaccacctacaaatgatttccacatacattatctaatttgatcttcatgccagttctgaggtagtattattatgattatgcccatttttggaagagagattcagaaaccacaaaatggcagagttggcattgaacagatgttcccaagaggcaaataccccttcagtaaaagaagcagctgatgctaacaaggataaataagagcagacaattcagcctgtgagctcttgtttaggggtacaacagaatttctggaagctgcattggggtaatgataatccaccatgtggaatgttatctgatgatgtatttatcaaaaaaaactaataaaaagaaaattaaaaaaagatacaataattgttactgcactacaccctaatgaattattgtgttcaaggttcttacaaaaaaaaagtaatattatactcggcttatgttttaattgatttattaatattttatcacaggaatgtaatttaagctcctcatgatttagatctcataaacctttagcattttgcaaattcaaattccaatttaaagccagggcgagcaattaacttttctatcatcttgtcaggggagaaggttcgtgtttaatttgagacaaagtgacagaaatatatatacactgtatgtattactccaatttaatttatgagtcagcaccatccaccttcaaaatgtagatttaatagaagaggaggaagaaaaggccgtgctgtcatgatagggctgtaatatctgccctgaatttcttacatattaaaaaaaagtcactggtttgttgagataccaagctagattgattgcaggcctatttccagttcttttgtttcacattccacttcctgattcttttctcatacagcacataatctcatggatatcacagggagttcttacccccacttctacctctactcctaccccatcctccattttcatgcatagctgcttctacaggtttatcctaaatcttgacaagtgagataaatggtaaatattgctttgagatcacgtcttcatcacctttctcatctttccaaagccaccttctaagtgctctctacctaaaacaaacaaacattaaaactcctcgcaattttatattttaatgtgcagggtgtatctggcacggtaaaacactggcactttcccgtgatcctttacaaaatatttaaggacaggatatgaataaataagctaaaaccacagaaggtagtcaggtgaactgtagggaagtacttccccttggtggttattaagcactggaacagggctgcggagagaggttaaggaattcttactagcgccgttatcctataattcaccaaaggcacacaatgctctatgctgatgagatgagttacatgacatctcctccctggttcaatcaaaggaaagcaatttacatctcaaaccagttctctcatcagtgggacataaaaactgcagaacagagatgcagcaaatgtgcttatttatacagaatcaactcagttgccactgttctttattattttccttctctcccacctcccctgtatggtggccattttgaataggatgcttaaaattctaaaagtgagaaaaagaaccaagaacaattcagtaacaaaattaactaaagataacttgtgcttctgacaatcagtgtcccttgtggtgctaggccaatccctttgttccacttaaaaataaaatcggattcctcttgctggccacaggaaaagaattagaagacgattaatggaaaattctggaaggtagccttgtaaatgtttattcacttttcaggcatacaatgttgtgctacataagtgaatacagtgcatttgtcaaagaaaggccatgttgaattagtgtgaggtcttcattcataaaacaagcttatttttactaataatctctattaatctcagcttaattatattaggcatttttcacttgcatacaacagtaaaaatggccaaaactgcatttactgcacctgcttaaacgcagttatatccctaaaaacgattgcagggaacaagctcccacagacatggcttttaggcagaatatgggattatggcagaggggtttaaatacaggaggtaaaaatggtaatcatattcatcaactacacaaagaagtaaaaacaagaagctctagataattctttttagtggactcactaaaataacaataacagcttgatgaagagaacatgattgtcgaaagcttgtccattttacattttctctttacatagtgcaataaaaaggaagcacctgcagtttctacttgtgcgtgtattcgtgtgtgtgtgtgtgtgtgtgtgtgtgatgttgaaagaaatcatggacatcatatttgctttaggagctactagtctaatcttaagtgcacattccctaccataaagttgtatttgagctccgtgcagtgcagaaacattcttcagcttagaaagtgcagtctttgcttcacacccttttccttcattcagacacatcagcatcttatcactttggacattaaagtaaaagagacttctttgtcatgaatatttttagacaaattacaccaaaatatcttgtattttccattttttagtggaatctactttactgacatataccagcccaccataacatcactgttgtgatgtcctactacttatctaaaaaaagtactattaactacatattgcaggtatttgaagtatataagaaaaccataaactgaattacattgtatggctggtatgatctcacatgaagtttgagctatcattattaaaaacagaaattgcatttagttaatgcatctgacagtaagccagtcaactttcaaggttgtatgatgagaaaaaaaatattttttaaaaaaacagaaaatgcctgaaaaatttcacaagagcatttcacatgacaagagaattcttcctctcccttctgctgcctgcctgcccacctttcttccttccttccttcgttccttcctttcctccttccttccttctttccttcctttcttctttcttttcctccttccttccattcttccttccttcctttcttccttccttctttccttccttccttcttgccttccttcctttcttctttcctttttcctctctccctctcttctccttcctttcttccttccttccttccttcttccttttcttttctcgtgcttctctcccttagtttctctcttctttccttccttccttcaatttggtggaggaggtgcaaaaatttgagtaagaaaataatatttttgtttcagaatccacatgcttttactattcatcatgctaacttagggggaaatttagataacttcttatggcgttttttttttttttttttgagtttatagatatctttcaggggtcaagctatttccaaacattcttataatggcctccaatattccacactgcaatatatagcatgctctaagcaaaggcagtcttttataaaagactgcaatagctagtgaagaaatacttttttttgattacttttataaaggcacagagcaaacgacagtacagtatgtacataaataaagcaaaggttcaaactgcacttttacaactacaatgtcactaatagacctcatcccctctctgctattctatatatataggttgaaatctgaggcttaaaacaatgtttgaacaacaaaacagaataaatgactaacccaatctttcaggttccaaaaacagtactggagagttttctatttttataggtgtttgtcactatggacattcaatatctataattctgaaattacagccgggcgcggtggctcacacctgtaatcctagcactttgggaggccaagatgggtggatcacgacgtcaggagatcaagaccatcctggccaacagggtgaaaccccatctctactaaaatacaaaaaattagccgggcttgttggcgtgtgactgtagtcccagctactcgggaggctgaggcaggggaatcgcttgaaaccgggaggtggaggttgcagtgagccgagatcgtgccactgcactccagcctgacaacagagcaagactccgtctcaaaaaaaaaaaaaattctgaaattacaacaaaattaggatctgaatatgtgttttacaaaatgatttgctataggccttcatgggggagatggcaatccctagtatatcaaacactgtggcttaattttttttaatcttcacaaaactcttcaagaatggttgtcataatgtaagaagtgtcagcattaccagaacaatcagagatttccataggcagaataacattagagattacgtcattacaacagatagccctcatactcaatgcatcttacatggtcagttaaaccaaagggtaggaggcactataggataattgtgagaagagttgctttctaagtggaagaaaggtgaaaataaagcacctgcagtgctgtgctttcactttacttcctgccctcacagtcatcctggagatcttactggtgtgctttaactgtcttgtggcattctctttcaaaagcatcttcagggactaaagttcaggttttatcagaatagacatagtcctgtgctacttgacagaaggcattttactcttttttatggtttcactaaaatcaagagtatcacaaaaacatcttaagatctgaaactgggaatcgcctcataagcatgtcttccaaccctacaggttgtataaggcaagtatgtgtagattgaatggaaccctctatgtctggcttttcagtattgtaaagactttcaaagctcattaagtacttctttgctgatacacaccaagctaagtcccacctcagggcctttagaccttttgttacccatgactggaatgctcttcctctagggtttagcatgcttctctctttattctggtttctcctcaaatgtcacctcttcaggagacttacactgaccatcacatctgaaatagcttgccaactttactctacctatctcactttattatttttcatagtatttatttttttccggaaattatgtactgcttattatctgtctcccctaataaaatttaacttctttgaaccaaatactttgtcttattccttagtttattgctagtgtccagtactgtgcctaatatatggtaggtgctcactatatatttgtcaaataaataatacttaaaatttaaaaatttattctcctttaagttgtacagtttaagcctcaccttattttctgctgataagagaaggtatcacctacaatgacccttcacattctagacaattaacaaagtctatgtggaagaataactattccaggaagaatgtgttcagacctggtttgaaatcacagcctgttgctgtggggcatttattacccaccatttagctagattactgaatagatggagttaaccaaaatgctgacaagacacacaccacacacacacacacacacacaaacacacacacacacacaccccccaaaaacgaaacctcagccctccaaaactctccttactcttgtaattggagtgcattgccactttgctccaagccaaagaacagataagaaagagaagcaaaaatcagaagaactttggaagccatttcactagagctgccacctgtcacttacgtaagaagatgcaatcatccatctgtccaaactggtgaatcataaggtcttaaatactatttactttccccaaaatagtgaatcccttgcaattttatatcacataataacaaagggacatgattcttatttgtttttcctttagatacacatagaacattttctttaatgtggcatacaactttaaaaatataaacaccaattcactgaggtatttttttggtagaaaaaagtgtctatcataattttagtagcaataatagttctgtacatttcttttagcaattacaacctcagatttctaagcactgtgcaaacattaatttactaagttctgctgtgttctctttgtgaattagaatattatcatatcttcattatttttaggtgagagtcacatggctatgacttgccagggccacacggtaaataattttttttaaagtggtaagatgcctctgttttgaaagtggatgcccagggaagattaataaaataggataagaacatacctaaaatggcatctgtttttttttttttaacctagtgcttccattcaaattttgttttgggatatgaagtcacctgatagctcagttcaaaactcgaataaacatccttgaaaatagtagggttattctttaaaaatagtagttatcaattattgagtgtgcaccttgtgccaggcacagttctaagagatctagttctaggagggaaagtgtacgagtccatgtgaacaaggacttggtgtcttattcactattgtatgctccgagcctataacatacctggatggtagtgagggttcagttggtatttgttgcaataagtgtataaataagggaagctttcttggttccagaaaactaaactgtctgaattttgaaacacaacctgtttgtaagttgggggcatcatattaaacattttcttttggaagcagaggagaagggaagagattttatttgacccaatatataaccaaatctaggataatagtgatcctctttacaataaagttcatttattcaacaattatttattgaatacatactatgtgccaggtattggaagaggttctaggaataaagacaaggtccttatttcagaacttaaattactgtttatgggcataagaggaaaatatcttcatatacaatgcaattatgaggcaagatttttctatgaaccagtgacttctgtttgtttttaccatgttaccctcctaatttactaaggcttcaattacttggttttcttctgagtagccaggaggacattatagcaaaaagtaagtatactgattaattacaacatatatccataaagtggaggggatatctgaaaatcacctagagaatctgaccaatatctaagaaattaatttaggtcaaatgattagttctgaaatgtctgagttatctatattagttattcatattgccagttcttaacttgttctatacaaacacaatctgaagcttcatctgggcttcttcaaattggaacctagttacaactcttaatggataagttcaagaataatgccactacaataaaaaagaaataaagaagggcacaaagtattagaagataaattatctagagattaataaagtctttggtaagagtttgcaactctatcacatatgggctaattggaaatcactgcttccagggctaatgacctcatttgaggttaccctgtgggacaataacatggcctacctctgtccactaaacaaattctgtcaaaacataacttaccaaagtatagcttgttgaggggtatacatatctgaatttattttactctgataatctgcccgagaggttctgttacttgaaggcaatatcacttcctttgggttcacttgtaggacacaaaatgcagcttttacaagtatttctgcttgtaaactaattcttcagctatagtatataaacttcactctataagaaaaccaaagaggccaagggacattaagtttggtgtttaattgctatcagcaattaaaaattgctagcagcccacttaacattttcttcttcctctaaaaatgaaactgaaacgtatcttttagctgagagttctgtaatgctgagaaaacatcctaaatacatcttggcaaaggaagaaaagaaaaaaatgtgatattgatgtatttgctttcctagtatattgaaatcaagaactagatacaggtgacagatctgcttccacctgctggctcagtgaatttgtaaaactgaaatctgttatctaaaaatcactagtacattcagaattacttagcattccctttctgtttgtacatgttcatgacaatgataaaacagccccaggaattctgctaccaatcttcatatatatgtccattgacattgtctccatcaaattcaatccaataaaattaaatggagttaaataaagcagtctgcttgaacctcagtatctctcatttcttattgtattgtacctcttatcatttcttatttatttagccaaggttaaaaaaaatggtttccagattcaattataatttccctcctggtctcctatttcttaagtattttttcctttttattttcatataattacaaggatttttttttttggcaattgacatgaacaacattattcaaaggaaaaaatacttaaagtagctactatcttatagcaaagaggacatttccatctatgtttaccataaaaattttcactggattccaacattttcatataatactatctacaaatattgcctgctttgagaagactccaaattttaggaggtagatgggcgataggtaatgcatggaggaagttggtaaagaagacaaatttctaactatgacttccggagttaaattttaaaagaaattgagaagtatacaaaagtgttaagactgaaatatatgcaattggcttacaatttctccaaccacttgaggcaagagggtaactccaacttttgccccttcattgccacacttcttcaatctgcatatggattttatgtttcccctttacggctgcccttaatattaattttaacctcaaataaaatttttttggaaggaagagtaatatacacattataattttctctggagttttcctcccataagcaacagccagatgacaaccaacttctcattagtctcttgaaaaacgaatcagaaattttcttatgtccttcacacaggattgccatctattataaatagtgctgaaagaccccacacacagcaaactgaagcatgtggcatttaatacatcacacagaaggatcaagaattgagtcaacacttctagggcttctacccctcaactatgcatttccatggtacccatttccatggtttttagacttttaaacaaacacatttgtctaaaaacaaatacatatgtaggaaacatttctccagggctctcgccttttcagctgcttttggttgacagatgagaacccacatacagtattctgaaattctgcgtcttcttgtcttaagtactagagaaagaaatatttggtcctaggtggcagatcttacttatatcacttctattaaacgggcaagatagagtcacaaaaagaggacttatgattttcaccttataatggattccttcttggcttccttccacctcctatacatggatttgaacttcattttgaagacacttacaattattctgaatgaaaactatcattttcattctccctctcaaaaaagtttctgaagaaatttgttgcaaagccatgctatctgtaacattacgaatatgttagcatatttttagtgcttcactagatttcataaatcttacttacccatatcaataacaaccagtataatttgaaggaaaaaggagaaatcttgtgtcttaaattatatcatttaaaattcatggatgaaggtagtatccctagaaatgatctgattctatgtgactccgggaaagatactatttcatttctgttttagagattaagaaactaaagtacagataagttaactaacttgcctaaagccttctggtgaatgagatagccaagatttgaaccgtggagtccaacgccagaggcttaaccattacattattctacttctgtgttaagattaatagagaggaattaaatgcataattttggaggcaaacagcttaagttcaaatcccaatttcaccagttactagctacatgaccttgggcaaagatcttaaccactatgaaactttatttcctcatgtatttaaataatagctgttcttcactgagtactaagctatgttccagttatcgatgctaagtgttttacatgcattattccatttaattatcataataactcaaccaagtatgtagtgttatcatcccagatttagagatgaagaaactaaggttgagtaatttgcctattgttatacagtaaggggcgaagacagaattctagtaagggcaatctcactctagacaccttactcttagtcattaaatttggtgataataaccaatagtgtctacttcatggggtttggggttgtgttttggtcaggattaaattaggtaatggaggtgtaatggctaattttataggtcaacttgactgagccacagggtgctcagacatttggtcaaacattatttggtgtacttcagtgagaatgtttctggatgagattaacatttgaatcagtaactgagtaaagcagattggcctccctcatctccaaacagttggaggctggaacagaacaaaaaggctgactctctcacaggtaatagggaatttctcctgcttgacagcctttgagctggaacattcctttttttttcctgtcttcagactcaaactggaaacatcagctctctgcaggtctctggcctaaggaagttcagactaggactataccattagctttcccaggtctcaagcctttggactaatacgttggactaacgcaattggctctctggggtctctagctttctgactatagatcttgggacttgtgagcttccacagtcatgtgagtcaattccttataaaacatctcttctatacaggtatacattttattagttccaattctctggaaacatagtacatagtttctgacacccagaaatagttaatgaatgtttcttaaactgctttcccaagaaaagccaacagaaaaggaattataggatgaaaaagcccccttcagtaagagcaaagataggtccagatgaggaggataatgttctgtgggcactcggctcttaagagaggagcaggggtaggggcaaattttaaaacacgatctgcagctaggtcagatgataagcttgtttatgaaataagagatggcaggaaaaccaggttgatccagatatcaagaagaaaagccactttcatcttccactaccctaactggaagggaatcttggttccttaccatgatagcaagctgactagaaatatagatgtgatctttccctttgaaaagtaacaggttacagggaaagtgaaggaatttatagaaaaggtcaagtttgtttagtgccttactgtgtactacttcaaccaattcagctctatcacccaggttggagtgcactggcacaatctcgtctcattgcaacctccacctcccagattccagcgattctcatgactcagcctcctgagtagccagggttacagacgcaccccaccacgcccggctaacttggtattttcagtagagatgggatctcaccatgttggccaggctggtctcaaactcctggcctcaagtgatccacctgcctccacctctcaaagtgctgagattacaggagtgagccaccgcacctgccccaatccaactcttacatacatactttgtttccagctataaaccataggggcataaaaagacttctctatggaacaggttaggtccctgaagttttcaggtctaaacatgctggagatggcaattaaagctttctaatatatgcgagttacattaatatctttgaaatacccattcaattaccccagctcaacacctgttagacaccctctctgtcaaatctcttctgaataactttgtttagttagatttggggccagtatcgtaacttcacgtagtctgtacaggaagaaaataagtaagctttactctggatctcagggaacatgtgtttctcccatcatctaagctaaaaaacaaggaagctgcaacagctgggacaagaaggaaaagccaatttgatttttaaagaaaatagaaaataaaagcaatttgtccaattccaatgtgtggtatctatgctgatttttctcaaggaaaagtgcttatcattgccaaaatccccaaagtaaccacagctgacaaacttctcagcatcagagcacttggcaactgacaataagacctgctccttccccaagcggataaaaagccaggaactccccaaacaaaaccaacagcttttctgtactcttagtctgccttcatgtcttttgagcacagtatattgtcctgtgtaactggaggttcatgtagcacactgattttacccaaagcatcaaaactaatataattaatttatataatcttctagttacactgactatagaacttaccttcactacctacccaaatgtctgctgctgatatatacatatgattgcacaaattctaaagagtactctcaataaacagaaatgtaagtctgctaaaaatgcttaaatatacaaagaaatgcaaatataagctctctaccatacataggatctttgtttataccagttgcacatgatcaatggaaaaggacattcaaaacacttttgaataaacaaattattatcttgcattagcttgtatcaatagaatccttccaagtattttttgttcataataaaaatgtgtataggttggtttgattattttttactcttatcatggcaactcaatataacaatactgtgcaggtggaagagggaagaggggaaaggagagaagctgcaaataaccaatttaattaccctaacagtcatttttttttgcaggaaaaaggttccatatgataagaatgtttgttctgatcaaatatctttgctccataaagaccttatgaatcttccttcaatgtgaagctaagctatttctgaggagctactggaacctcctcattttttctagaggtatccatgttctaaaaatctcaaatgatctcaacttaggaggttactgaagctacataaatgtcaaaagaaatgatagatttacacttctccaatttctgcatttgttatgtagcataaattcatgacagaaaaaaaatgatcctcaaaactccttagaagctcgctcaaaatcttgttttaagtctactcaaaccaaaccaagttctgctaatgtaaacccttaagatttgtggtagtttttcattcccaatattaaaatagtcttttattaattctccatcacatcatattttcccttgactactaaatcaggtccacatttgttgcttctatgtttttgacatcatggaagaatctggagcagtggtacattttgctcttcagagatattttattggtttaaaatgtttgattactaaggggtttaatctagtaatactagattaagtactgtctaccataggaaaaaattcatcagacttaaggtgtttcctcttaagtggaagtagaaagccaaatttcaaagcctaccgtgttaataacaaatgcttccttttatattttcatcaaaaaacaagcctatttccttatctaagttctgtgcaagtctttctgattttctcacaataaactatatgtgtgaaatcccatcagtgttatcaccaatatttattcctgatggccacagcttttctaatctttgtgtagccatatgcttaatgttacataacccacttggaattcctttcttacaaacaaatagcaaaaatgtaagtttatgaagtatgcattccttttttaatgccaaaaataaaaacaaaggaaaatttctaaattggacatgtgataatacataaaatctatctgataaaaagtgtgtaattactgtcacaaaatcttcacacaatccttgaaatctcagcagtagggtggcaccaagttcccacacatcaattaaagcatgtacatatacgtcattggcaataggtcagtctcacagagaataatctcatgatgccaaagctatcctacctgaactttaattcctgaataacaatgttggctaatagtgttttactggatattgtcttacttgctaacatttcttatggggatcttgattaattggctacctaatccccaaagattattccagaaaataataatgtctgaaaagtagaggtcttttctttcacctatgcacaaatttgtcatagttaatatgaaattactttgttcatctgacccctatcaagtaaaaacacatgaattaagatcagcatgtaggtgaaatgcacaagaaattagggccatcttgagaggactgtcatctagtatgaatcacatactggttgaccattctccctccaatcccatatttttatggggttatacttaatacgaagaacaagtgattaatggagcattaatcacagaagtctactgactaaaaaggactgaaaattctgagccttgcttcagtggtgatggtggtgggaatgtgggaacaaagttgctgcacaggtaatccctagttttgatccaaagaaatagcagccaagcagaaacagacagacagacacacgcacacacccctcaatatatattaaaaagtcaaatttcattcagtttctcaagaaaataccaagaagaataagacagaaaatctctgttcttagtcttggccactttattctccacatggacaaccactttgcatcaaaagtctctctctacccttactttcacctctaagtcttttctccatcccttctatcccttatgggtacttttctttcctccctcctcatttttcctgtctctagccccttccttttacccaagtgaaattttgtcacttttgagttcccctcccctatgatcacttttccagttctatttttcattcccccaattccacactacccaagttttgacacctagctggcatgaagagagttcttagaagaaatggaagagaatgagaagaagaagtcttttctgtgatacaagaaaggagaaggccatgactactgacatgaaattaaccttgtcccaaccacatacacgtacacctcaaagctttgtaaaccactggcaaataccctcttattatctcccctgccccatctcccctttcttttaattttttggttagttaccaatcacaggagttaacttcctacatagagggtagacaaatcagggcaatctatgatctctttaggtccatggatagatgttcacccccaaatgcagagctctgctaaatacatctttcagtatctctgccttcttagatactctaagctataactctactttagttttagggtcctttttgcctttttctggccagaacatattgcttttatatgtcttccttttcatcttcccaaatgccctaataccagcttaggctaaatgtgctactggtataaaatgtatctttctccttaaaaaacaccaattattctcaacctctgggatccaaagcatccggaataggggccctcttcaataataatcagtgagtgagtgatcttaaaagatatgtggtttaggaagatgaagttaagtatttaaggtcacaaatcaagtgtggagtggggctgcaacccagatccagatgttctttctgacatgatctctcattgtcttttttcttgtattaatcagttgctaagtcttattatttcttcttcataaaaaagctaatgatcatcttattgcaacaccacactctctataccacaactatatatacttattttggaaagctaagattattcaagtaagactaaacaacacataggaccttcaaaatatgctcctaatcttcccttcttgtcttcgtttctgtctcctggtcccagttcctcccaactttatgtatgcatgagtcttttcatgatcttctctctgcctagagtttactttcacttcccgccaggaaaaaaagaataagtaccctttttaaataagcaaactcaaatattatttgctccataaagccttcccaatatctattccatgagcctttcccaacatctccactttcctactaacagatcatatatcctgttgctttaaaattcctactgctttcaaattctttcttcttgctagattgtgacatgcttactggcagaatccatgctagatactgggaacacaaggattaaaaccacaacccttgtactcaagaggtttccagtacactagtaagtcaaaaatataaacaactacggcacaggtctgatgtagaaaacatatttctatttaattgacttgaattatagttgcacacattttgtgttgtaaccaagattatgttacatatgataatttaagtagccaaaagttgactcaggttgagtagagaagtaaaagcacataagaaagagaacaggaagaaataaaactgtaaagatgtaatgggagagaaaatactgagttaactgaagtaatggcttaatgcagaaataagacgtttggggaaaggaagttgaattagttgaagacatttttggtaacaagagtcatgaagcctacagttgccagaaataaaaaaaaaaaaggactgactatggagtatttattaaatactcatactcactgtttgaagtacaaactaagaggaatcagaggatcaaagtggttggttatgacttgctcagctagtaactgcaagtgccaaaattcaaactgtggaatatttcaaagtccgccctttctaaattcaattttggcctaaatccaaggaggtagtgtccacagaattagctagaaattacttatttcctaaaagatcaaagtcccaaagaactctgtatgatttcaaggctgctcatatggtaataatggatacatttcacttcatagtctaatcaactaatagactttaggacagtgaatatgaatgacatgaaggtgccttgagaaccatcaagtcctacctcttattttgagactaattgaagatactgaggcccagtaattgaatcatatagattgctaaaagaagttctgagaagaaatgaaatacaaaagcttggtttctaaggctgaatatcatgagaaactatcatgttatcctgtgtgagtgagctccacgaggccaggtatcttgtctcttttatggtcaactgtatctccagtatctaggagagtttatggtactataactagcacatagtgagcacttaaaaaaaatcaggtgctcaaataacacggtttagtgaaggaattaacgggttcatatatgtgaatgtgtgtaaagtgggtgcaagcatgtaattaaatggaaaactggtcatatttagttagatgttactaaatttatttttatttgccatttggatcacatgattttctcctttaaacatcccagtgacattataaatgtcttatgtagcaaggtctttggcttcaaatgccttcaccaggaattaagagtttagtacaccatcaatgaatagaatttacaaagtaccctttgggcagaatcattaaggaattaaggaaagttttttaacatattgagaaataacacaaaaggttctgaaaataaaggataatatgaatatttcatctttgtcttagttttggggggtggggaacacagaagcaatatttcatttctaaaaccatgttcccatgaagctgagcagaaggactgcttataacataattttccagccaaattcccaaagggcccccaacaggctttctcaatttgtgggcgctgtcctctaacaatctatttctttccagactctccttggaaaccaaagatttatgtcattctcttcatattttaaaatgaaattgttccaggttaaagaaattatgaaaactgaaagcctgtctttatccaagaaccaacactgcctggacaaataacttatgaatacatcctattctggaggtatcatcaatgactttgcctctgtagcactcttaccattatttggacatttccagaaatcaagatccacttcagtttgtgaagatgagctgtgcttagacataggcttaaaaagaaaaggtaaataaatattctgtcaggttatatagagggaagcagaccctcccttttataaataacgtatacatttgcttaaactccagagtaaaggaaaaatctcatggactgaaaacattttttaaaaaaatgaatattcactaaacaatcctgaaatgctttttgctctctgaatacattcaaacaagtagatatcacagcatttcattgatagcttatcaaaccacagaatagaacaggaggacagaatacaaagggcattcttaagggagcaccatcatgattgttctgtaaaaacatatgaacatattgctataaactcatcttcacaggaagtcacacagcttaataagcacagacctgcaagttaatattaaaattcactttgatttcagcagcagcaaagctgatccaactaggagctattacataaaacccttattgtcatattcgtcatcaccactctcaatagagaccactgccagcaccaagaagccagccctcagttcacctcaggaaacaggctacacagacggccgtcccagtaacaatgcagcagtgagatggccctgtttattttatcagaatggcactcccttaatttttcagttctctttattgatgtcctttttcatgtacaggtctattagattctacttcctttactgtcctcccaggaattggtgcttgccaactacaataagttgttttgacaacttgtctagctatacaatactctgtttccttccctctacagtctttttggcttcaaatgagtgccttcaaaatatagcagagactatccaaccaaactatgctacaggggggaggagctttctatgtgtaagcaatgtcctgcccaaactacaatctttcatgtgctcatagtcctctttcttttcctatttatttttatggataaatcccccttgctatcttgtctactcctatcttaataaggaatgactgccgtgactacccccatctagctatgccattcaccgccagcacctctgctctcctcgtgtgcttcaagaagaactgattagcactttgcataattaacctgattagcactgtgcataatcaaactgattagcactttgcataattaaaaagaaataataataataacaataataagcactaagtaatatcaaaagctgttagtcccacagccctttggttacctccaagattagttcagtgcagcatattttgcaccttcacattgaaatcttttctttaactcaaaagtcaagaaaataaattaaaatgcttgcaatccacagactcgttatggttttcatatccataccagttaccaaaataatcagtttcttacccatacacatctccctcagtttgggtcttacatattttacccatgttaaaatggagaaaatggggatataaaaccaagtgaatgaaaaatatttagaataacattagaaaacaagatatatgatgcgtatagaagcatagagagagttatatagaactatataaccctcccttgtgttgcttctgggtgacaatgaggcatgtggaaagaactggacaacctatcagaaaaacctggctatgacatttcctggctaagtgatttaactttttggaacctcagttccctcatctgcaaaattaaaataataacaccagttctgctacctcaataactgtaattaaaataataatttaggaaggtgctttgtgaactgcaagacactttacgtacatgaggtattccattctaggtccctaaatctcctatcccccaaattttatttcacaccatggacaatattatacattatgaataataaattttaggctcagtgcagtggctcacacctgtaaccccagcactttgggaggccaaggcaggaagatcacttgaggccaggagttcaagaccagcctgggcaaaacagcaagatccccatctctacaaaattttttttaaaattagcggggtatggtggcatgcacctgtagtttgttttttttttttttaattttttattctcataggttattggggaacaggtggtgtttggttacatgagtaagttctttagtggtgatttgtgagattttggtgcactcatcacttgagcagtatacactgcacacaatttgtagtcttttatccctcacaccctttccccctggtccctaaagtccattgtgtcattcttatgcctttgcatcctcatactcagcaggctgaggcagaaggatcgcttgagcccaacagttcaaggctgcagtaagctaagaaggtgccactacactcctgtctgggcaacagagcaagaccccatctctaaaaaaataagataaaataaaaatttatatttataatgccttaaaattaaaaagttataaagtcctgttgcatgctttgccttatttcttattcagggctgaatgtgactaaaattttgacttggagttaaaactggactctagtaattattgtttccatcacagctctcatttgtgtttctgtggaggttaaaatcaagctgttgctggaaattcacaagagaggagaagaaaatctagtacattactattaatttgggactacaacataagagaattctgcaactctgcttttctccaccctaccatagccaaccatctgttccttaccaacttcgaggcttagttcagttccactttcctccaagaaaccacctatgatacccatagattggaaattctctctttctctctaatgcttccataatattttatctcatgcttccatagtacagtgtactatttattaaatatgtgtatatctatctgatacctttagtagattagctgctcctaaacagaactatgctgcctattcatttttgccccagaaatagctgccacaataaataatgtagtggtgaacactcaacacctttgttacagttggcttaaggaaactggatggtaaactatttttttcactaggcatttactatataattgctaaatgcaagcctgagaaattgtttcaataactatatgctagagaatacaaaggtgtttgacatacccataactacttaatcaaccattaaaaccaaccattcatttattaaaaaatagatagaagtgctagtaaatactaggcattgtgctaaacactgaatacagcattgataaagtttaaaaggaactgttggttcctctcaaggagcttatagtctaggtctctattaagaagttcatattagagaggctggagtggagtagtgtggaaaggaaaccttaaaatagcaagatacacatcatggagccactaagcctctatcaacctacgggaaaggaacccaaataagcagtcagtgttcttgggcaaatcattcattttacaattcatttaattcaagaaggaaaatgctgctgtggagattattcaagtccaaatgttcctggtgaaggtgcttccagtaattctgggaaagaagccaatcccttagttttatatgtaaatatttttaaaacacacacatatatataagcacaaaagaaaggtcaggaagacgtaagtcttttaaaaatctattttaataattttttctataactgtccacaaaagtttgggctttttttgtagccttacattttcttttacacaatacacctgcttttttttctaaactaaatatttcttccatctaatgactctctttattagacagcatctaatttgcatacatttacatacaatttaactgctagcttgtgagaacaaagaaatggctctgtattgtactgaaggacaatactcagtaaaggaaggtataaaaaccaaccagcttggtgactgtgtaagctctttgtttcagatataccaggctccctctttctcttttaacataccatttaaaaggggcaaaaattatttcatcaaacaatgaaaaaaagaaacagccctactttgtttaactgtccatttcctctccagtttggttactacaattcaggggtccaagttccctgaatctactacaatttcctctattatatttgatagatttaatccctttatctatttttgtttcgtgtctcattcctaaaacaacctgggattccactgcgataaagctctgttctgatgctaatttgtgctgccatcggccttgttcccaagcagacagggtagaatatggcatcatgctctccagtgaacaatgcatacacttacccttaacaggttaatagattttattgagactttgggtctttatcatatgaaccagctcttcaaaaagaaatggttttcagcatctactggagagatgatggaaaagaagacttgaatatagggagggaaatggtaaaatagatgttaggggtaaaagagtacttgagtcaaatgtttctccactcagcaatgctatccctttgtaagtctccaaacctgcatgactcttggagaattaaaaaaaaaaaaaaaaaaaagaactgaaaaccagggacccttgactctcctttgaaagtaaattcacatactctgtgatacggggtgagtcactatgactcttctctctgtagctctcatccttgacacatggaaaaggagattatgtaaagcaatcttgaagaggtttgttcagtgttttgtaaatattaacaattattgaaaacacacaaaataactaataaagctgcggtcacaaccaactgaaaataaacactaggctcattcaagtttctgaaatgccatgtctaaaataacacacaaaaaagaaatatggtacacaaaaatgcttcaagattataacaagctatacaaatgtaaagcaggacataagggcaaactgaaaattataaagccaggtacgaattggcaccaaagcctcgatggaattatcatccgtatctgggtgctgcaaatggtcatgggagatgcatttccttggacatatatttaacattattaatttggcctgttttctgcatctgataatgcaaatttacaattttagtgacccaaagaagtgtgaacttgtcagtgataagtgaagaaattctaccactctgtggggctgcagaatgcccacataatttggaacctttagcagccaaacagattgcacaatctcaactagcgatcttgaagcatgtctgattttccacctggtgagaagaagcctgagttatggggactgtatgagtgctggagtgctggcataaaccaactctgccaacttcttaacccataaacaattatgaataatgatccaaacagcatttaaaagaaataattagacactgcactttaaaaaaaaaccctcagtagtgactaaaatctagtcactggaatgagtagtcaggaagttgttgatcctccgaaaaccacggcttagttctaaaaacagccttaaattgcagagaacctgaccctgaccttcaaatcccttgctccatgaggaaatgagactaccgcctcctgagtgctatagtgtctgttctttcagagattgtcagtaagttttacaatacaattcctgtttctgaggctcattagatcttccttatttatacggatttgaggcagtacttgcttttgtgtgatagaattatctgttggtatccgacgtcagacctattttctacactctaacatattaaattctgccttgtttgtttctaaagcacctcttaataccaactcagccaacatcacctgtgctggaggtggttaagatccacctccccaatgcatgttaccacggtgacaaagtagtgacctaatttacacacacctgctgggttaattgggccaaaatgaaagatgatatatatgctcaaaatccaaaactgatttttttcctcaaaattaaatatttgattttttaaaaattagcagtttctaaagctaagtaacatactccaggtgtgcatttgccagttaatgtaccctgaatgtttcatgacacttgaggagcaaaatatattgagtgatgaatacaaatcttttatgtattttctgtgtgcaatgattagtatgagtaagtggtctcgatcactgaatacatggggtgtgcttgaagggtcaggccactgccttaaagcaaacagagacatctcaactgtgccaagttagcacgcagagtccgggccgcctttgaaagtgcaagtttgctttggagaaagctgttctccatagcctgaggctgcctgcaacatctcttagacaaaaacatcacttacctctgcttgacctcttcccacctctttgtattcattcttcccagaccactgagagtttttctttgaaccatattaagttttatgccaagaactgatgaggatatgaacaaatagatactttcagagactgctgggacagacacagcaatgtgtaaatggtatagctaaatgtatcaaaacccttaaaatacatatatctttgattcaattattacacttaagtatttacctgatgacataatcagggatgtttataaaaaagattgtcacaataatattcattgtaattcatgtttactggagaaaaattggaagcaacttacatgtccaaaaattagagatcagctaggtaaattataacacatccattgtatggaatactatataatcaattaaaaaaatcatgtcacaaaaaatattgacagaaacaaatattcataatatattgctagttgaaaaatcagaatcataaccttgcataatcctatgttgttgcatgcacacatacatatacacaccaaaatattaagaataactttttctttaagtggtaatagtaatatcaatggtgattttcttgtcttctttctgtctttttgtgttttccaaatagttttacactgatagcgtactacttttagaaaggaaatataaatatgatattaaaaataaaatgaagagtaggaaaaaagttaaatgacatttcctaatccctctctcctacttagatttcacatttcacctatatttacttctctccttgtcaactacagatgtaaatataatagatgttaaactggtcaatgttcttttattactgaatattcaacttttctagctgaatggatctttcacttatttacaaatcttacaaagatgtcagtcagcacaactcttagaaagagtctccaatctgctttttatgcttacaaaaaccatgtgaaataattgccttttaataacaatgattacttgaagtgaacttttcaaggtacaaataaatctatttatcaccaagctattgtgtcccgcttaaattacaactttcacattttgatttcatttgtacagatatagggtcttactgataagtaagtgcttttgttaagtaaataaaattagtattaccatatgaactggatttgctgttaaaagtatctcactaggggtttgatttattctatgatggtttcactgatttaatcattgcttaaattagcaaaatataattatatatttttataaagaagatgttttcttgggattttcctatgtcaccaagaatagacatcagggattgataagtaataagaaatgtcaattttaaaattacatttcttggtctaatatgctttctttttaccttagtgatgatcgctgccttcctaaaaagttcataaagcttcagaaaaatctaaaattcatgaaatttcaaagaattaaaaaaattggtgcttttatttcaagtgataaaattaaactttattttcattctcaaaaataagttttggttgaatcaaagatgtaaatattaagagactaaatcataaatgtgctagaagaaaatctgagtaatttttctggtgtaagaagttttctaagccataaaggaaattattgaaaaaatgaaactacataaaaaatttttctacatatacaaaactcaaaaagcaaattaataaccaagaaatatgtctaacacatactacagaaaatttattttccataatatacaaagaggctatacaaaccaataaaatatttttaaaaactcaatagaaaaatacagaaaagtattatagccaattcacaaaaaagtaaacaaaaatgtaaatggccagtgaaattttaatatgttgtttaatctaactcctgagtaaagaaatgtaaatcaaaacaatggtgaaatatcattttcacttttctgattaggaaaaatttgctaaagcccagtactgatgaggctgtgagaaagcaggaattctcatataatgttgttacatgtgtgtgtcagaaaaatgtttttgaaggaaaatttttaacaggcatcaaaattttaattatataaacatatctaagaaagtatgctatgtggatattaaaataaaaacaaggatatatttagaaagctgttttgtaatatttttaaacagcgaagaaactgtaaataaccaaatttccataaataggcagtggttaaatacattttgtgacatccataaaatggaaatattaagtagctgtttaaaaagaggaaaaggtaaaatataatataccaaaatataaacactataaaatttctagaatatataaaatctctaagacatggcattaagaaaaaagtacaaatgtatttgaacagtatgattccctttctgtttttaaattaaaggtatatagacacatttctctacgcaagtacagttgaaactttttatctctggtgaatagtgctatcagtcggtaaagacatacttttcactttatatccttgtgtaccattcaaattttttaaccctgtgagcacattttaaaaatacaaatagcagaaagattgttcagtgtaatggtaaatggtgaaaggtatatacatggaagtaaagagtactgcactgttaaatttctcattctagacttctctagtcccacagtaaatcattcaacttcactgggatttcatttcctcatttgtaaaataataattaaattagctcaaagaataatctgtaagttaccttatagttctaacagtacatattttcatgtgttaataatccaatacagaatggtggaaaaatatgtttgagacttaaatatcaattttgagcacctgtacctactacaataaacaaatctctacttggtattttgtatgtagactgtagccatgtctttatgacaaaaacaaacaataaatgtactgaaaattttggctcattgaataaactaaatattatcttaaagaccatccccatgcacaagtacctctgggtctcaatggtttagttctgccaaggtgttgaaacaagactatcaaacaaaactgatcagaaatgtattacttacatacttcactgccaacttaaagccacaaccacgaagctgacttgttgaatctaaccttgattaatgctctcatatatacaaaataatgtcaaaatatcaacattcatttataattcaggtatatattgccacaagcactcttaatatgtttttgatattggataacctgatagtgcatgctcacaagttaaaatagtaatatccatcttgtttttaatttgtggtacttgaggcttcagtataataatggccttcttccattgtgacttaatattcctatcatttggttatatatttttaaagcaaaaatctctcgatcgttattcagatgacaaattatatggtcatatctgttagatacagcaaagtctgcactgtggtatttctaagaaagcaagtagttcattccttcatttctgggttccattgtgataaggacagaaccatgggaatttccttggtaagattcaaggggtataactggtaagaatggtgtgttctttttttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtgtcgatctcctgacctcgtgatccgcccgcctcggcctcccaaagtgctgggattacaggcgtgagccaccgcgcccggccggtgtgttcttaatcacacaccataggtacatttgtaaattaggatgtggctaaagcctactaaaaagtatattgatagatttttagtatctgtagtgaaaaaagttagattctcacatctaaaaacctcacaatttctgaaactgtcatctgactgtgtttttcaaatgttcacagtagacggcctacttccttgtgcattttttcacatagtatcagcctgggtcatggtaatactgttatctggtataacatcgagcaatgggaaaataatgtggtgaatgaacagttgattagacacattaaactaaggaaaattcaatcaaagatcatcagtttcaatgatttactaccatacatctttgcttagctatgaataaaacattttgaatgaagcttttggtgaaatttctgtttcaagatgaaagtagaaatgagaaaaatagacatcctgtgctcacctcaaatggagagataactatatattccgaaaaagttctatgttaaatcttgggctcctatgagactaataaaaaaaaataagtttaacccttcattttcagtttcagtcttgatatacagaaaaggaggaaaagggctgatactactacttgaagaagtgatttgcgaaagggagaaatgatggctcaaaaacccctgtagctcctctaacaaaccctggtaccagagcagacaatgaaattgctagggagagctaagagtagcaatgaattcaatccctccctttgtggccaaacttagttctgctttcagaaataacaaaatttcaggagatatggttaaaatttataggatatggcaaagtttaaggagatttggttaagcatttttaatccattcccaaatgcttactatggctatatttagtaccaggataaagaggaggataaactggttgcccctgaagaagcagacctcccaactgtacattgttaatagttgacagaacactcctcccttgccacagctactctaatacacacaaaccttggatgcacaactctgtgtaacctgtaatgatttagagattgcatttcttgtacacaagatcttcccttgaatggctccttcacgtcattcaagtcttataattcaaactttatttcctcagaaaggacacctacaccctgcctccggattaccagccattcttcatcctttttgttgtagttgtatgttaatttgtttagtgtctctctctcggtcttctagttcagagctctgtctctagtgcctgagatcaactgaattgtaattatttactcatgatagaagagtaatcaacaccagaaagaaatctgctatctaacaaaataatagtttcttcttttttttttttcggcaacagatacaagacaaactaaaacaggttaattcaattaatgtgttttgggtgcaaatcccagtttggtattatcaaaggcatattttcacatttaactatattatcatttcagggattacttaattttcattttcatttctatttcatcctttcttttctggcagggaagcctaagctcatttgtaaaatttttctgtcctctgagcatacaattatattttatccagaacagaagtgcaccaaaagagctgaaagttaaaagaaatgttcagtagatgagacctataatactggttctgattaattaatataatcactctattaattatctatgtttaaaattcaaatttatctatgttggcttattgagcattcttaaagaaaacatacttgtaatatcctacaaccatgaggtggaaagggtcagcaaatgcttccaattatatcccaattattttaggaatggtttacttcaccttctgctccctctacccactcaccctaatagtggtctgctccttacttaaaaggggaaaacacaaagatttcctgcagtttgagaatcaacttgggagaaatagaaaaacaggtgtctgagttgagcagagctgagtttagtcctgtgtcagccatttactagctatttaaagttagaaattaactttctgagccttgggcttgctcttttaatctagacctggatattcatgattccagtgttcatttaatggatgtgtatttgtacgtatggccatatccatagttctctaataaagacctggccgatgctaagcagagaaattagacggattgtgatctcaacatgcagtcatccagcacaatacttttgtccatctacgacactaaatttcaattgtatacttggcttatattatctggagatcattacgaaaaacattttctgcaactcttgatttacttaggtcacaagtaaagttatgtgaaagtaccatggactataagagtatatttggcatctcaacacacatggattgacagaaaagttggatgataccaatgtcagtttttagttctgcagtccatctgcagagttagtgactgttggttacctattctatgcctcaaccttgtcatctataatgagaagtttcagtagtttaaaaaagtatgacagaaaatgattcataattccatgaaattcataaaaaataccaaggtgctaaggctacaagtattctaaaaacagaggacaggataaactttgtcaaataccgaggggaaaaataattaacatgttagcatatgtcttagtctgtttcctgtcgcctataacggaatacttgtaactcagcaatttataagaaaggaaatttatctcttatagttggaggctgggaagtccaaggttgagggagcaaaactggtgaaagccttcttgccgtgacaacactctagaatcctgagacaacgtaggacatcacatggcaagggggcagactgtgctagcgcaggtctctctttatgtttctataaagctaccagtcccattcccatgataacccagtaattcattaacccaagaaaagactcatccattcatgggccctcatgacccacctcttaaaggccccagctctcaatactgccacactggggcttaactttcaacatgagttttggaggggacaaaaattcaaaccatagcagtgtgtaaataagtcttccatagatatttactaccaaaaaataacattactctctatagtaggttgaatgttgactagagtccccaaaatttcatgttcacctggaacctcagaatgtaacattcctgggagatacggtccttgcagatgcaactaattaagaaccatgagataaaatcatcctggatttaaggtgggccctaaatccaataactgatatgcttttaataggaggagaggacacagagggacacatacagaggggaaggtgctgtaaagatgaaggcagagtttgacgtcatagtgccaaaagccaaagaataaatgggaccatcagaagctggaagagccagggaaagattttcactgtgagccttcagagggaatgtggccctgctgcattttgatttctgatttctagcctccagaactgtgagagaataaatttctgtcgtttttaagtcacccagtttatcataatttactacagcagccataggtaactagtacactttccctgtactctctaggactaaaacagaggaagacatacagaagttttataagtgtaaatagtgatctcaaagcccccaattgataggagcacataaggacaaataaaaatcaatgagaaaacttaagaggttgcagtgatggtttctggtagtagtaagcctcaaacgaaatgtactgccctctatttggagctgttccctcttaaatcaaatgcagatgccctccaaaagtgatgcaacatcttctgatccaatcctttcaagcaagccagaaactgatcttaacgtggaattggtcattaaaaaaaaaaaaagaaagaaagaaagaaaagaaaattaataggctgggtgcagtggctcacgcctgtaaatccagcactttgggaggctgaggcaggaggactgctggagcccaggagtttgagaccagcatgggcaacatagtgagacccccatttctacaaaaaaaaaatttaaacatctgctgagcatggtggtgcacacctgtagtcccagctactgggaagctgagatgggaggactgcctgggaggttgagactgcagtgagccatgatcatgccactgcactccagcctgggtgacaaagtgaggcctttatatttttaaaaatccaagtggtatattgatgtaaataattaatatcttacaatgatatatgatcaatagcaaaagtatactggaaattacttaattggacataaatcagttctcaaataaaaaattatttatgttcctgaagaacttgattcagagagtaaatatacctatttttcatcaatggaaatttaaatataatatcagtaacaaatttacatagaggaaaatcaattttattttggtctagagtatatactatcatgagacttggcaaagaccctaataagtatacagatcacggcttgaggcatcagatcagcatgattaaagattatgtttgaattgtctcctgatatacaaaattaaccatttcttaagtaatactaaactcagctatcctatttgctacacaaatttaagccattatagaagcaacattttagttaattttcaatatctctatttactttctgtgcatatttttatgtacttacacttaaatcttaactttcagatagtcctaccttatttaatttttttacctttaaaaagtcataacctgtggtataatcttcttttgatatgcttaacaaaatataacaatgaaatgtagtgtaaaaagtttaaatacttttaaaaatatatttttaaatagcttaagaaatatattttgaaaatatattttacacaaatatgaatgtgtgaaatatctattcacacatttttaccctaatgcacagaaatcctttcgtttagaaaaatagaaattgtattcataatttcccttaaagactctcaaaaccataaggatgatacatgcagatattaactattagatattacatgtttaaagcaggaaagaatgaaaacgttaacttcctagaaaactgcaaatatcaaattctttttcttttggttttttaacttaagagttgtgcattaattactattagtaattaattagtcaccaaatattctaaaggtgggaacaaaaggttcttacaactcagagatgaatctatttatatttgactttttttctcagacactggtctcctaacactttataagttcaataagatgtgaatatagataattagggtattcctatataatcaggtagaaagtgaatacatttgtgtcagtagctacaataatttgcattaaatgaatgagtgaataaaaaataaatcataaaaaggcactgtttgggattggtataaaacatttacttttaatacataaattattaatattaagcagttatattacaaatgacagagaactgttattgaggtgcaaataactcaacagtaaatattagccatgactaggttatagggtgtttctggaattcttgcttctttttagattagtataatgctctactcaaggtgtagagtaaatctgcaataactagagcaaataataagtggtagaaaaaaaaggatctatacagaagaccatattttattacatggtttcagaatagcattatgattatgatgactaatgagaggaggaagaagaagagatgtttttaattttaaagtgctttggtatgttgtcatctctaatttacagatgaggaaactgagcgtaaaagcacacgaagagctgcctatatctcatagccaataagtgataacagagaaacttaaatccctctcttctatttctaaaccctgtactctttctactctattatattgtctctttattccctgaaaccagagatatgtattaacagtaaaattcttaaatactgcagttaaaatagaaattcctccaagccagtgttgaaagcaccacagtatttataaaaataaaaatcagcttcttaaaaaattattgttcttaaataaatttaaaaagaacaaaatcttctttgagttcccctatattcctcatacagaatcttggcagtgataatctgcaccgtaaactgtgaagtaaattgtgtatgtgaatgaaaacaataagaacctacagaaacacatgggagatctaactcggataggatggtctgagtagcgtagggacatggatgaagctagaaaccatcattctgagcaaactgtcacaaggacagaaaaccaaataccgcatgttctcactcataggtgggaattgaacaatgagaacacttggacacagggtggggaacatcacacaccgggcctgtcctggggtggggagacgggggagggattgcattaggagatgtacctaatgtaaatgacaagttaaggggtgcagcacaccaacatggcacatgtatacatatgtaacaaacctgcacattgtgcacatgtaccctagaacttaaagtataataaaaaaggaagaaaaataataataatattatcacatttcacagagtttacagtctggcggaggagaaaaacattaaactaataattatataaccacttatttatttacacctgaggtctattcgttatctttgactatgccacataattccaatctgaactcacttgtatgcattacttagcttggcgatgcttgatgttctcctttctatttccttatgtcctatgcttcatgtttttttcaaggcccagcttaagttcagcctcttcccagcagttcacagagatctctgcctccactaaatatctttagcacttaatgattctttttcaacaatggcaaatgggtttcctattacatgaaacttccaacaattggtatggctgtcaaagtactgtcttcagagggactctgaggtcaagttttggtgtagtgacagagacagccataatggattagtgttgtttcatggacagtgaaggggagacaggggatgctgaatttagaacattgacttcacaaatagactgcctaacttaaaaaaaatgtttgtagcatttattttacaccaaatccaggtctaagcatgcaatttgacactgagagtgccttgttttattttttaaaaaacctgtatcatgtctcctcaagtatcataagattcttgcatgtaatacttctctatgctcacagcatgtagtcatgccttgaaacataggcatttgctgatgacaataaattaccattttagaattcactcttattactattgtgaactccatttatgtcatagcttctctcaaaatattatcaatattgaacccattttagaaaaactttgtaacataagctataaaatgtaagtaaatatattgtctttaccatgaccagattcaaattcaacattaggatattgataacacttaacgattaaatatatacctgccaaataataaaatgaaacaaagagaagataactacttcttaaatgagtttaaacattttttaaaaatccagccaggcgtggtggctcatgcctgtaatcctagcactttgggaggcccaggcaggtggattgcctgagctcaggagtttgagaccagcccgggcaacatggtgaaaccccgtctctactaaaatacaaaaaactagacgggtgtggtggcgggcacctgtagtcccagctactcggaaggctgaggcaggagaattgtttgaacccaggaagtggaggttgcagtgagccgtgatcgcgcctctgcactccagcctgggcgacagagcgagactccatctccaaaaaaaaaaaatatccaaatctgtgtatttcaaaatatattttacatacttattatgtcctaaaatttgtatctctcttttagtatacttcattttcctgcacatagtaagtgttgaagaaatccacagtggttagtttagaccttattttagagagatagctccattttacattccgtcttgctaaggaagtgtattcatcatattccataacagctcacagtttgttatacattaactgcttattctctgtgccaataagactgtgctggaacagcaaataaatttggtgcattcatttaaatgattctgcaaaccacaggctacccagttgtctaatgataagagagccccaaagccacctgatcaccattatactcccttatttttttggatttgcatggtcagtactgtcaggatctgaatacagagaagaatgagaagtaaaagtatacctcagacctaatcatgaaaagggattttattaatttcggcaccagtgatgatgtggctaggttggaaggggaatgggatataagatctggagtgctttatctgctccaagaccaatgctggttttggcacttctctcactctagtgagttgcaaaaaaacaagcaggtgctagcaatctgagagaccacatgccagctacagctgcttcaaactgattcaattacatctgcctgaatagtcccaggacatcaaactagttgaagagatccataggttgcaaggagactttgtctatcctgatggacaactgtctctgagataatgacctgcaaatttccaggttgtgatataaagtgatcattccatcaccaggcataagagaaaagatgggggaatgcgatgttttattcactttaaaattaaaaattggttgtagaaagcacaaaggcctctttgaatttaaatctgaaagtcactgaggccttatggataccttgaaacagcccaattttgtgagaacatttcccaaatcattgggtacagcacatttacagaacatgctcttgggatccggacttcgctccaaaccttgtttgtacaaaaaggggccaagcagctgggaaattctggagtggagtgtgtcctcattagttcccatctgccaccagaactcagctcatggcaagtttggctaagtcctggtgtactcaggtccaaatgtgggtcagttttaattacactatacagaattcagtgtgcagttttaaaatccttattatacagcacagaggaatgggcagctctccagctaatcaattttttaaaagtacatatataaaaattttaaaccaggctagacagacagtgggtggaaaaaaatctttaaatgagtacaagggttacttaagagaattattagtgaaattgggtcatgaacaagttctgctttaaagcttcaaagtgagaaacaaactgttttcattggtaagttggaaaacttatgtaaggtacacaatgtgccttgctctttagtgtgaataacaataagcctgtggccagggtacacaacacacctacaagtgaactggctttcatgtaagcagaaatgttcccaattttgtgactcttcactccatccccttttgatgtttatcacttatggcaaagactggataaaagaaaaaaatcacaagctacctggtaaatagtgaaaaaaaaaagatgaggaaggggagggagtgagagaaaaggagagtagaaagcacaagtgctgagtagcagactctgggcatgacttgtctctcagtgccatccatacaaatgggggccagaatcaacgcttgcagtctatgttcagattccatcctgtccaaaagctttatcaggttcaggagcgctaaaacactaagccttcgaagacaattgtcagtaaaaaattcaggagtaaacacgtcggcagtcagtgattaggcatttatgcaccatttttgatagataaaatgtcccttgacacaagtcctaatgacaacaacaacaacaacaacaaaacacaaaaaccttaaatgttcaaagtatctttgggcttttgactgagtttttatcaggtttatccatttaaaagcagcacgggatgctaggttcaaataccagcattgaatatttacaagctatatgactttggacaaattgcttatcctctctgacattttgttttctcacctgcaaaatgggagaaataacatcttcctcacagggctgttgcaaggatcataaaacatatatgcatacatatattggatattacatatctatatatacatacatgcatatatatacatatacactcacataaatgtgcatatgtatatatatagcatctggaacatgaaagtcactcaataaatgttaactatcattaacccagttatgatgaactaaattttgttccccaacccctccaaaaaaaaacatgtgttggagttctaaccccaagtacttccaaatgtgatcttacttggacataggtctctaaagaggtaatcgagttaaaataatgcaattagggtgggcctgaattcaatatgactgatgtccttataaaagcagagaaatctggggacagagacagatacttacagagggaagacagaggaagacatatggagagacataggaaggagatggccatctatatgtcaaggagaaaggctggaacagatccttccctcacagccctgagaagaaccaacctggctaataaaccttgatttcagacttctgaactgtgagaaaacaaatgtctgtttaagccaccaagtttgtggtcctttgtaatattcccaactaaataaaaattccattaatcatcaatatttaccttgattcatcatggtcgaaactatacatttgatattaggcaggtctgtattacctctggtgagtaataatcaattctatatatattatctagtgatgttttcattattttaaaagaatccttttctgattgctgtacaagaagatactgctgcaatataaacagcctggcagaggaaaatggtttactataattaagatcatctagttattattaaagataattaagggaaaatcatacatataaattcataaatccacttttctactgttgagtttgcatagaaggaaatcagaaaatcttaccacactaatttccttctcaagaaaaaataaaaccttacacagcgatttatgcactgacaactatgctcactaaacctgaggctgcttagattaccaacaggaccacttttaagtcattttgatgcatatgaaagtaactcatcaagcatgggttcttcatcctttgcaagagactgcttttaaaggtatctgactttcagaagagggatgagagttgtctgggttgtgtcaacacgctttctattgcaagacatacctccataatcaacagacattgaagtgaatgtgagcatccccatcttaagtttttctttaaacagccctagccttctatagaaatgtggcatgtatagttagaaattatgagtctaattatgttgaactgagataagcaacagatatcacaagagccataattggaccaaagttaactttcttaatgtatgtgtcccacacttccttgaaattcctatactactgattataaaaatttttatattttgtcaagagaagagaggaaaaaataatacacagagactactatgcaataatacataggtggtagtggtgcacaaaataaagtattttgtatacctaatttactttaatccacatatccaccattaaaaaggtaggtgttgttaccaccatactatacataggaaagcttgaggcttagtaagctctgccaacctcgatgaggtcgcacagctactgaataatggagctagacttttggtaaaggtcagtgggagggaatccaaagctcctaaattcaaactcaagcatgagatttacaatccagatatcctaagtgcatcactgggttccaagatggtgatttatttaaggaattcacaggcgtgttgaaagcatttgaactcacataagcagtagatgtgttcttgctaaacctaactcaacttattctccttatgaggaaatcaatgctattcacaaacacaacctaaaaggctttattcaatttaaatgaaattaatcttattataagaacacatgaaaatggaattaccatacaatctagcaattccacttctgggtatatactcaaaagcattgaaagcaggttctcagagagatagttgtacacctatattcatagccaaattgttcataataattaaaacatggaagcaatccaagtgtccactgatgagtgaatggacaggcaaaatgtggtatatacatgcaattaattattattcagccataaaaacaaggaaatcctgacatgtactaccacatggatgaatgctgaggacattacgctaagtgaaataagccaaacacgagaagagaaatactatatgattccacttatataactacatagagaagtcaaaatgacagagacagacactaaaatggtggctgccagaggctgggggtgggagtgcagagggaaatgggaagttatattttaatgggtatagtattttagttttacaacatgaaagtgttatatagagatgtattgtggtgatggctgtgcaagcatcataaatgtatttaataccattgaactgtataccaaaaaatagttaagatagtaaacttcatgttgtgtgtatttttcccaaatacaaaaatttggggaaaataataaaaatatcacatgaaggtcttttagattcagtacattgcttcatgatttttataatatcttctaaggccagggaagcagaggtaactttgtatagaacctctgagtacaatctatgtgataatgcccaaccaggatccctgctcccaggcaattagatgttcttttttcagagtctaaactgcagtagtggtgatggcgagggaactggtagtgatagaaatgacagtagcatagctaagatttcttcagtacttgctatgtgccaaccagtggaccaagaatcttacatgtagtgtgttattaactctcagacaacagatactattattttcccagttttacaaatgagtaaacaagggaacagaaacattaggtaacttgattgagaccatactaataataagtggtgaagtcaaaaagaactctattgatatatctttgtctctcactagcctgtatcctcttgagaacaaagattttgttgtattcatctagcctagcacaatttctagcaaacagcagacatccattcaccatgcagaataaaaggaaatgaggaaaggagagagggaaagaagggggaaaaaagaaattatatctagtcatgctatgttcttaataaatgtggattttctttctttatttccttaaccctgaaatcgcaggggaacctgcaataatgctcaggaatcctagggcataggaattcctccctctttgagattccaggctaattcctgacacaggaccctcaaaaagctgctaatatctgtctagtttaatgattaatattctagcaaatatatattcttggctcatctcctaatttctaatattgagactaacagagagatagagttcaatctaccacactaagattcactggaaaaaaccgatgtctttgatattggcctcttgcacactggtgtgaactgaggtaaaagaaaaactgttcccagaggaaaggtagttccatgcctaaaagtacatgtgtcataaaccagtggtactaaaatttgagaagcctaaacaaaaggttttaatgcaatagataactggcttattatgtaaactgtgccaatcttatgtgacgggcttatgccacacaaaacggaacattagaatgatctatctaaagcaagtcttaactgttctattttgactctactcttgcttggctttacctctatttataattaaaatttagtgagtcatagagaccataattataaacatgtatacagtaaacacagggtccattacttttgcttagaaaaataattacagattttttaatattctgatcttaactgacccaaaggaattaaacacacattttatttttgtgttttagtgagatagagatagggagggagaagcataagccagtgctcaggaaagacgaggcattaaccatataacatagatttgtttatttatgggctgcaaagtatttccaaggtgacaagtaacttagccattaatgcctcagccttatgtgtataatgggaataacatacagacttcttgtaataagtaaaagttagtttaaagcacattgcaaatagtgttatttcaattattcattaaaatagtcaaaaaggatcagttcttatacattaatttctcattttaaggacagaatttatcagtattctcatatctatgtaactggcagtatgagaactaaaggccatcaagacttatctaaactgtataacaagtaataagattttaggacacaatccctctatttctaatacaactccagaaatgttttattcataaatgcattcattcaacatttactgatcaactactatgtacaaggcattgtataagaggctgtggcaatcctctacttacctttgtactgtgtttcctacttccaaagaggttaaattaataccaaagtgatttgttaaaaatacaaaaaaggattccaaatgggccaataaaaggaaaagacacaccaactctaagaccagatttatgttactaaataccgacggaaactcctcagcatttaaaagaatacattaaggagagtaatgcaagtcatttggatgttttcaatatgagaaatttgagcctactgaataaattaattaaatatctttaatattgagttgcagctttttattgcatttatagaactttacctattagtaaaatatacaatctataatagcttgtctatatcaaaaatatagatatctgtcagaaaacatacaaagccacaactaaaatacatttaatatcattaccagtaacatttgtgaaaaaataccaagcatctagcatttgttaaattaaagaataatattccataaaatctacatctggattttagcccctcttttagaattactatttaatcttcactttttttctctctcacttctaccccaacagcaacagaaacacatgcacaaattaaggaattatcttacaatatacccttaaattttctgaatatgccccatgtgtccactaatagccaaatgctttcaaatctgttcagctaaatggatcaataactacatccagcctcacatagtggggctgccaacacggtgaaattgagccaaacacaaaatgtctctaccaggacaaaaattattatcaacccagttatctgaagagatctactctcccagatattctttcgagaagttggcatacacattatctagggcagtcaacagctactaaaaaaaaaatatttgagtcataaaacagaggatttaaagaaaatattcagaagctaaaaccagtgagttttagaataaaccaatgtaacagttcaaggtctacatcaagtaagaatctttcagagtcagagtacacaaaacacgtaagagcacaagcacactgctaacaagcttctctgtgctctcactcatatgacacagctgcaagcaacaattgagcaggtgcaaccaagcttttgagaattcctgcctgttgcccaggaaccacaacactgcatggttgagattttaaacaggtgcaaacatttttttttcccattcgtctagtgcttgagacagtggagcagacagtacatctgcaaccactccatacctaaagcaaccatcacagaaaataaactcaaaagcagcaaaataaaaaaaagtttaaataaaacaataatggcaaaactgtggttttgcaatggtctgaccccacatcaccgttcactttaatagtacaattccataaaataatctcttcaccagatgaatgctttgtaattaaaattatttgccttatcaaatcttagaaatgtttacttgattcttacaatagaataaaataaaatatatgtataaaatgtactatcctttgaagctgtcattatctgtaagtaatcaagaattaacatttttacattatgaaatctataagcaattttaatacataaaaatattataacttgttagttaatatatagatttacatagttataggtaattcatatacatacctgtgcagctatggggcacaaacttgcaattcatcaattctgaaatgtaaaagaaatatataagtaaaaattaatttactaagttggaaccagtatttatgttgcaacaattcctgcagagaagtaggaaaagtttcagtgcataaagaggtaaattattttttatcaatattttccctataggatatttcatatatctgaaaatatatacacacacacacacacacacacacacacacacacacagagtcccttagcagtgtatcataagcactagcaagggactctgactcaccatggcctctgaaactcaaatgctttcactagaggacgaggcaaacactttaaaatgatttttttttttggtattcttccaagactattgccttcctaatacaaatatgactgctgctctctaaaatgaaactactcagattcatctgcactcagtttggatagaatgttgttaaggaagaaaggtgcttttgtagagcagtccacaaaaaaatgcatgaataaatgaaagtaaactttgaatgttcgttaactttgagttacaacagcaaatagaaatgaaattgattgctacaagaaggaatgctaacaccacgtcggatataatgcaaaatgcctcaactcaacacactttgacaaaactgccagcgaagtaggtattgatacagaagactatgtaagtccacattaaacaaaagtagcagtttacaattagacctgaaaaacatttggatttaggtggaaactgtattgcaacatacagcctgggaactactggtactcttaaaaatatttcctagttctagccaggagtggtggctcacgcctgtaatcccagcactatgggaggctgaggtgggctgatcacctgaggtcaggagttcgagactagcccgagattacgctattgcactccagcctgggtgacaagagagaggctccatctcaaaaaaaaaaaaaattctttttgaaagcaaacggacatgtttaatttatatagttcttctgagcacagtcgattacagcaacacattatagtcagtaagtccactttataatactgcttaaaagtatatagaggtaataattttgatgatggctcaataaaacaacatcttcgtatattctgatgggaatgtggattacaaaagactttctagaaacccactgagtactatgtatcaagaacccaaagttcaatatttttactcagtaattttagtcccaggaatcaaatgtaatagaaaaccaacagaaatttatgtaaaaaagataatttttatgacagtaaaaaactataagcaacctaaatatctaatagaaaaataattaaataaagcatagcacatctatataaaggaatatttggcaaaatttaacaaggtactttaaagaatattttaaattttacggaaaaatgcaaatttatagtattatgatgctaaaatattatataaacatgtagactaccaattacatggacagtatgaaattatgtgaataagaaaaaacaaagaacaaaacaaagaattaagagtgattatatctggataataagactttggatgattttaattttttctttttactttcatatatagttaattatctacaataagcatgacttttataataggaaaaaataatagtaggtagggtaggggtaaaaggaaaaagttataaaatgctatattgaattcataaatgtaaccttcctaagagaaataaattaattcagtcacaaataaaacccagtaactgtgcctacagtgagaaacaccctcactgcttcctcaaaggggcatagccagggtcttttttatcccagtgctttggaatctacacaagtaattcaataacacatttttaaatcatcttagtaaaacttctttacttattatgcagagtgaaatgatggcaagaataatttaggacttcaaatctcttcaacctagcacagcctaacttattcactaattcaatcacattcagtgagcatctactgcctgcatggtgctgtgtttggcactgcaacgtgctaacagataaattaggacacaccttaccctcattgagctaacaatttaaaaacactaaaaaatgtttagacacagctcacatgaagaagtaaacacaatacagttcaaagcatttgtgacagatttggtacattttaaagcaagaaaacatacactaggtttattttttatatttctgagcaaacacctatctttaggtaacaataaaaagtcatgtgtattagtatcacttattaatgcactagcaaattaagtatttaagttttttccttatgtgatctattttttgttaatggacagttacataataggagattaagtatgaaggaatagtgacccaatctggaatgcagatgtgtaagattgtctcagtttatctgaggccacataaaacacatgcacaattattaacaggctgcagttatttattggaaaccaaagcaaataagttagttactggttaatcctgctaaaagacactgttatgacaacaccaccagggaaagaaaagaagatagagcaaaccacttttgttatgcagataaaatgattcagcatagagattctctcaatagcagttcagtttcctgctggcctgtaaacataatcagcaatgcccttctgaggccagtgctgcaggattattccaatgtgaggtcaatggggtcaatctgtgtgaagtggtgacaaacactaagagaaggtaagaagctatttgtgtgatcagtgatccatagactggggctcagagttctgggaagcagtagagttatgaggtagggtggtagttaagcacttagcttttgccatcaaacaaacctggaatcaaattccagctccccatctttagttctgtgatcctaagcaatttaaattttctgtctgtaaaatggtgatcatgttactcaccctacgaggttgtctatgcaggttatatgttatagccatataaaggaactagcacagtgccagccatgaggtaagcatttgataaaagggaactgttagtactatcatagttgtatgaaaagggaaagcatgtctgtccctttaagctaaggaactaagctaggcaaggagtaaggagataaagaaggcttgttgaagacatcaccctacagtccagcagctcatccaaaagccagtcatgtgcttgatgttcacagaacatttctgaatcaggcaacactgcaacaatagtaatagccacaataacaattctaaccagcacttttaagctccattcctatgactgaaaagaaaggcagtaaagtctaaataatacgtgcagcaacactgccgaacttctctgggtgaaaaatgaaggatcactttccacatttaactgaaacaatcaggaaaaggaaaataaggacaaaatgaatataattactcaactggaattggaccaaggtgccgtgtaatggtcttagcaatcacatgtaggcacttatcacctttttatgtattctaaggagatcctgcagatgaccagagccttatatatgaggtttgcaactctaagtaaaaaaaaacgttagagtcagtttttttcttatggctgggaagacagaaatggatgcatactgatgttgttctagtccttatttgtgttttgatttaaaggacagcacagatcctgagttgttaagtggcgtgtcttcagattcccacacagttcatgtaattgctagagttgtttcactcgcattgggtgaagttactattagcaccattccagatgcagatatactatagagtgtttgtttgtttgtttgtttgtttgaagttctttttacttctaggttggcatagctgtgttctccagtgggataggtccaattctatgttacagaatacagaaatagttcatcttcccttcatactagttgggcctggctagagatgccccttaagccattaataaatctacttgctaattcacttagagtactaacaaggatctcacctgggcctgtgggtacaaccactccatagaagagctctaaacctaaatttaaacaaaaagaatttcacccatgactgaggaagcatccacaggactattttacatgctttacatttaaatttgatattttgagagaagactatgtaattcaaaataattttattttatttaatatgtatttagtccttctggacccactacagagctggatgttgtatcattattatatggttattataaaatgtacactttactcatcaataaagccaattttacttttgaaaattgaggtacctggcttctgtggtttctctcaacagaaagtcctatgaagagtaagaactataaattgtcaagtagacttgaaaaacttatgcttattttgtaaattactgagctaggtctggcccttcattttgaaaagctatctgcctataagaaagaggaagtatgaggagcacagttatctattaatcaacactgtgaactggaaacagataaagtgcaataaagaaggaaaaggaaatcatatggtaaacaccgttaacccaacggcacagttgatctgtctagaccttaggtcagataagctgtaataaagctataaaatccacgaaaaactaaagcttatttacaaaaactgcaaaatttgaattttctataattaatgccacttaaaatgaaagaatttaatatcaaatttcatgtataaacatgataaatttgaactctcaagtagaaacctcatctacaatacactaagtgttaataattctaattgtcctataatccacacttcacagcatattctagagaaaatagctgttgggtttttatgacttaacttaaacttcacaacttttaaaataaaagtttaagagctaatttaaaaatgtatttaagaacctaaaatttagaaaatattaaaaattatattttcaaaatatcctcaacttgaagttatggctattgaaatcaatgatttattctcagaaaatgtgaaaattttactggcctgcttgtatacatccctggggtcttagtttagatattatctcctccagaatctgatatcctgtgtctaatcctgtcataataatcattttattgcactggaattgtcttttacataagactgtaaacttggggaccagcatttgtatcttattcaccattacatctgtagtttttacttagcacagtacataatgtgtggtaggtaggtcttaaatattggctaaaggaatgttgcatgaattgtgttagcttgtattcttgatgattaagaaaattcacactgcataaaaaattaaggaatcacattcgtaaacaagttattcccaatctttaaaggactaatcttccaatctattttcttgtgctttttctacctatttttcctcttaatcagtacaaacttaaaatatgagaatttgagtctcaaatgttaacaccaggttagaaagcctcgttagtttggccccacattggacaagaatgagttgtccaaatcctacctgttaacagatactcggtatggaagaaactgttacacagagttcactgaaagagttctgcagttcctaaccaattatgtggttcttatactttctctaaaaaacttcttctagctatagttcctgagacagatacctccactattttattcttttgtggcatatatgacagtttaaattattggggtgattattggcttatgtgtttattatctctttctttcccactagattgtatactccatagaggccacactactttattcactactctatacccagggtctagtttagtgcctgacacacagtcaacacttaataagtatttgtcagatgtataagacaaacatgagttcaaaaatatgagcagtaaatttagagcagtagctttcaatcaagagactataaaagtaggcagttaacagctacccctaaaaagtgttttcatttgaactctgtggaagccttgatgatgtagaaaatcttttattgtaaattctgttcaatcaaaggcaaggcagaaaaacttcaaaagcaattctaggtaggatgaaggtatagtacctagaaaaagcaatggaatcacaacaacagcaaccactttcaattagaagttttgagtttgaattaaagcttactaggtatgtgtcctaggtaaacttacataaccatctctaatattcagattaatcatatttaaaatgagggggattttatataatataaaatttttatattatataaaattttatgtttttatgatgacttaatgagattatatgtatacaagtagctattagcattatctatggcatttaggagaaggggctcactattgattagttcctttaccttggccagccagcgtctgcaacaagattgagctaaaacttcatcaagtaaccaggataatacattttaggtaggaaaacatagatgaaataagggcttaaatgcagagaaaagtaagttggtgttagggttaatacataaaaaaaaatgtgtaagacagagtagcgagaatttcacagcagttagaaatggaaaaagatttcaacatgatacaaaaactgccaagaaatctattagcttttcccttaggtgacgcagtcttcccctcatataaataaaataattgctactattatagttggagaaaaatcaactgaaatgtacattaaacacgtattagagatttaacattcttcacatcatttcacatgctgaaaactcaacctttgtaaatatagccatgaaccttattatttactataataaagtaacagcatatccttttctatgtactacttgcagaagtataaaaggcaaatgtgttcttgctctttaggtgcaattacaaggcagcagaatgtagttaggctaattttttgcattttgtgctcatcagacagtggctaccaaccctgcaagaaaaaactggtaccaaaaatacttcatcggaaattctattttcatacttagttgctttcagtattcttactaatttggtcaaacttatgtcagctccctcattaaaattgttttctgtctaaatcgttatcttttctgtgtacgtatatgtgtgtatgtgtattatttggtcaatattcagacagaacaagtctgagatgcaccgcataacaaaagtaatcaccccatccccatacttctcagggaatatctacctggtaccaataagctcatcaagagttcatctgaattcatagcctttgtcaatcagaggtgataaactgtgattttagtagtctatgttccctgcaagaccatcgtcttcatgagggctagaatctggtttattttctttcttttttgtcatcaccacctagttcaggacaaagcacacaatatacaaccattggatatttcattcatttattctaaaatgtttattgagtacttactatgtgacaggcattgttccaagtggtggtgatttaggagtgaacaaaatagatggaaatttctgatctcatggagattatatatatttgttgtggatgtctgataataaatatatagaatgacagacaattatctgcgctaaggaattaaaataaagcagggaaagggaaaagtaaatgatgggattgggagttggggttgaaattttagatagggggaccagcaaagaaattatggaaagatcacattcaagtgaagacccaaaagaaatgaaggagggagttagccagaaatgccttggagaaaaggcaaaggaataggaaagagtttcctttaaaatgccaggctatattcagatagaaatgtttctattaaaatataaaggtatacgaaaggcattcaagccaaagaaataggaaagacttttctttaaaatgtcaggctatattcacacagaaatgtttctattaaaatataaaggtcctatagaaacatttctgtacgaatatataaacatcaaatacataaaagttttaaaatgtttcataagaaaggaacttagaaatcaagaagatagagctagggtatttggcattactatgattctaccacaaccctcccaggggaattatccagctcagtaataacctgagaaatttaggggtacaaataaagtttgcaataactgtaatcactgagaatggcaacctcctaatagatctggaatacctagaagaaacaaatccacttttgcaggataccttcaacaactcaggtcatgtgggagtctcacagaaaaagcaaacaccaatgaaaaagagctcatatatcaaaaatatcaaatccgaagaaaggttcatccataaatgagtcagcagatgaaaaactttaaatgaaatgtacgcattaagttcaaaatagggcacaatcttagggaactaatctgagggccaaaataaaaaaagaaagaaactatgaaaaaggcagatttgataaatatacagagatttatagaaataaaattgtcattaaaattaatatctgaagtgagaatttatcatattaaatggagctaaagggaggattactgaactgaaaaataattccaaggaatttacctaccataaaacagagatagaagatattttttaaaaagattaggagatataaatgacaaaataaaaaactctaacatatctaataagtatttaagaatgaaaaaaaataaagacaaaaatgcaatatctgaaatgatgatgaatcttttccaaaactgataaaacctcagaaaactgtaaaacagcatcaggtaggtccttcagggaatatttcagaaaaaggaatttttatcacaggagatgacagctccatgcatgttattacgccagaagaccttccagtgggacaagatgtagaggtggaggacagtgatatggatgatcccgaccctgtgtagacctggctaatgtgtgcatttttgttagtttttagcaaagtttaaaaagttaaaaaaaattaaatggaaaaaatacagaataaagatgtaaagaaaaaatattttgtacagctatacaatttatgtgagctttaaactaagtgttattacaaaaaattcaaaaagttaaaaaatatgtttataaagtaaaacacttaacagtaagctagggttaatttattattgaagaaatatgaaacttttataaatttagtgtagcctaagtgtacagtgtttataaagtctacagtagcatacagtaatgtcctaggccttcacattcattaaccactcactcactaactttctcagagcaacttccagtcttgcaagctccattcacggtattaattataacttataagcaaaagactataccatacagcatacgtgtacaataggccataccatctacgtttatctaagtacactctatgatgctcacacaatgatgaaatcacctaacaatgcatttctcagaatgtatccctgtcattacgagatgcatgactatatatcaaaactcatgcaatgcagctaaacagtcttagggagcaaagtacaactttaagttaatatgctaaaaagaaaagacaagactaaaattatcaagacattagaaaagttacaaaaaagtaaaaccaaaaaatgtaaaagctgaaacgtaacaataatactgagcataagggaaatgaaaaacaaaaatgtaaagacagtcaacaaaattaagtgttgctttttttaaatgactaataaagtagaaaaatctctgggaatttttattataaaaaagaagatagaaataaaattaaaaagaaaaaacaaatctatttggacatttaagtgattactgaatactatgaaatactttatgctaatttgacttaaatgttcaagttattttacaagtgaaataatatgaacaattttgtagaaaaatataacttgcctaagaagaactagaaactctgattcgacaattataaagatatcacatatgtggttagaaatttatataaacatacacacacacatgcacgcgtgcacacacacacacacacacacacacattaccaggcccaaatatatttaaatataaaatttaataaacctttaaaaatctgttgaggtctatgtgataaaaattggaccatagaaaacaggaaagcacctcaactcttgtataaggcccttgaacactgatatcaaacccagataaaggtattatgagaaagaaaaattatttacaatggtgaggatttagaagaggtacaagctagccaaaagacactcagaaaaagaaaagtaacaatagctattatttatttagctactactaagtgtttgataagagttttgcatatattatttaatctgtatatcagccatataagtggttttattttcattattatcacaattgtataaataaaatgatgctcaaaaaaaataaatgggctcaaagtcataaaattaataagtagcagcagttgatagagggagactctaaagaccatgtacttaaacactgccttgtactatttactcatctttcttaattatgttcacagaggacattatgctgtctccctaacacttcacccaattttaaataaagcataatttttggtttttagcagctttactatgatgttcccaagtgttgttttcttcacgtttattgtgtttagagttcactaagcttcatgtctttcacaaaatttgggaatttttaacctttcttcttaaagtctttaaatattttctctgtcctattcttgttcttcaataccctacatgagagaacaggaggtccctcagacatatacccccacagcaataaaaattttctagttatcccaaaaaaaaaagtgccctagttgaaactttggggctcaagtagggggttgtgaacactagtgacacccaagacctaagaaggccattttgagagggtagaatcaagcccacatgacagacttgccaatgatggtcccagcttcagacatggaaatagctccaacatcctgtatcaaaaacatcgacaaaggggcctggaagaagtcatgcacactaatgcctcaggtgacagtcatttgtcttggctgaggatcctaaaagggagctcccacttagctccagttcctcttggctgctctctcagagcagtcctgccagcacagggaaaaagaactcaaaataatgattttcaataagtccaatgagatgtagaaaacacaaataaaccacaaaatataattaggaaaataattcattaaaaaattagtttagtttaaatattatattccataaaaaaaggaccaaacagataccctatagctgaaaagtatgaagacagaagtgaaaaattcaatacagggcttcaacagcagactcaatcatacagaaaaagaattgatgaacatgatgacaggtaatttgaaattacccacctagaggaacaacaagaaaaagactgaaaaagcatgatgaaagtatgaggaacctatgggacaataccaagtgtacaaaaatatgaattaggaattcccagagaagacagacagagtaagaggacaaaaactaatataaagaaatactagcagaaaagttcccaaatcctgggaggcatatggacattcagattcaagcagcataaaggcttccaagagagatcccaaacaggaatgctctaagacatattataaccaaattgtcaaaagtgaaagacaaagagagatcttgaaagtagtgaaagaaaagagccttgttccatataagtgaacatccaaaagacaatcagtagatttctcaagaaaaaccttgtaaaccaggagggaatggaataatagattcaaagtgctaaaagaaaaaaaaaaaaaaacctgccaaataaaacagtatatccacaaaagctgtccttcaaaaatgaaggagggataataacataaccagacaaaggaaaactgagggaggtcatcacaagacttagaagaaatgctaaagaaagctcttggagtggaaataaaaggatactagatgataaaataaaattatatgaaagaataaaacttactggtaaaaataaacatatagtcaaaatcagaatactctaatactgaaatggtaatacgcacatcactttttaatagggttatttgtctccttattatttgttattaggtatacttttaaactttttattttaatatttttggaacacagtaagtatatatatttatggggtacatgagatattttgatataggcacataatgcctaataatcacataaaggcaaatggagtatccatcacctcaagcatttatgctttgtgttacaaagaatccaactacactcttttagttattttaaaatatacaattaaattatttttgactagtcaccctgttgggtgatcaaatactagatcttactccttctttctagctatcgttttgtactcattaaccatccccacttccccggctcctactccccagttacccttcccaacctctggtaactgtcattctactctctatctccgtgagctcaattgttttaatttttagctcccagaaatatgtgacaacatgttaagtttgtctttctgtgcctcactgacacacaaaaaagaatgacagaacctcattcttttttaaggctgaatactactccattgcatatatgggccatattttctttatccattcttttgttaatggacacttaggttgctaccaaatcttagctattttaactagtgctgcaataaacatgaaagtgcatatatatcttcaatatactgatttcctttgttttgggtatatacctagcagtcagattgctggaccatatggtagatctgtttttagttttctgaagaacctccaggctgttctccatagtacttatacttatttacatttccgccaacagtgtacaaagattctcttttctccatatcctcaccaccacccattattgcttgtcttttggatgtaagtcattttaacgggagttagatgatatctcattgtagttttgatttgcatttctctgatgatcaatgatgttgagcactttttcatataccagtttgcgatttgtatgtcttcttgtgagaaaagtctattcaaatcttttccccattttttatttggattattggattattttgtatatagttgtctgaactccttatatattctggttgttaatcactgtcagatggacattttgcaaacactttctctcattctgtgggttgtctcttcactttgttgatggtttcctttgctgtgcagaagctttttagtttgatgtgatcccatatgtccatttttgctttggttgcttgtgcttatggggtattaagaaatatttgcccagtcaaatgtcctggaaagtttcctcagtgttttttttttcagtagtgtcatagtttgaggtattagacttaagtctttaattcatgttgatttcatttttgtatataatgagagagaagggtctagtttcagtcttctgcatgtgggtattcagttttcccagcaccatttattgaagagactgccctttccccaatgtatgttcttgccacctgtgttgaaaatgagttcactgtaaacgtatgaatttgcttctgggttctctattctgttccattgctatatacactgttggtatgccagtaccatgctcttttggttactatagccctgtagtataatttgaactcaggtgatattcctagttttgttctttttgctcaggatatctttggctattgtgggtcttttgtggtttcctataaattttataattgtgttttctatttctgtgaagaatgtaattggtattttgatagagattacattgaatctgtagactgccttgggtagtatgggcattttaacaatgttgatccttccaattcatgaacatggaatatctttccatttttttgtgtgtccctttcaatatcttgcaacaatcttttatagtttttattgtagagatctttctcttcttcagttatttcctaggtatttaattttatctgtagctattataaattgaattactttttaaatttctttttcagattattcaccattgacacataaaaatgtcactgacttttgtatgttgactttgtatcctgcaaatttactgaatttattgatcagttctaatagttttctggtgaagtcttcaaatataagatcatctcatctcccaacaaggaaaatttgacttattgctttccagtttggatgagcattatttctttctcttctctaattgtactactatgacttctagttttatgttgaataacagtgatgaaagtgagcatccttgtcatgttccagatcttagggtaaaggctttcagtttttccccactcagcatgatactagctgtgggtctgttgtatgtggcttttattatgttgagatatgttacttcgatatccagttttttgagggttttttttttatcatgaggggatactgaatcttaacaaatgtttttttccagcatcaactgaaataatcatatggttcttgtccttcattctgttgatatgtggtattatattgattgatttgcatgtgttgaataatcattgaggcctgggataaattccacttggtcatgatgatcctaatgtgttgttgaatttgggttactagtatttgcttatggatttttacatcaatgttcatcagggatattggcctgtggttttctttgttttcttttctttttttttttaaatgtgtctttggttttggtattaggatgatactggcctcacagaagatggacacattccctcctcttctatttttcagaatagtttgagtagaattggcattagttctttaaatgtttggtaaaattcagcagtaaagcgatcaggtcccagggtttcctttgctgaaggactttttattacagctaccatctcattacttattactggtctgttcaggtattggaattcatggttcaatcctggtaggttgtatatgtctaggaatttactcatttcttctaggttttccaatttatttacatgtattaatagttgcttatagtagcttctaatggtcttttgaatttctgtagtatcaattgtaaggtaacctttttcaattttgattttatttatttgggtcttctatctttttttctgtcaattttgtttatcttttcaaaatgtctgtcaattttgtttatcttttcaaaaaaccaacttttcatttcactgatcttttgtattattttcttcatttcaactgcatttatttctgcactgatctttattatttatttaattctaccgattttgggtttggtttactcttgcttctctagttctctaagatgcattgttggtttttttattgaaagtttttctactttcttgatgtaggcacttgtcactacaaatttccctcttagttttgatatgttctgtttccattatcatttatttcaaaaaacttttaaaatttccttcataatttcttcattgaccaactgatcactcaggagtacactgtttaatttccatgtgtctgtatagtttccacaattcttcattattaatttctagttttattccatggtgatcagagaagatatttgatattatttcaaatttttgaatattttaaagcttgttttgtagtcttaggtatccttgagaatgatccatatgctgatgacaaaaatgcgtattttgcagccgttggatgaaatgttatgtaaatatgtattaggttcattcagtctatggtgcagattaagtccaatgtttctttgctgattttctgtatggatgatctgttcattgctgaaagtgggatgttgatgtcttcagctattactgtactggggtctatctctctgttaagctctgataatatttgctttatatatctgggtgctccagtgttgggtgtatatttatttacagttgttatatcctcttgctaaactgacccctttataattacatagtgaccttctttatctcttcttgtagtttttgtcttgaaatctgtattgtatgatatcagtatatttcaagtatacttccaaatatgattacagtattataatgttgtttttctatgtacatattacgtacataccagtagtattatgtactatgtaatagtaataatatttttactgttactgcaagttttgtaccttcagatgatttcttattgctcattaacatccctttctttctaattgaagtactccatttagcatttcctgtagaacaggtctgatattgatgaaatccctcagcttttatttgtctgggaaagtctttatttctccctcatgtttgaaggacatttcaccaggtatactattatagggtaagagtttattccttcagcactttaaatatgtcatgctactttttcctgggctgtaaggtttccactgaagagtctgatgccagatgctctgttgtatgttatttgtttcttttctctttctacttttagaatccttttccttatatttgaccttttgggaatttgactattaaatgctttgagatagtcttctttaggttaaatctgcttggtgttctttaaccttcttgtgcttgaataattatatctttctctaggcttgtgaagttctctaataccgtcctcagaacaaactttctacctctacctctctctttacctcacttttaagaccaataactgttgccctgttgagtatcttgtaggcatgcttcattcttttttattctgtccttttgtctcctaaatatgttttcaaacagtccttcttcaagctcactaattctttcttctgtttgatcaattctcccgttaagaggctgctgcattcttcagggtgtcaactgcatttttcacctccagaatttctgtttgattcttaaaaattgtgtcaatctatttgttaaatttgtctgataggattctgaattccttctctatgctatcttgaattttattgagtttcctcaataattctgtctaaaaggtcacgttatctctgtgtttctgagattgatccttggtgccttatttagattgcttgatgaggtcatgtcttcctggatggtcttgatgcttgtggatgtctgttaatgtctacacagtgaagaagtaggtatttattgtagtcttggcagtctggacttgtttgtacccacccttcttggggaagcattctaggtattcaaagggacttgtttattgtgactaaatttttggtcaatgcagctgtgtctacattgggggcactccagggtcagttacactgaggctcttacagactcatagaattaccatattggtggtcttgtacaagatctggaagaattctctggattactaggcagagacttttgttctcttccattactttctcccaaacagagtctctctgtgtgagtgtgcttagctgcctggtgctgggctgggagagacataatacaagttcccctgtggccatcaccactgagactgtgctgggtctgacctgaggccagcacagcactgggtcttgcagaaggcccactataaccactatttggctgctgcctacattcactcaaggccctggggttctacaattatcagttaccaacaccagccacatctgtgtcctttttttcatggcaccgaatgcccccggccccagatggttccagagaggccctctaagatccagggcctggagtaagaaaccttaagaatctacctggtgctccattctactgcagctgagctggcacgcaagccacaagacaagtcttttccacaagcacagaagtctcttctcttggacaccactgccacaggcccatggggagtactaacaagctactgtcaatgttcattcaagacccaaaggttcttcagtcagcttgtggtgaatgctgccaggcctgggactcatccttccatgtggtgagctcccctctagcctagggaaactccccaaatgccattcaagaaccaagtcctggattcaggaaccccaagagcccacttcctgctctacaacactatggccaagctagcatctaagctgcaagacaaagtccccttttctctcccatctgtttttctcaagcagaagtagtctctccctgtagccaccacagctgggaatgttctggatcacacctgaagccagcatgtttcagagtctcactcaatgcccatgacatgtactgcctggatattgctgctgattaggaaaggcccaaaggctctttagtcagcaggtgatgaatcctgccagggctgggtccttctcttcaaggcagcacattcccttctagcccagagtatatctagaaatgttatctggaagctagtgcctaaagtgggtgcttcaagactctacttggtgccctatcctactgtggctgagtgggatccaagttgcaagacaaagtcctgtttactcttcactcctctcctcaagtggaataaaggagtctctttcagagctaccaattgcattgcttggtgtcagaggaggggtggcagaagccctcccttggccaccctgtctggtgtctcactaggtcatatgacccctgcatccactggctccaagcctagcagagcactaggacttgcctaggagttgcagtccttgtggctcagactgccttaaagtttatttaggaccccagagaattttagcccatagtggtgaagtttgttgatacttgagttccaaccactgggatggacaatttctctcttgtaaatcccttttaagcctaatataaaagataaaagacaaaaaatatcaaaaacaactatagctagaatatttgttaatggatacacaatataaaaaggtataaaatgttatatcaataaagtgggggcctgggggaaaagcaagatacagagtttttatatgcaatggaaattaagttgttatcagtttaaatttgatggttgtcattacaaggtgtgttatatatgcctcaaggtgaccacaggaaaaaacctctagtagacacaaaaaatagagacatgaatcaaagcaaaaattgaataaaatacaaaagaagacagcaagattggaagaaagaaacaaaagaactacaaaacaggccaggcatggtggctcatgcctgtaatcccagcactttgggaggccaaggggagtgaatcatgaggtcaggagttcgagaccatcctggccaagttcgtgaaaccccgtctctactaaaaatacaaaattagccgggtgcggtggcaggtacctgcaatcccagctactcgggaggctgaggcaggagaatcacttgaacccgggaggcagagtttgcagtgagccaagattgtaccactgcactctagcctgggtgacagagcaagactccatctcaaaaaaaaaaaagaactacaaaacagtcagtaaacaattaacaaatggcaatagtaagtccttatttgtcaataattactttaaatgtaaatggattaaattctccaatcaaaatacaaagagtggctcaacagaaaacaaatatgtaaaatccaacaatatgctgcctataagaggctcactttagctgaaaggatacagagccaaaaagtgaagacatgagaaaagatattccattcaaatgataaccaaaagagaataggagtggttatagttatatcagacaaaatagactatcagtcaaaatctatcagaagacacaaagaaggtcattaaatgataataaagtggtcaattcattaagaggatataaaaaattgcacatatacatgcactcaacattagagaatctaaatatataaattaaatgttaacagaacagaagggaaaaatagacaccagtataataatagtaaaagatttcaatattccactttcaaaaatggatagatcatatagacagcaaatcaccagggaaacagtggtctttaaaagtactacagaccaaatagacctacagacatatatagaacattctatccaacagcagtagaatatacatttttctcaagtgcacatggaacagtctccaaatagatcagatgttgggccacagaacaaatcttaacaaatttagaaaaaactaaaattatctcaagtatcttttctgactacattataaaattagaaatcaatcaaaggagaaattaaaaatgaaaaaataaaagtggaaaaatcacaaacatgtggcaattaaataatacacttcttaacagccaatgtgtaaaagaagaaatcaaaaccaaaatcttgcatatctttaaacaaatgaaaatgggcacacaacaagagggaaggacataacaatgaatgcctacattaataaaagaagaaaaatctcaaacaacttaacttcacacctcaaaaaattaaaaaaagaacaaagtgcacaaagtcagcagtaataaggatatattaaaaattagaccagaaataaatgaaatagaaaatagaaaaataatagaaaagatcagtaaacctaagagttcgttttttgaagacagataaatctttagctagattacccaaggaaaaaaagaaagaagactcgaatttaaaattttgtaatggaaaatggacaattaaaatgatagaacagaaacacacaggattataaaaagactacattaaacaattacattccaacagattagataacttagtaaaaaataagttcctagaaacatataagatgcaaagactgcatcataaataataaaattcggaacagattaatagcaagtaaggagattgaatcagtaataaaaaattctcccatcaaagaaaagcccaggactagatgtcttttattttttgagacaaagtcttgctctgtcacccaggctgcagtgcaatggtgtgaccttggctcactgcaacctccatctcctgagttcaagtgattctcctgcttcagcttcccaagtagctgggattacaggcacccaccactacacccagctagtttttgtatttttagtagagatggggtttcactgtgttggccaggctggtctcaacctccagaattcaagtgatctgcatgtctcagcctcccaaattgctgggattacaggtgtgagccaccgtgcctggcaaaagaactagatgtcttgatgagcggattctaccaagctttaaaaaattaatgcccatccctctcaaacagttccaaaatgtttacaagaatgacacacttcctaactcatttcaaggccagcattgccctcataccaaagctggataagagtgctttatggatatacaccatcagcaagctatcgcaaggacaaaaaaccaaacaccgcatgtcctcactcataggtgggaattgaacaatgagaacacttggacacaggaaggggaacatcacacaccagagcctgttttggggtggggggaggggggagggatagcattaggagatatacctaatgtaaatgatgagttaatgggtgcagcacaccaacatggcacatgcatgcatatgtaacaaacctgcacgttgtgcacatgtaccctagaacttaaagtataataaatatacacatatatatatataaagagtgctacaagaaaagaaaattacagagcaatatcttagatgaatatagatacaaaagtcttcaacaaagtaccaccaaaccaaattcaacagcacattaaaaggatcatacaccatgatcaggtgggatttatctctgggatgcaaggatggttcaacatacacaaatcaataaatgtgatacatcacattaacacaatgaaggataacagtgcgggaaaagcacctgacaaaaatcaatgctttcttgataaaaagcctcaacaaatttggtacagaaggaacgtacctcaacataataaagatcaaatatggcaatcccatagaaaacatcatactcagtggtgaaaagctgaaagcatttcctctaagattaggaatgaaaaagcatactcactctcactatttctattaaacatagtattggaattcttagccagagcaattaggcaagaaaaaaattggaaaggaagaagttaaatggtctctgtttatagatgacataatcttatatgtagaaaaaccctgaagactgcagcaaaaaaagaaaaaaaaacctgttgaaacgatatatgaacccaatagtttcaggatacaatgtaacatacaaaaattagttgcagttccctacattaataaagaactctctaagaaattaagaaaaagatccatcttagtctgtgggcattgcttattacctaaggctgggtaatttataaagagaaaaagtttttttggctcatggcttttccggatgtacaagaagcatggcaccagctcctggtgagagctcaggctgcttccactcatggcagaaggtaaagtgaagccagtgtgtggagattacaaggcaagagagaaagaagagagagctgccaggctctttataacaatcggctctcatgggaaccaatagagaaagaaatcactcaatacatcaagacatcaagaaggacatcaaaccacttatgaggaaactacccccacgatcaaacacctctcattaggcctgatagctaacattgggatcaaatttcaacatgaggtttgtggggacagatatccaaattataaaacgattccacttacaatagtatcaaatacaataacatactaagaaataaatttaaccaagttgatgaagaattggtacactgaaaactcttagacactgatgaaagaaactgaagacaaaaacaagtgtaaaaatattgcacgttcgtgaattgaaagaattgctatttttaaaatgcccatgctacctaaagcattttcagattcaatgcaatctatcaatattataatgatattttttacagaaatagacaaaacaatcctgaaatttgtttggaaccacaaaagatcacagatagccatagcaatcttgaaaaggaacaaagctggaggcatcacactctgtgatttcaatttgtcttacgaagctacagtaatcaaaatagtttggtaccagcataaaaacagacacttaggtcaatggaatagaattgagagcccagaaataaatgcacacttgtatggttaactaatctttggcaagggcaccaactatacacaataaggaaaggaaattctcttcaataagtggttttggggaaactggatactcaaatgcaaaagaataagactggatccttgtcttgcactgtacacaaaaattaactcaaaatgaattaaagatttaaatttttaatttaaaaatgtaagatccaaaactgtaaaacaaagctccttgacattggtcttggcaaagagtttttggatattgacacgaaaagcacaggtaacaaaagcaaaaataaaaaaaagtagaactacaccaaactaaaaacctttttcacagcaaaggaaacaaaaactgagaaggcaacctactgaatgggagaaaacatttgcaactatatatctgatgaagggttgatattcagaatgtatgtagaactcacacaactcaatggcaaaaaaaaataataacaataactcaatttaaaaataggaaaaaggcctgaatagacatttttccaaagaaggcatacaaatgggcaagaagtatattaaaaagtgctcaacatcaataatcatcagggaaatgcacatcaaaactacagtgagatatcacctcatgcctgtcagaagggctaagagataaatatctgcaagaatgtggagaaacgaaaacacttgtccactgtaggtgggaatgtaaattggtatagccattatggaaaacagtatggagtttcctaaaaaaatttaaaatagaataattatatgatccagcaagcccacttctgggtttatatccaaaggaaatgaaatcagtatctttaagagatatctgtaccctcataattattgcagcattattcataatacccaaaagatggaaactacctaagtatccatcaatgggtaaagcggataaatgaataaagaaaatgtggtacatatacacaatgaaatattattttgccataaaaataatcaaacctgtcattttcaacaacatgaatgaatctgtaagacattatactaagtaaaataagcaagatatagaaagacaaatagtctgtgatctcacttacatgaaatcttataaaaaggtgaatctcattgcaacagaaagactgatgattgccaggggatggtggtggagaaaataaggagatgttgattaaagggtacaacatttcagttataagttgaacaagttccagggatctaatgtacagaatgggtggtgaagaatgtgtgaattaacttgattgtgataatcactgagaaatgtatgcataaaacaatcacaatgcacactttcactatatacaatctttgtcaattaaatatttttaaataaaaaataaataaaattgtacttccggtttttgagatactgcttattttttatccactcttttttctcactcctttttagattagataatttctattgatctatctttaagttcaatgacttttccttcaacccctcctccattatactgttaatcctactaatttatttatttaatataatacatttctctgttttaaaattcccatttggttcttctttttttttttttttttttttttagatgaagtcttgctctgtcgccaggatggagtgcagtggcgcaatctcggctcactgcaacctctgcctcctgggttcaagcaattctcctgcctcagcctccctagtagctggaattacaggcacatgccaccacacccagctaatttttgtatttttagtagagatggggtttcaccacgttagccaggatggtctcgatctcttgaccctgtgatccgccccctcagcctcccaaagtgctgagattacaggtgtgagccaccgcacctggccaatttggttcttttaataatttcttatttctctgctgagatttcctatctttttgttcatttcaaccatattccctttcatctcttaaagcgcagttttaatacctgctttaatttttttgcctagtaattccaacatgtgggtgattttaagattgtcatctgttgattttctttatccttaagaaagggtaacattttactgggttgaagtaattatggggtttttatttgtttggttgtttgtttttgttttgttttgtcttgagacggagtcttgctctgttgccaggctggagtgcagtggcacgatcttggttcactgcaacctctgcctcctgggttcacacaattctcctgcctcagcctcccgagcagctgggactacaggcgcccgccaccacacctggctaaatttttgtatttttagtagagacggggtttcaccatgttagccaggatgatctcaatctcccgacctcgtgatctgcccaccttggcctcccaaagtgctgggattacaggtgtgagccactgtgcctggccaattatgggttttaacttagacatcgtcaatgttaattgtggatactccagacttggagtccttaacttggacaatgtgttacattgagccaaagagtgctaatatctttgttctcatgggacattaatttggctaatctcatattgaaaaatttgtgctttttggatctcagtgtggactgatttcagtctgccctgtgcatgtgcagttcaggggtcagacaaagacttaagacagaatttatacacacaatatcccatctctgtctctttactttcctatgtttttcctcattctctgacatccccgttccttcccagagttcctacagcctacagagaaagcaagggctttctcttggagttaaattgtcccatgttgccactgcaattggagatgccctcagaaaaagcctcagaaatgtgaaactcacttcatctcatgacatttgcttaatacaaagtttgaacctcctctaatatttctctagtcttatccattctccaaaacctttacagagttgtattgtgttttgttatgctttgcttttatttttggtttttgtccagagtttatagctactatctgcaggctggttgtttttttggaagtttatttctccacacaagaagcaaaactcttgtattattactaatcctgagaacagaaggttacagagaaacagaaaacagaaggctttaaaaaagtaccaagagatacaaataaaaattgaataaaaaacaaacaaacaaaaaactagaaaaatgtctcctgcttctaggagagggctgaacaaaggcagatgaagaggcaataaagtaggtaataagtacatttacagaaatatatgccatcaaataggtaagaatgcaagtaaaatttatatataacaaatacccaaaagttttggaagcagaaaaaatgttagtcaatagttcatattgtctaacaatcaatctgtcacccaggctttgtcacccaggctggaatgcagtgacgtgatcatagctcactgaaatttcaaacactatcctcctgagtagctgggactacaggcatacaccaccacatctggctaattttctattttattttttgtagacatacggtctcactatgttgcccagactggtcttgaacttctgggggctcaatcaatcctccctgcttggcctcccaaagtgctgggattatagtgtgaaaggaaaataaatcttggggcccaaaatcactaagctaaagggaaaagtcaagctggggactgcttagggcaaacctgcttcccattctattcaaagtcatccctctgctcactaagataaatgcatatctcattgcctctttgtcaaggctaatcagaaactcaagaatgcaaccatttgtttctaatctaccaatggcctggaagccccctcccactttgagttgtcctgcttttgcttcaagttgtcctgcccttacgaaccgaaccaatgttcatcttacatatgttgattgatgtctcatgcctccctaaaatgtataaaaccaagttatgctccgactgtcttgggcacatgttatcaaaacctcctgagactgtgtcatgggcatgtgtccttaacgttgacaaaataaacttcctaaattgactgagacctgtctcagattttttagtttcacaacaggcatgagccaccatacctggcctcaaaagtttcaaaaccaacactcttcatcagatcccagaaccaaagaaggaaaaaacaattgaagaatttatgtccacagttatgccaagatttacactaatgcataccacatctcaaagattgaagaactctctcaagaactggcaataattaagtttccaaccaaattatattttctaaattaaaaataagcacacatccaagtgtaaaatttaaaaaaacctgaagctaaagcacattcaccttatagataaaaatatagtccatacctctctattttataaatgcattttcagacttgatgcattataggacatggtaacttcaaacagcaaggaaaaaactcttatttaaaactcagtaagaatataatctctgtaagaaaattatcattttaaataatttcattaaactgttttctcctttgatatacccctggatgtaacactattaggttatagtgaaaaacaccctcaattaactctcaaaaagtatggttccaccattaagctactatgagactttggacaggtcccttcacctatctaggcttcagtttactcatgtgaaatgtgaggctagaacatatggtttctgctttccaggtgtaaaattctataactacataactttatcccttcgtttcatgcagttttatctccgtcttccacttctgtgtcttcctggctggagtagctttatctgtcgtctgaggcatccggggcacaccccatcatttcaggcttagccgtttctaagtcgaaggctgcagtcactgagggcagcctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggagaacctcaaggttcttcaatgatggaaagattcttgtttaatttctaaaaaataaatttggcaaattcctcagatctcaggcccaaagaaaatatttcaggagagatacattatgcctttcacgcaagtgcaaaaaaattaaaaatgtagactcccacacacaatctcaagcaaatcatcaactgacatctgatgttgtcttacctacagagttaagaagcttgtttacatctgtacttcaggtgagtgagataattttgtgaatggtaggttaaaagtaatttcaaatttgagaattaagcaatgagaaatgtgctgtaaatttcaagaaaaagatgctgcaatactgtttaggattctgagaactttagatctatcttcttataaaaacttccacttagaaacaaagaaataaacaaaaaccaggataaacaatacaatgctctttccaacttgctggaattacattcactcagataaacatttattaagcacttagttggtacaaggtgtactgtcctctgtgagacacacactcatagaaaagaattttgtatctgctttagtgagtttataatatgccagaataaatacatactaaaaggcatatatacataaataatataatgcattgcaggaagaggtaagtactatgatagagggacacagaaagtcctgtgcctcaggccttgctccctgcagggcactaagctatttcgaatcacactgcaggaggtggccaactacacagtatgcagtgcatcagtgctatccagggaagaaaagactactacatggttaagagagcctgaaaaaacagaagcagagaggtggacctagaaaactagcagtcggttgaaggtcaatatgttcctacctggaaaatagggtccaactactgggcagaaggccaggacccaagggtgattctgtgcaactgggggaggtgagaaaggagagaaaggaagtgagtattctgctgtgggaagaagggaattccaagatgacaacacagcaagagcttaactatagatgaaggaattctgaatttcttctagtttcccatctcatgatcatgtcaatataaaaggaaattactataaaatgtaataatttctaccagtctacagattctggcaggctaaattaaacctgaagataaggacaaaattacattccagttcctacttacaacttctatcacataaagaggtacttacatagttcatatgtgcaaactgagttgcatgctttctaaatcgttttatttaattgtgaaatgtttggaattgggtgtcactggtcttcattttgttttgaaaaggcaatataagtgaattaatctatcatcaggctaataacaagaataagtattttaactccttcctttgaaatgaaaagacaaattctttagccaagagcttccaagtttaatttacgattcacaaaattctacaaacataaattatatagtagaagtttcccttattcttacttgaatataactctaatcatttgaatatcagttttaacaaaatgaataagagtacaacagagttcagatgaagctcgtttcttgccaaaatccatatgaatgccaaataccttccaagcacaaataaatcctgccttccatttaaacaaacaaacaaacaaacaacaaacaaaacaccacattgcctaagattgggcaatcactactaagtgactactaagtagtgagtaagagctaagggaaacggagcgaactttaggtcaccagggcacggtacactgaaaaacatgtgctgcgcttcttcagaaacaagctacaacagcagaaagacgaggtaccttatatcttgtttataaatcttactttataaaggagaaaaaaatgaaaaaagggaaataatattcccttatatcctattttgtgctaggcacttagacaatgttttattatttaattgaaacttgagttcaatcggtagcaggagcggcgagcggaacccagagagccctgagcagccccaccaccgcccccggcctagttacagtcaccccagaaggagccacaaccctgcagccagcaggtcaccatcacagcaaccacaaccctgagcaaagacgccaaggcagccaaccccaagccggcaccacctgcagcggcgcagggagcagtggcaagggcgacctcacaggcggcgcctgctgatggggataagatcaccgcaaggaagattttgggaacagtaaaatggttcaatgtaagaaataaatggtttcatctatgcgaatggcaccaaggaagatgcagttgtacagcagaataccatacagaagagtaaccccaggaagtaccttagcagtgtaggacacggagagactgtggagtttgatgatgttgcagcagaaaagggtggggaggcagtaaatgttacaggcccctgtagagtccagttgatagcagtaagtatgcagctgaccttaaccatcattgacgctatccatgtggtcctcaggcaattaccagtagaattaccagaatagtgagagtggagaaaagaacgaaggacgggagagtgctcccttaggctcggcccaacaatgccggccctgctgcaggcgaaggttcctgccttactacaggcagagaccctacggaaattgaccaccatattctaaccctccttgcagggagcagcgacggagggtgctaacaactggggtgcaggagcacaaggtaggccagtgaggcaggatatttgtatggtttatagaccacgattcctcagggaacctcatcgccaaagccagcctagagaggacggcagtgaagagagtaaagaaaatcaagatgagacccaatatcagcagcgacctcaacatcggtgctgctaaaaccccaattatctatgtagactcccagaaaaccctaaaccacaacatggcaaagagacaacagcagccagtccaccagtcaagaattctgcacccgaggcagaagaaggttgagtaaatgccggtttaccatctccaccatcatccagtttaatcatccaacaagaagaaatgaatatgaaattacagcaatgagaaatgcaggaaagaaatgctgaagaccttaagtgcttgctttttgcccattgatcagaaaccagaactacctgcattatctacgaagcatggggtttttaaaattatttttacctacagacatgtctttttggtaataacaaaggtttttattgttgttgtttttgtgtgttttttttttagtttggtttttctcaacatgcctttaaaagcttttaaattggttcatatgtcaagttgagatttttaagcacttcacttttaatttgtaataaaagtttacaacttgattttttcaaaaatgtcaaccaactgcaagcacccattgaaagtcttaaataatacaaaaactttaaattaaatcaaatgggtattaacaccatataatacaaaaaagaagtgaggttcgaaaatccttatgcttttgtgatgccacacgtcacctaactggtagcacaacttgattgcaatctgactctgaagcttttcttcattcctagacatcctatttttgttgaagtcctagattttaaaagtataatttttttaggaataaagatctggtaggcaggaaattctgctgaagctgtttctgggcaacttgactttgccagggcctttgcactgattgtgttaatggccacctcctcttcagatgtagggttatggatcacctgtaaccacctgtaacctgtacagcaagctgaaggagtgtttgcctaatatccaatccacagaatttatttcaaaaatggtgagcctcactaaggtgatagcagtagcctgtccacaggctgatcaacaaaatcttgtctttgatccatggtttctgcttcttggagtctcccaaggtacattctgccactgctggacctagaatcatagtctcctttcctaccagccttctcaccctgccaaacttatcatatacaattgtttgacatcacagatattatcaatccctaggcctctctagctttctgctcttgcaatttcttttacattgtctttgtcacccagcacagagcccatacataagtcatcactctattttcttagaaatactttcagttcacttcttggttttcctatctcacttaccaagctgtcttagtacagatctaagatgagaattttagtacaaataatttattttggaaacaaccccatgaaacactggtaagggagaaaggatggaaggcagaaaagggaaataagatagaatgtttgcaaagataaccatcaatagttcctcaaagccttgctctagcatgctgctcttcccatcaagaggcagagtttgtttcccccactcttgaatctgcactgaccttgcaccctttttttgaacaatagattgcagcagaagtgatgctatgctagttctaagccaaggctgcaagagtcctggcagcctcttcttttgctttccttagatgcagataccatgtaaagacgctcagactagattagtgaatgatgagaagcaatggggagagacaggcccagacagaccccagccattctatacattgcactgaggcctaaaacccataagtaaagccatcatagtcattcctgacccagacaggcttccagtcaagtgcaactacatgagtgacccaagctattactaatctaagcctgggcaccccaaagatttgtaaaaaataacaaatctttgttgttttaagtccctgtatttgggggtagtttgttacacagccataaatgaaacagggacaaagccaaaaaagggtacaattattaaacaagttactgctatgggaaatgagtttagtccttctgggatactctggaaaacagtaaagaacatgcctcacagttatcccatgtgaagggtaaggatgatagtgtaatccacccacttgctaacagttatttgcttaagtctttttctagtgacagtaactatttggtactttaagcctgcccaacactgtgagccaaatctgctcagcagccacacacaaaaaatgccttcaggcagacagtcacagtatcaggaataagcagtcttctgtgacaagaggtgagtggtggaaggaaacaggaagagcgtcaacataggtgaaaacccaggcctagagcagtccagctatctgctttctccactcctagaactgcaacagctaaagtgggtcacatacactcacagattataaccactacacatctacagctcccaaacttagctgggtcccaaatgttacttaataatccttccaagtttccctaatcatctgtttactttagtatattttacatctatttcaaaacttcccacttttattaaatcttctattccacctacccctcccccttcggtatcagcaaagcaatatgctctctatcccaatgagaaaataaaggtcatcagatcaattttttgctacctccattgcactgcattcagaatcatccttccttccttccctactaataccacaggaaagggtcaaggtaaatgcagcattaatccagcacctctccatctctggaataccccaccttagaatacaagaacccattatgtacttgcccttttctgtctctcttaggtccctaatgcatgaatctcatcgagttatagatctgttgaaaccctacacctatggatctttgcaccaagcattgttcctactgcctaaaatgtaccttccccaactttccccatttctagactctgccctggcagagtcctcttcatcttttagacctccacttacctgcgacctcttcaggaaagccttctttactttgctgcccacgattcctcaaatctatgcttacctctgccacagcactttgctcttttctgaaatcgctcattcctttttctgatatccttttcctcctcctttacctcccactgaaaataagctcctccaaatcaggtatttgccttatatatttttgaaccatagtatctgtgcctagaacatagctgtggattaacaaatagcaccaaatttaaataaattaattaatcatctcttttccttaagttactttccagagtaactttagtggaagctgcaggcaagatttatgtgtactgtggcccttcctctttctatctttttttttctttttaacattctaagaggtatcatacaggtcatgataaactgagtctcttctaaatttgcatatagtgaaaaataacacgtcaaaatgcatttgcttagaagctcaggaatccattgttcagttaaaacttgttgccttgttataatgttatgacaaaataggcttccatactggcttttaacatataattgttaattatcatcacaaaagtttcaaaatttcttcagttttaaaaagattttcataagtaaaaatgcatacagtacttgtatactcacagtgagcttatttaataatatgtttgtagaatgtaaaatagctttctgttttatggtcagatttgataggcctatcaaaattggtttttatagatatgattgctactttcatcaaaaaatgaaccatcaactttaagagaaatgaaaaaatcaatttgggtcatggtaacttctaagccctactacctagtcctagaatttgttcttaatagaccagactgtctgcaaaatactttgaaacaaagaatgtgtactttgcctcctccctaccatgttcttggcaactagggaatatgggacattttaagtctttaagataaaattaatcacactgatttagaacaactaaaatcttgtcagagtaattcctaccttctcccttccccaccatgttacctttaggaagaggagacacacttgaggaagctcttcaaggctggtcttcagggaaataaagacattgaaattccactccaattattttttattacctgccaccttgaatccagaatatatgttacattatgaagtgtcgtattcttgactcaaaacatccttccaattaagattttcttttttaaaaaaaattaggttaaagcaaaaatgcagaaaagaagggtaaataagattagtaaaccatctgaaaattactgcattttgtaaactttggtaaaatgtatgaagaagcatgttttccagtctgctttctcggcctgtggatacctgggacataattcagtttgccatcccctgttcccagatcagctcagtctttgttcagctccatcttcaatctggcatataattacttcttcagctcctgtgctatttggttttaagcacctcttacccccaaggcctcatggctctaagggcttgttgaatttaaacaagcacatttaaatctttgtctttaaatgagtaaaataaaagtcttaacacctaacacagagtactcttctacactctaaatgtgcatgttataattgcctaccagatcataatgagcatctatccatcctcaaaatcagagaaaggggggctcattctagaggtaaatttacaataaatggctttattcttgattagctatgtgtgtttggggacacagagactggcacctgcataatttaaatacctgataggaatcagatgatcaggacaccttggaaataaaggtggaaaaacaatagtggaggaaacacaataatggaggaaatacagaagaaaaaaaacaagattgttaaaagaaattaataaaatacaacttaaggaattttaagcttcacctctcattggaaaaacactgcaaactcatacacacactgatgcatgcacacatgcatgcacgcacacatgcatgcgcacacacacgtatgcaatataattacagaaatgttaaaactgtctgtctttcctgagagtcaggagatgtggattctgccactactgctgctggcaaatcataaataccatccagggttttagtttagcctgagtaaatgagtaatcattacatttgttccacatacatactttactccaaacactggtagataagtattgaatgagaccctcattcaaatacacggtcaaaaatgccacaaaaagaagtattataattataactattaattataagtaaagttttttaatgaatggataaattagtaaaacaaattttaatagatataaatggaaaacaaagcatgtgcaatctcactagtgatgaaggtaatagaaattttaaaagtgagatactagtctttcacctatcagatcagttaaagtcaataaaagaaaaattcagtgttggaagaggcactgcagtgggagtgtacattagtaccattaagcactatgtatcaagggcctgaatcatgattatgtactgtgccagtttgggtcctcttgtgccaaggtgaattgggtatgtgagataattatttggggtagaatctatacatgataaaggggaagaggtgtaggtaaggagagcactcagactatgatgcaattctgacatctctgaaaggagaaaggcaaggaagcatttggtaggaagagatctgcatgcaggaaagtcctgagaaagtctcagccagggttggttccaagtctttgttattgtgaatagcgctgcaataaacgtatgtgtgcatgtgtctttatagcagaaggatttataatcctttgggtatatagccagtaatgggattgctgggtcaaatggtagttctggttctagatccttgaggaatcgccacactgtcttctacaatggttgaactaatttacactcccactaacagtgtaaaagcgttcttatttctccacatcctctccagcatctgttgttttctgactttttaatggtcgccattctaactggcttgagatggtttctcactgtggttttggtttgcatttctctaataaccagtgatgacgagctttttttcatatgtttgttggtgacataaatgtcttcttcttcttcttcttttttttttttagatggagtctcgctctgttgcccatgctggagtgccggggcgcaatctcggctcactgcaacctccggctcccgcgttcaagtgattctcctccctcagcttcccaagtagctgggactacaggcgcatcctaccacatcctgttaattttttgtatttttattagagacagagtttcaccatgttagccaggatggtctggacctcctgacctcgtgatcagcctgcgttggcctcccaaagtgctggaattacaggagtgagccactgcggccagccgtaaatgtcttcctttgagcagtgtctgttcatatccttcagccacgttttgatagggttgtttgttttcttcttgtaaatttgtttaagttcctggccgggcacggtggctcacgcctgtaatcccagaactttgggaggctgaggcgggtggatcacaaggtcaggagatcaagaccagcctggctaacacggtgaagccccatgtctactaaaaacacaaaaaaattggccggccgtggtggtgggcgcctgtagtctgggactacttgggaggctgaggcaggagaatggcgtggaggcaggagaatggcgtgaacccaggaggcggagcttgcagtgagccgagaacgtgccactacactccagcctgggcaacagagtgagactccatctcaaaaaaaataaaaataaaataaaatatttaagttccttatagattctggatattagccctttgtcagatggatagatggcaaaaattttctcccattctgtaagtcgcctgttcactctgatgataatttcttttgctgtgcagaaactctttagtttaattagatcccatttgtcattttggcttttgttgccattgcttttggtgttttagtcatgaagtctttgcccatgcctatgtcctgaatggtatcacctaggttttcttctagggtttttatggttttaggtcttacgtctaagtctttaatgcccatcaatgatagactggataaagaaaatgtgccacatatacaccatggaatactatgcagccataaaaaggatgagttcatctcctttgcagggacatggatgaagctggaaaccatcattctcagtgaactaacacaggaacagaaaaccaaacaccgcatgttcgcactcataagtgggagctgaacaatgagaacacatggacacagggaggggaacatcacacattggggcctgtcgggtggtggggaagtaggggagggatagcattaggagaaatacctaatgtagatgacaggttgatgggtgcagcaaaccaccatggcacatgtatacctatgtaacaaacctgcaaattctgcacacatatcccagaacttaaaagtataataaaaaaaaaattctagaaaaagaagttgcatctgtactgaacatgtacagagttttttccttctcattattccttaaaccatacaaaaaagaaagtctcagccatgttggtagggagtccctgaaccagagttacccattagaagaatctagtattgggcagaaatgtccccgttctggtattcctgacatgttcagtcactcggtggaagcagccccaaagaaggatggtttcagggtgaatgttgtggtggatccacaggtatagcagctggaggctgtcaattatctatgctctctacaaaagctcctcttgaaaacagagctgagaaagacacttgtatacatatgattttattcccgttctaggaatctatctcaaggaagcaatctaaataccaaaataataatgataaagagctttatgaacaaagatgctcatcgcagtcttttaaaaaataattgaaaggatagaaacaatttaaatgtccaagcataaggattgattaagcagctatagtatgtctactttaccaaaaatgctgtggctattacaatggaaaacttatattttaagtaaaattgaaaatagagataaaatatggtataacttttaaaattaaaagctttgaaaagatacatattttaagactggcagaaaataaaccaatatggtagtaataggaagtttttttgcatttttgaattttccaaattttctttattaaaatttatgacctttagctgagggaaggaagcattcaaaataaaaaggcaaaaaagcaaaatagttaaaatgatttagagtcgaagtaagcaggggaaatatgaagctatagaagagaaaacaaagaagacaataaaaatatctgaagaatactgtcttaataattctgggactaggtgtggtggctcactcctacaataccagcactttgggaggcccagccaggaggattactcgatgagcccagagttcaaggctgtagtgagtgattattgtgccgctgcactccaggctgggtgacacaccaagacccagtctctaaaaacaaattctggaaaacagcttcatggctccaacataacattgaacaaagccaaagatgggaaaggaaaagggaatgtttttattttcattgtagcattgggtttttaaatgaaaactgatgtttcatatgctcttctatgactattcagtataggtgtttcaccatcattgtaaggagtatcttctgtgtatgtaagtatgtgttcactagtgcattcattttttcaacatgtgattaaacagtttgagagtcaccatatgccaggtactgtgcaagcaaatcaaaggtcacagtgtaaaatgagaaagggtatgttttggccctctattctagaattgtttatagaaagtgcataatttaagcccatatgtcccatgtcctaaagatacctgtccattaaatacagtgcatttcattgccttttcagactctcttcactatgcacataagtgacaatgtaattgcaatttgattaattcatataaactaagaaaggaggaattattcattcatttctgatttttttttttttggaaagtatcccattcctactatagtttgccaaaccctctcagggtagacctctatttacttaaaagaactagtttcatagattgctgtcatgcaccctaattagacaaacgtgttttccaggtctatttgaaggacattctgatataatgcatacctatcttcttaatcttcttattcagcttatgcatatttcttttcctttaaaatccatcaataaatgatctgtgatctgtaagtaattaatttaatgattacatgaattaaaataatgcacattgctttaaaggagttagtattttcggtttatgttacaatattggccttgggtaaatatcatccattgcctgaatttcataatggttcaaggataaaccatttcctctttataattcagtaagtttgttccaaaggagcctattgctcctctactcaacaatgaaagaaatgcattcagggaccttaggttgcctattcttaataagatggaatcctttcccggtttgttaaattcactgaatttataactcattgttactgatgaaggaattaatccaagcccgttaccagattgatctcctaaaatccacagagcgaatttggtgtcatttttaaaaagaaataaaataacaaaaataaaaatacaaaggatgtcagtaagttacagacaggagggcatacctcatatttatcacctggaaaactagagaaaagtttcatcaaaactgtttcatgcatctgtgcagggctaaagtcatctgctaatcagcactaataatgatggggataacaataataatctgctacctttacataacagtttttaccttgggaaaagattttcacatactactcttcatttagttcttataatgactttgagaaactaacataaatgttttacaagtcccattttgtgaaagagaaaattagagtacaaagaagagactgacccaacaataacatttaactggagctagactcctacttcaggtttttaaaatgctttcaaatcaatagaattcatgatttgcaatgttttcctaaattctgttaaaacacacttaggaccgtaaattttcaccaaccataacagacacctggtaagcgggcatgtaataaacaattgagatgttagaaaaaaagatatgtctctgatgagcagggcaaaagtgaatgtaagtcaaaagatatctaaagactctatagcttctggaataataaattggtagttttctttatttttcatttgttgtttcagaaagtgtttaacttttgatactaccaccaatgtaaaatataatagattgttagtaacaataaatcaatctctacgttgtccaaataggtgtgtttacccaggtccacactgttcaagttttattaaaactgtttcgttttatccaggtttccagtattgcatctcctaagacaaacactgatatttatctgctgatgcttgttttactaaccaaatattacattacacatggtttatcacattacccagggaggtgacaatatttcaggaaaaaaattaacaaatcaaaataactttgaaaactgtttataccccatgtacaaaagtactgtctatgcctagttattcactactatcacaagatatacataaatcagagtttttaaataatactgacttccccttataaattcctttaccccttgtgaaaggaacctagcaccattatgacacagttaagcattagtcacagtttaataaataatttcgttatagcctcctagtctatcagtattatttggattctcagaatgcatgtaatcatgtaaattacaaaatttcctttgtatcagggataaccaactgtcttttataaataatgttatttttggtgatttttcaatatcagaacagtatagttttggctagagaaattactataagcattcaaataaagattaatcaatttatacaaggcaaataaactttttgtactcttaaatacttaaagaataatatatacattcaaatatttgtaagaaattcatatagaggggagtataaaacacatatggaaaaggaggtatgtctgcagaagttactttgtaaagaaacatagtgctcaactaccaccctccctcaaatatcatgtcaatcaaattagcatcataagaagaactccagttctactgtgatagagtagcttatatcaaatcaccccctcgttgagaaaaactattaaagatgaataaaatgaaattattttaaaaactgtttgaaggcaccaggcaccaaccaaagtaatttcaatttaaaactcaatagtctataaaggaagtaaacacgttaaagtaagccctatgttgtttattacttttcaaattcaaggcatttgctgtttcctaagtagaacagaatgcgagactgagcacaaagctccagattagaacattaagaagtcttgtaaagagaggagggcacaaataacactttggagctgtcagcacagccaagacatgaagaatcaagatcctggataaactgtaaatgcaatgaggtgaggcctgtattctttttccacttttaacccctaaaacatttccagttcctctttcttggagtgagaaaatcaaaagagaaacaagcagaaaacagcaacctaaatactaggacattaaaaagaatattcagtagtcttataccaacgaagcaaaaactggagtttagtgactacttgaaaagcactccaaaattttatttgaacctctaaatgactatttataaaactaagggaaaaccataactagagtagccatcacaaagatggaaacccaacttcaaattgtcttaatccctgataagattaagtaaattacctttattctaataatctgtgaggagaaaattaaatccccatggaaaaatataataccatacaaaacactctaaatttttaatatgaaaaaatcatcaagcatgctaggaagtagaatcaaagaaccaaaacaaagagaaaaaataatagacaaaaacataaattcaaaaatgatacagattaaagaattatcagatatagtcttttaaaaacagtgataaatatggtttcagaggtaaaggaaaagagtgagaataatcagagaactgggatttatattaaaaacccaaagattattctagaactaaaaataaaacaaaattaataactcaatcgcagccagttagacacaacagaagatccaagttgtgaacttgaaaataggttaatagaaaatatccagaataaaacaaagagagaaataaggatgataataaaagaagaagcattagagatatatagaacatggttaaaaaatgttttaacatacaaatatctctagtcccagaaggaaagggtaaggagaataggcagaagcaaaattcaaagcaataatggccaagaattttccaaaattggcaaaagcatcaagccacaaattcaagaatgtctaagaaccccaagcaggataaacacaaagaaaccaactacaaaaaaaaaaaaaaagcctgtttgtaaaactatttaaaaataaacaataatcaaaaaggcaatctcaaaatagccagaaaaataaaaatgcattactttgtaaggattagtaagtctgataactgattgctcatgaaaaacaattgaagccagagaacaaagccatgatatctttaaaatgcttttaaaaagtaactaccaacctaagaaacccaaacaacagcaaaaaactaaataacctgattaaaaaatgagtaaaagatctgaacacacatttctcagaagaagacataaaaatggtcaacagatatatgaaaaaatgctcaacgttactaatcattaaggaaaagcaaattagaaccacaatgagatcacctcacacctgttagaaaggctaccttcaaaaagttaaaagacagtaagggttggcaagaatttggagaaaatgaaactctcatacactgttggtaggaatgcaaattgggtacagccattatgaaaaacaatatgaagattcttcaaaaactacaaatataactaccatatgatccagtaatttgacttcaggatatatatcctgaggaactgacgttagtatgttgaagagatatctgctctcccacattcatcgtagcattattcacgatagctaagatacggaagcaacctaagtggcatcagcataaaaacagataaagaaaatgtgttaaatacacacaacagaataatattcagccttagaaaataaagaaatcctgtcatttacaacaacatacgtggacctggaagatactatgttatgtgaaataaggcagacacagaaagacaaatactgcatgatctcacttaagtgtgaaatccaaaaaggccatagatacagggagtaaaatggtggttactagaggctgagtgttggatggtgatgaagaaaggggagatgttattcaaaaagcacaaagtttcagctagacaagaggaataagttttagagatatactgcacagcatgatcactataatttataagagtgtattatatattttgaaactgctgaaagtatactttaaatgttcttaccataaaaacacgataattatttgaggtgatggatgctaattagcttgatttattaattctacaatgtaaacatatactgaacatcacactgtatctcataaatatatataattgtcaatcaaaagtaaaataaaaataaagcaaaacatatatatacacaaaaaagtaaataccaacgtagaattctctaaccaatgaaagtattcttttaaaaagtcaaaataagaatattttcagaaaaacaaaactgcggaaatatttcaccgaaagattcatactataaagaatactaataggtatctttcaagtaaaaggaaaagcatctcagacaatgatagagaaatgcaaaaaataaagtacacagacaagattagtatgcgtataagtatagaaaaataataaaaataatgttttaggaattagagcacttgaagaattataattcaggacaatgataagacaaaaaatgagagagggacaaatataattattcattgaaaagagataaaaggtgtaagttacagtagagctcattagggtaaccactaagaaaaattaaaaatacgtaattagcaagttaaaagaggggcaaatgaaataacaaggttgattaataaaaaaagttaagacagaagaaatgggaaacataaaattggtagaaaaaatagaaaagtacagtaagatgatagaattaaatcaacaaatattagcaagtgcagttaatgtaaatttaaaaagttgcattgaaatacaatgtcagactttgaattaaaaatcaccattaataatatgctatttgcaggacacataccttaaaagtaagtatacagaaaatgtgaaaggaaaagtgctaaaaaaaatttaccaaacaccaacgaaaagaaggctaatatcactatacattataatatcagtctaagtagaatgaaaagaaatagtacaagaagagcattaaataatactagttaatctactaggaagatatcacagttccaaatttgtacaaaccaataacataagcttaaaatgtacaaattgaccaaactaaaaggtgaaataaacaaatacacaatcaagttagaaaattttgacatatttctctcagtaaatgatagaacttggtaaaaagttggtagataaataaaagttttgaacaccaagatttagcaaatttgatctaatttatatgtacagaatcctgcacccaatagcaacaaagtacacatatttgcaggtgcacatagagcatgcaccaaaagtatccttaaactgagtcatatagcaagcctcaataaattttcaaagtatttatatcatatagaatatcttctctgaccgtaattgaattaagctcaaaattaataacaaataagtattataaaatacatcaaatactttcaaataaagcaatagataaacttgataaaagtcaaaaattggggtcttttggtaaagaaagacaaatataagcagtagtcttctagaaacacaaatttcaaagatgaaaaaggacaaataaccttaacaggaatgaaaaaatggagtattgttacagatgctacagacatagtacaaagataataagatctggtgaacaagtttacatcaataaacttgaaaaaattgatgaaacatataaatcccctgaaaaacacatattaccaaaatggacacaagaagaaatggaaatccttcatagtactacgtcttttaaaagacatgaatatttgatttggaaaactcttctggacactggtctagagaaagaattcattaataagacaccaaaagcacaagaaaccaaaacaaaaacagacaaatggtacttaattaaactaaaaagcttctgcccagaaatagaaataatcaagagtgatcagatgacctgcagaatgggagaaaatatgtacaaactatcaatcagacagaggactaacatctagaacttacaaggaactcaaactaaataacaacgacaaaacaaataatcctatcaaaacgtgggcaaaagacatgaatagccatttttcaaaagaagacatacaaatggccaagaaacatataaaaaaaaaagctcaacatcactaatcaaagaaatgtaaattaaaatcacgatgagagatcatctcagactactcagaacagctattacttaaaaagaccaaaaacagcagatcttggcaagcaattgcagaaaaggaaacgcttatacactgttggtgggaatgtaaattactacaatcactatagaaaacaatatggagatttctcaaagaaccaaaaatagatctactatttaacccaacaatcccaccattgggtatatacccccaaaaagaaattattataccaaaaatatacttacactcatatgtttatcacagctctagtcacaatagcaaagatatggagccaacttaaatgtccatcaatggatgattggattaaaaatgtgaaatatatatgtaataggatactatccagctataaaaaagaatggaatcacatcttttgcagcaataagaatggaagtggaggccactattgtaagtgaaataactcagaaacagagacaaatgtcctatgttctcacttataagtgggagctacctaatgtgtacacattgacatagagggtggaatgataaacaatggagactgggaagggtgaggaggaagggggtggatatgagaaattatttaatgggtactatgtgtgttattcaggttatgaatacactgaaagctctgaattcaccactatgcaatatatctatgtaacaaaattacaattgtacaccataattttacacaaataaaagataaaataaaaaagtctttccacaaaactttctgactcaaatagtttcacaggtaaattatttcaaaaatttaatgaaaaaaaaatagcaccaatcatatacaactcttccaagggtagaaatagagggaatacatccgaactcattttatgagaataatataactatgcaaagaaaacctgacaagaacattaagagaaggtaaaattacaagctaatctctcttttgaatgcaaatagaaatatcttaaagaaaatattaagaaaatcaaattctctatgaaaaggataatataacatcaagtagggtttattctaagaatgcaagggtggattaacattcaaaaataaattaattaaataacaaaaatcctatgatctcaatagatccagaaatgtatgtgaatattccttatgatttaaaaaaaaaacaaaacagacaacacagaaacacacataaaacaacaacaccaactcagcaaactcacgaattgaagagaaattctctagtggatacaggaaatttacaattttcaaaaaagcaaaaaccaaacctagaacaaatgttatactagtggtcctagctagtgcacacaagtggtcctagctagtgcaacaagtcaaaaacacttataaattaaagttatatggaatgaaaaggtagaaataaaactgtagttattcacagaaaacatgactgtgttataaaaaattcaaaagaacccacaaagtctaatagaattaataagtaaatttagcaagattcctggccaaggtgaatctctctctctcctctctctttctgactctctctctctctctgtgtcatagatagatagatagatagatatgaattgttttcttatatagtaacaatacacatttagaaaataaaacttaaaatgataccaattacaagagcattaaaaaatctaattgtagaaatgaatctaacaaaaagtatgcaagtccactgtgcagaaaactataaaatattactgattaaagaagaataaaataagtatgaattataatgcatttatagattagatatcagtattcccaaaataccatctcaatcaaaatcccagcaaattacatattgtagagattaacaagcagattctaacatttttatggaaataaaaaggaacaagactaactaaaagaatctaaaagatgagcacagctaaaagatttacactaccagatattaagatttcttctaaatgttcactacttagtcatgcatcattgatgcaagggtaaataaatagattcctggaataagagtccagaaatatgtccatgaatatgtaggcagtacatttataataaagttattgctaacatactcagggaaagtatttttgacaaatggcacttgatcaattttttaaaaagaaaaaatgaatcctgtccatccttgcccccatctcacacctaacacaaaaaaatgaatttcaggtaaaatgcagacctacattttaatggcaaacaataaagattctagaagataacaaaggaaatgtctttatgacattaaggtaggcaaaagcttttccatttttttgtttttgttttaaacaggatagaaaatactaacactaaaagaagaaattgatcattgaagtgcattaaaataaaaaacttttgtaaccaaaagacaactataaggtcaggcgcggcggctcatgcctgtaatcccagcactttgggaggccaaggtggccagatcacctgaggtcgggagtttgagaccagcctggctaacatggtgaaaccccatctctactaaaaatacaaaaattaactgggcatggtggcataagcctgtaatcccagctacttgggaagctgaggcaggagaatcgcttgaactcaggaggcaaattttcagtgagccaagatcgcaccactgcactccagcctgggcgacagagtaagactctgtctcaaaaaagaaaaaaaagacaattataagagagtaaaaacataagcttcagaataaaagtagatatctgtaataagtatatctgacaaagaagtatatatcagaatataaaatgaaatcccagtaacttaataataaaaacagaaacaaacccaactggaaaatggacaatacctttcaacatgcacatcacaaaagaggatacccaagtggaaaataaacatatgaaaagacgcttaatttcactaatcattagagaaatgcaaaccaaagccatcatatcatgggctaccatgtcacacatgcctgaaaaactaaaatgaaaaaagaccaagtgttttcgacgagtagaacaataggatctctcttatacagtagtccccctttatccatggggaatacactccacctcccttagtgaatacctgaaactgcaaatagtacccaatcctacaaatactatgtttttttcctatacataaatacctatttaagatttaacgtatttatacctatttaagatttaatttatttaacattaatgtataaattaggaacagtatgagattaacaacatacttaatcataaaatagaacaattctagcactatactggttatatgaatgtggtctccctccctcctcttctctctctatttccctctcaaaacatctttttgtacttaagggtgagcccttcttgtgatgatatgagatgataaaatttgggctgcagctgactacggataactgaaactgtggaaaactgaaatcatgaatcaagtgggaggggcattactgtgctgctactgatcatgtaaattggtataataacattgaaaattatttggcactatctactaaagctgaacataagcacaccagcaatatcactcctcagcatatatccaataagaatgcttaaatatgtaaaacaagacatgtagtagaatatgcatgtggccaccacaattcataatggcttcaaactggaaataagccaaatgtccatctatagtagaagagctgaaaataataataatagaattgtgattatattaatacatggaaatattataaagcaataaaatagttttaaaatctgcaagcacatgtaaatgcaacataatataaatgaatctcagaaacataatgtgagcacaagaagccacatacagaagaatatataatcacatgattctatttctatatttttcaaaaataaactaatattagaagtcatgatagtggttatcctgaggaagtagagactggaaagatagataaagggatctttgtggtctgctaatgtttttttattggtctggtgctgcttacatgaatatgttcactttgtgaaaattcacttacctatatttttataatttctgaatttgtaactgttttcctgcactaaaatatttcatttaaaaattatctttaaaaacaattgcgaccataagaatttccattgcttttgtttttttttctctgttttcctgctacttagccttaaatatgggcatagtcacagaaatgtgcatatgaggtaaataaagccccagcttgctggctggaggacataaaggggagctccaggaaaactaaaaaatactaatgagagcacagagaaaaaggggctgcagaaagtgatcttatagggttacaaaattctgggctcatctttagctgtacatgcatggatctgatgttaatcagcatatgaatacaattaagaatgaaattaacagatagaccaatgtctacatccaagattgttcactggtatacacacaggacagacctgaaaagcaccgtaagcaaaactgatattgaaaccacagaaggaatcttgtatcttacaacctgaacctaaccaggtcaattgccttttaaaacaaaaatgtcaacattctccatagaatttcaatatgactcagaatctcataacatgatattaagaatatctaagaaataatcctaaatcaccaggcacaagaagaactaggaacatgtgaactcatatgagaaaacataatcaatggagataaaacctaaaatgacacagatgttggaattgtttgacaaaaactttaaatttactattctaaaaatgctgaaacaagcaatgagaaacaggcttaaaactcaaaaataaaattttaaaaaaatacaacaaaatatcactggatggtttccaacaaaataaagataatacagaaaacagtcaataaactttaagatagatcaactgaaattatgcaatatgagcaataaagaaaaaaagtggctcagaaacctgtgggacaataacaagaagtctagcattcatgtcattatattaacagaagcagagaagaaagagtgtgctatgtgttgaatgccccctccaaatctcatgtggaaatttaattgccattgtaacagtgttgagtatcaggacctttaagaggtaagtaagatagactaatgtcattaatgtgggagtttattagttatcacaggagtgagttgttgataaaaagaatagtttggcccagtgtcctctctgtcatgtgctttcttgccacatgatgccttccatcatgagatcacccttgttagatgctagcatcatgatcttagacttctcagcttttagaactgtgagccaaataaatatgtctgttctgtattaattatccaatttctggtattcttttatagcagcagaaaattgactaagattataattctgaaaaggtatttgacaaaatagtggctagaaaattctcaaattctgtgaaatacataaacccacagagtcaagaagtacagcaaaccccaaacagaaaaaaaaaaaatcaatctctggatacattaaaatagaactgctggaaattgaagacagggaaaactgtcttgaaagcatccagagaaaatcacacattatctgtagggaaacaccattcaaatgactgtggaattctcatcagaaaccatgaaaacctgaaggaaatggcaccccttttttaaaggtctgagagagcacagagaattctatatcctgtataaaagagacctgctctaaaacatttgctgaaaggaagctctccagacagaagacaaatgatacaacattgccactgatataaacactgaacattaggaatgaaggaagaggaaaaaaagtgataaacctatgagtaaatataagaaacgattattcttttgggttctttaaaacatgtttgacaatttaatgcaaaattacaacattatctgacggggcttccaatgtatgtagatataatatatgacaaaacaataatgcaaaactgggagagtaaaaggacttatatggttgtaagatttctacattctatttaaatgtctaaaatattgattctaagaagagtataaaaagatatgtatattgaacaactttagaacaacctctaaaaacaactatacaaagaaatatcgtcagaagaacaatagataaatttaaattgaatgctaaaaaatgttcaaataacccaaaacaaaacagaaaatgaaaaacaaaggaaaacagaagaaacaaacagaaaacaaaatataaaatgaaagacattaattcaaatgtaacaataattacattaaatgtaaatggcataaatataccaattaaagacagagattatcagaacggattttttttaatgacccaattatacactgttttcaacaaatttacttcaaatataatgaaaaaggtaggtttgaagaaaagtgtacgtgctgcaaactccaattataataaagctggaatggctatattaatattggacacagtagatctcaaagtgaagaaacctgccagtgatacaaaggacatcatataatgttgaagagttaattagccagtaatatataataagtctaaatctgtatgccctaacaacagagcttcaaaatacatgaagacataaaaactgacagaactgaaaggtgaaatggaaaaatctacaattatatttggagatatcaacacccttctctcagtaatagactaatatataattagtaaaaacagaactgaaaaaattagcttcataagagagagcatatgatcattcagaaacttaacagcatttaagagattatattccttaccaaatttttaggttaacatgagtaaggttttttgatatagccaactacagttttcgtaagagtaatggttacttcttcagagataagtcatatcagcagaggcagaaagctgagaatgggggaggtcaaatctttgtaagatgtaaactgaaaagaaagttttatagaaatgaatttctgctgatctcactgtgaaagtgcagttttcatacttttatgaaacaggcttgttactttgtttaaatatttgtgtaatccaaatagttttgacttcagttaagctgaatatttgctttaaatatttgtttttaaaccccatttatcaattctttagaatcttatataaaaggtacgtggtacttgcttaggaaaataatcaaaaatcagaaagtggcccttttaataatgtgaaatgattcaacaaacagaaaaccaatattttcttataaaatcagtaaggtggtaggtaggtagctataaaaatatttagatttttactacatattaatccttaaaagaaatcaggtaatgagtctgaaataagtttaatgtgtccttcttatttctattttagttacacacacacacatatacacacacactcttacagatagcaaaatatgctaaataggaagtaaacatggtactatggtatggattagtaagaaagtcctaccttagatagcattatctgagaaagtgttttttactttaagaaggattcgactaagcagtgtgagtttaagtgtcagggccagtgccagcatgcttcaatgagaacactgagaataagtgaaagttgaattgtcactggtttcttctaagctaagataaggtttggggcacctaaagtgcactcaactgcaaatactgttagaggccactcatcttccaagggaagtatcaggggaacataaaacttcattgagttctggctagaacaacatcttatgaagctaggtagattccatgtttctcttgctgataccaaggaacaaaggtaaacaaaggtgtcttcacttgcagctgccattgctgctgacaaagcttatctgcccacagagtggtgaatagtaattctaaaggaaacttcttgtctgccaagtagaactttgaagttctgtgtcatcccatgcaactaccccacaaagagcaggtgaatcctgaggtgaagggcactactgcccctatggtgccctgaaagttggagatcaagctttgagcccttcaccaactcaggataaaccagcacaattagacctcctataaatatgaaagaattctgataactccagctccagagattcttggacaagttactaaatggcagtagacagagacagcatagctgcaccttctgctgtatacctgaacactctagctaaaagtcagatatatctatccatgcactaagtggttgaggatcaatataaacaaaacacagttgcctgagttctgtttacagagcacatacgaaattgtctttttctctccacattgtttgcatcattcctaacccctgaattgaattcacttgttagctgcactgttgtgcaggtcttctgatcttgctttactgacttaatgacaaccactctctaaagactgacaaaaatcacactgtttcttttcacactgcccaactgaagtgggccaagttctcatcatcttagctctagtactcaaccttgaaatcatccacagagatgtcttccatgcaagatatttctcactgtaagggaagatgatggtaagtcatcatcttcaaatagaaatgatagctccaaagaggaaaaggaaaaacaactgccactccatcacctctctgactttggctttctagggaatcagttcttctgggtaaggttaaaccaacaaacaaacaaacaaaaaaatggaggtggggggtgtactttattctgttttgtttttaaagaaatggccacttttcatagatagagcaatataagtggaaaataaccaggaggttttagtgaaaatggaaaaggaaaaggcaaattttgtgacatactaggtctaacaattgtttaaatctaaagtttggtgccaaatagtgatggttttaattaatagatggatctgaaacacccatatatcatgctaaagatttagtattaaatatgttctactactgaaaataataccaaggtctctaacgacaagataaacacatgctatattgacaaaagtatgcaaaaaaatgctaatcaaactcagctcataggagcaggagctgaattgaatgatcttgttcccccaaaataaacttccaattcactactcaggttattttccaattgtcactgggacaacacaacaaaagcaggggacaaagttaaaacctggccttttcagtcaagcaagtggacaaatactcaagacaataacccacaaacaaggaagatgacagcggaaaatcccccacattcagttcacccctttgtgaccaaaccctgttctgcaggtcttctgatgacttagactttaagacagcaaggtagacatcctggaaataggccaataataatcttcaactaggaagacatactgaaatcactagggaagcttttttcaacataacctttccctccctcagctgggaatcatagattagatttaatttgtataatcacttcagtttgaagtaggtggatgacctgaagaaaattaaggtataatggcaggcttgccatcagcaagtacgcatttacaaacattttgacaagctatatctggaaatatcctgaggatccaagaatcttggttaactttatacaactacgataaattgggcactacaccaaaacatgcaggctatttgactctgcattttcctcaatcaacaacatgtaacggagaggcctaatataccaaatcattatcgaacagcttagggatgactcactttgacaggaagagcaaagtgtttcactctcatctcagtgaacctgttcatactgacataatgccacatggttcctaatacgcaacaatgtacactgttccagcaacatagaggcagctttgagcctttggatccaaattctgtgagtgagctgggctagagttttctgtttcccttccctcattatcatggcaacagagggcaaaggtggcagttaggctttatgcctggactgctggcatacaggtccacacctcttccaaaacaaaatttggacaatagttacacatgaaaatgttgtgttctgcttaggttataaggaaactaaatcatactgcaggcaactctttagttattttctcttttatcctatcttcaccagaaaatttaaagagctctaaaacagtgtttctcaaactgtaggtcacactgtcagtgctcttgaaattaagatagtgggctgtagactttaaaggaaagttaggataagataaaataggataagataaagtaggataggatgggatgggatgagatactagaggatagaatggaaaatgcaacacataggaagggtaaatactgtcttatgaaattttgttttaattatatgactgcatgtagactgtgtcatgatttaaatgcatttatctctgtggattattaggaaaatgtatgaaaaccactgccgtaaagaacatctatcttatggccctaacagcatttctctacagaaacactattggctttgtgactgggcaaatctcttttctaagtaatttcagctattcatggcaggatttaacatcatatctttcccctatccactgaattccagtagtgcttccttttcatcgtgacaaccacacattttaaatgctacctaggaggagttatcaccatctagagataaatatgaatccatagacaaaaggttgctagctcaactcatatctgatgagaagcaagtgtttctaagtatccttttgtatctagagtttgtcctccaggatgaatggaggtcagctttgatagctcttatctgggacgtgtacactgttccagctacttattctgcaaattaagtcttcctttcctagcacccatcaatctaatactaaattcattagcaaaatgaaatgaaaagaacacaacatacattgctattaatggaattccatgcatgtcactccccacacattgtactaaaaatgaactcatctccatttgagtgtctctacacaaatatctgtgtttattaatacacagcatttcagaagtgagattttccttaaagctgtaaagccatttgctttgtcaagctcccttttcagggaaaaacttcaggaattttcactatcaatttatgttgattatttactcttttgtggatctgctattctccaggcaaaatccaataaggagaaatcatgattactgtctaaagaatttattttgtaatattttttcttacttcctgtaacttactttgtgtgacagtaataaacagttcataatgctccatctactatcctcatccataaaatctagtaacagttcaacatttaaaaattttttaatgaagacaaaaatcagctggtgacttcctactggagcacaaaattaacacttgcactggagtgggtgagattttcttattcagagcagaatacagtctttttcttacggatttaaaaatcttagttacctttccctagcttgaaataataggcattttgggctgggcgcagtggctgatgtctgtaatcccagcactttgggaggccaaggcgagcagatcacttgaggtccggagtttgagaccagcctggccaacatggtgaaaccccatttctactaaaaatacaaaaaattagccagggtggtggcacacacctgtaatcctagttactcaggaggctgaggcaggagaatcacttgaaactaggaagcggaagaagttgccatgagccgagattgcaccactgcactccagcctggccaatagagtgagagtctgtctcagaaaaaaaaaaaaagaaagaaaaagaaagtaataataggcattttgaagacttcaggagaaatagctagaattcataaattacccagaagtgataacactgtacttagattttcacacataaattttcctattcctggatagtgtgggaccaaactatatataaccaagttttaaggtgaccaaaaattaaaattcacaaatactctgaatgtctcaactactttccttccagaaacccaagaaaaactgaagtgatttctcacttcccctaatgagcactaatgacaattagagatgaacagctaacctcaaacacactaaagagtgtttttaaaacagaataccacacaggttgtataaggcttatcttcaaacattttcctcaataaaatgttaataaacaaaaaaaattgacatgagggaaaagagaattggaatgaagaatatcctcctttacttttaaatgacaaaattaacaaacatgagagaaaacaccatttttaaaatgaaaagatcactcatatgagagaaggcagatcacatagtggaatgtctaaggggaaatccaggtggattgcccactggagtatacagttaaaaaatatccaaaggaagaaagaaaagacattagatatttggaaaggtaagtaactaagtaaataaataaataagaaaaatgatgacaaatttgcaagggacaccaacaccaaatgcggtttttgttttttgttgttttgtttgtatgccaaagagaatcagtcagctagtaacaagtaaggaaattcaaacagtagttgttctaggtcaaaaacaaaagatatatatgtacacacacaccacacacacacacatctatatttatatacatacacacacacacacacacacacacacacacacttggagactctcatgcctcaaatatattttgaagcatacaaatttagagagtctagatttaaaacagtggcaaatacaaaagtctttcttaattaaaaagctagctgcagataagtcactagcatcaaataggtaccaatcaaaagtaaaactgtgctcagaaaaactaacttgttcttaaaatggccattttcacaaagtactgaaagattggcaatgtggccaaattcccccaaaaaaggggtttagaagcagcctttgtaaccaaaggcaaacagtgggaatatgtataaaacaggaagatacacgaaaagcttttgcccacttggtgaattgagcctctctatctaggcttcttgtggcattaaagaagcatctgcaaatgcagtaactagaatatataatctattcagattttcaaaaggcttttgagaaagtttcatagcaataactgtgcaaataaattttgggtaaacatggaattagaaatacatattttcacaagcacaaaactatgttagatataggaagaaaatgtgaagtggaaatgatgagagaatgcttttataaattttgactgtggaattcaaagtgtcaactgcacatatttatatttcactatccttttcaaatagtaaaatatcaaaccacagcatcacggaatcctaaagagctgggatgactccctacgtactacagattaagaaactgagctacagaggattaataattgcccaaggttaaaacatatagacatcaggaagatttcataacgtttacaaacttgaacaaaaagtaccacatgagctcccctatggggatgtgttgagtattatatttcactagtgataaagaatacaaaactgttcacataaatgtggcctttaaaatatggtccctaaacaagaaccttaaaagaattataatacattccctgaaaacatttcaatgtgttctggttacaaagatattcaaaattctagacatcatcagaagtgctttggatccagtcttagggagatccaacatttaatagctatcagaaaaaaatgcctgcaaaggacatagtgaggatatcagaaaaaaatgcctgcaaaggacatagtgaggaaatgacaaggagcataggaagaaaatcaagaaagcatgacgccatgaaaaataagggaagaaagcattgcaataaggaaggagtggtcagcaagatcaaatgctcagtgaggtcccagtgagagttaatttggagaagtgatggaggtccctgcagcagacaaggtgaattgctgaatggattggtgaagaaatggaaatagagagtagaaacatttctttgaagaaatgtgagtgtccttctacaggtaaaaaaaaaaaaaatacatgataactggtcaatctctgaaagtgtgggtccagcggttttaagaggagattcagtattacccaccatactcgttttttttttttaaccataattcctagtcaaatatgtcataagcccaggaaaaggatctcaaaagaacttagaactatcctccttcaatacaaaaaataaaaggcatctggtttgcagtagggttgtagaccttgcaagacttctgcattttggtttaatcagagattttccagaagtctaaaaataattattcatctttgaaaaataagggtaccatacagctatctagctctgtaatccaaggaaaaatcaattatcttaaaagatgccttatgaggtcattgtttcacatgataaaacaagaacattaggaggacaagtctcggttggaagtctcagatcactctaattgttctaattgatgaatcttcttcaaggaaaaaagtgggctccatttctgtttttaaaaatccagagtatctgtagtagtgcaactaatgacaaccttcccgttgttcttgcctaagaggaaaccctataataagagcttcccaaaatgtcaaataatacttgtctcataacagggcttctttgttcattcaccatgtctcttttgatatgcacagataataaaagttcatataaaactaaaggtaatatagagcagaagccaacactaattctgtataaatatgtctgattaataagaatgctattgttatggttatttcataatgtcacgattgttacaagaacagaggatagaagtactcttactcttactgttttcgttcatcctctgtcatccaaccagtttgcaaatttctgttcaacgggaaaaatgaaggatagatttttgtccattaattactgctgttgcataagttagtctcataaattgtgaaatgagcattaaattcagggaaaaattaggggttttattttaaaattgaactccacttccactacaaaaatgaatacatgctccaggcttactttctaagctcccttttccacatgcacagttgctatattcttctggtgctcatgaacacatgaaagatagaatttagcatgatagcactaaaatctaggtaagagcctagtatattaaacctaaactgtggtttaatacaacaaccatacacaaaattgtatatgggatttggttccaaaaattagaaccccaccctggtgaagtaataagtaaccccacccagatgtgagtatctggtcccttactggaaaggaaataaaaacaagtaataagataacagtctacactcactgcagacagacagcccgatagattttgaaggaaattctaaggctggtagataagtttgtattgtcattattttgcttttctctttaaattcttatctcctagatcctggtattcccccttggggcagcagtataatataaaagcttaacagtcgatcttaaatttagctgacatttttatatccttcaaaacataccttttagattgcacccaagaaggagattattaaatagtagcaggagaccagttagtggaccattttgactgaacaaaaaacagcactgtgccttcttgttgacaaaccaaaaaacatttatatagtcattataatcaatttcataaataaaaggctattaatgactgagaaaaaaagggaaaaactgtatttctcccaagtcccttcatcctctcttaaactccatattagtttaagaaagtggaggaagctatgcatgaaaaatagtgtacttagttgagctggagtctcttgtgaaacaggttctgtcagtcagaaggcaagggtacatttctataattatttaagcctagtttttttgtagtaattagccagagctccattttgctgaagctggcatcactcacagctcacttttttttttcaatttagacttttcattcctttttataaaataaatttacatattttcagtctctcaatccctcctatgttttatttatgaatatagcccttcttgatggtaactctaatgtgaaagaggtagtaattaatgtcccaatctgctaggttaatccctttccacactctctatagagaagtttaaggtaagtaacagtttacagtcaatattaggtttaattatgcttaatgagagttggtgtctctgtttactaactgcatttaggtgtgtggatcctagatgaattttcccttggcctcattctgatttgttaatagtgccactgtgtactgtatactcagtgcttaaatctataaagctgcttctggagaacaaagcaagtaaggcacctgtttcagttgaaacattattaaacaaatgagtgaagttttaccgcaaccacatctttctttgggaaggtgctgttattttataatgctttccaaacaggtccatgtaaaaggctaattgctgcctaaattcaagatcctaggttaagtctatacatattaaaaaatgtttcaaactaagtacaataatcaatggtgagtattttaaaactatggagtattaaacacttctaagactttctgtattaatctttcaatgttttcattccaagtactataattgaaaactactttgacaagtagtttttttgccttgaaaatgtcttttgtcttaaaattatattcaactttgttgctgtgtataagacaaaacttttgtttccttactgaaactataaaaataagcatcaaaacaaacaccttggcctcaaggaaatcagatagtaagccgagggaaatttagtaaacaaatttttaaagaacccctttttcctatatttttgttatggataaattatgtatacaactgaccatgtagtttctttaagtccattcatagtctaatcaatttagtaaacatttattgagtaaatactttgagctaagcacaaaaatgaacatgacatactcccttctctcaagaagcttaccatctagaaaggagccaggcatgagttaaaaactttaataggctgggtgcagaggcttacacctgtaatctcagcactttgggaggccaaggtgggtggatcacctgaggtcgggagttcaaaaccagcctggtcaacatggtgaaaccccgtctctaccaaaaatacaaaaattagccaggtgtggtggagcacgcctgtaattccagctacttgggaacctgaggcatgagaaatgcttgaatccgggaggcagaagttgcaatgagccaagattgggccactgcactccagcctgggcaacagagtgcgagtctgtctcaaaaagcaaacaaacaaacaaaacccaaaaaacactatgctacaatatggtaaatcatactcatgcattaagaagacacagaaaagatcagttgatctgtagaggataaataaggcctctgctggtgaaatagcaagttttttctgggtcatgtgcagactatagcaggctaaatgaacagtaagagcaaaggcagaaagcatggcatccacagtgtatttaaaagacagcaaacagtgaagtgtgtgttgaaagaactatgtgcctgggtggaggaggcggggggtgatgggaagagatatgggagtttggaagttaggggctcaaagagtggactgagaccgaattaagaattttcaatgtcatcttgtgttagcttttatgtaatatgagggataggaaaaggtaaagagataacactactaaacaaggataaggtctgaataaattccttcaaattaaactgaattcttctaagcctactgatctttgaaaaacattttcaaatttcaaacctcccataatgttatttggaagcccttgcatttagatcaaagaatttgtgccatgtggaaaaaaattcctaaaatatgtctatctgaaagatgggatgataacatattaatggaagccagtagaaagagaagctgttaggtttataccccagggaatcctgagaaatctgcaaataattaaatgtactttgtgatataaaaatctgtttataattaatttcagaaattttctgccttttgaaaattctcccttagttaatatatcatgatgttgtttttgttttttaaattttaattggcaactaaaagttgtatatacttatgatatacaacatgctatttttaacgcatgccttactccacatatttttgtagtgagaagacttaaggtatactctcatagcaatttttaagtatagagtatatttttatttacacaatgtacaacatatctcttcaacttattcctcctgtctaagtgaaattttgtaccccttgaccagcagctccccagtctctcatcccagcctctggtaaccaacattatactctccgtttctatgagcttgacttttttagattccacatataagtgagatcatgcagcatttgtctttctgtacctggcttatttcacttaaaaatcctccaggtctatccatgttgtcacaaataacagcattttcttttttaaagatgacttacattgcatcatgtttatgtatattattatctattcctccattgatggtcacatgataacatccattctgacaggtgtgaggtggtactcactgtggttttaatttgcatttctccgatgattagtgatgttgagcattttttcatatacccattaaccatttgtatgtcttcttttgagatacgtctattcaggtcctttgcctatttttcagttgggttatttgttttcttactattgagttgtttgagttccttatatattttggatattaaccccttatcaggtgtacattttgaaaacatattcttccattccttaggttgtgtctttactgttaagtgtttgcttttagaaaaataaaaaaagaggcaaacatttccttaaaatccataaactaatgagttttaaaagaaaagaatgccatccaaactacctaatcagaaaaagactttctacagcttagatcctgtttttatagtattttagaaatgtctaaacacatggcctatgacaaatacttgcctctttttggaacatcaattacttctttgtaacggtatactgatttccttttaaggaataatctctttcccttccagtatagtattggtgagacggtaactccaggttcaaagataaacttggggaaattaggtagataaaaacagagaacatgcaaaaaaataaagaagcacacgaggtgaatgaagaaaaatgtagcaaatttatcagaaagatggaaattgtttaaaaaagttttaatattttctaaatatggtgaacatttctccaatttaaataatcatcagttatttaacactttctatgtgctaggtattcaattcatcaatttattaataatatctccaatcctaattataaccccaagagatagatgttattttttccattttattttatcggtgtgtaggcttaaacccagagaactaaagtaatttgcccaactgttagtgaatagttcagtcaagactgaatctcaaatccagtggaaaataaaatggtatgtccagtataggaagtacaaaacatacaggttaaataaacaaacgttcacatatacctatcaataaagaactccaaaattacatcagtctgttaaaaacaagccactcaaagctctagagttaactaaggtagtaacataattctgaaattaaaatgaaaatatttacataaagttaaatatttttttaaaaaatctttaaaaagtacactcaaacatactgggaaaacatttttcatgggaaacattttaggataatactatctattctataagaaaagagtcaccttcctgaagagttctttgctttcagtgctgttgcctaaattaactttctgttatgaaacacatcacgctagttttaacctagagaataatttgaacaaaaccaagttaaccatttctaaaatacttaaaatacaaagaggtggttgtgtaaccttgaagataattattcagatgtttttaagtattcatctctccatagtattttagatttaattttgtgaatttagcaacaaagaacacagtttagcacaaaatgagaaaacctgttcagaagtgaagaaatcatctaaatattaatagattttattaaatagcagcagaaaacgttatacttggtgttattttcagctatataaatatcttatttttatccaataaaaaacatactaaattcctccatttcaaatactgatgatatcagcaaagtgttcacacatctggatatctttctgtgtttacctaaactgacctttctggtatgtactgtactttctatctcagtatcttcagtgtacatttgcaaaaactacttgaacagtttacattctcccacaccatgctacttcaaatggtcttcaagactttcaaattactgtcagacactgggcattttgtaggcatatacttttgcattcctcctcaagggaaaaaaaaggggggaaagcctagattcaaatggtaataaagtctctttcaccctgataaatacatttaaaaagttgatctcggctggtcgcagtggctcacgcctgtaatctcaacactttgggaggccgaagcgggtggatcacccgaggtcaggagttcaagaccagcctggccaatgtggtgaaaccccatctctactaaaaatacaaaaattagccaggcgtggtggcgggcacctataatcccagctactcaggaggctgaggcacgagaattgcttgaacccaggaggcggaggttgcagtgagccaagatcaccccattgcactccaacctaggtgacacagcgagactctgtctcaaaaaaaaaaaaaagagttgatctcatcctgatgctagagttgtataaaagaagatcttagtgttaactcacaagctattatataaaaatatttgtatatatgtataccaatgtactatgcataaacacatttgaatatagcatgcgtatatatgcaatctatttagtatatttgaatgtatatattatatatagatacatatgcatttacatttccacatttattccaaaaacttagagagaaaatacttaaactgttttcaaaatacaaattctaaatgaaataaaatgttctttaaaaactgtaattaatggctgttatgtcaaactgtgaaccaaaaaggtcaaaccttataatttacagtttgagaggtcatacctcaaattataaccttaaaaaactgattatttgtgagtaatttgacaaatgcatctaatataaactgaatgcatatgaaatatttttgcgagtaaaaagaatgtatgtccaagtggacagctgatggaggaaatagccttttactgaacaaggctgaagtccaacataatgacttggaatgcctttgaataagcatgcaggttggaaggccaaacagtacacacatccaaaagggagcataatgaactatctgatcagaagacaaaaatactccacatatacacccaatgagaaaaaagaaaacacacttcggtcacctcctcttttttcatcattactataccccaattcacgaatgaactctgggctattgataaataatcatcaaaagaaatgatttttataatttaaaaatactagaaattcctataatattccaatctgagattttcaaatgtctatggagatcttctatatcatataaagtaagccaggtttacaaaactgtttacgactcatcttggatgcaaatattaccacacctagcttcatctcaaagccacctgctccttaaaacataatctgaaatactttggcctctccacaatttttaatctacaagtcatccaccattaagaaggcagatcattgaagataattttctccaccgtagactcaattccctaacccaagctagaattgagaaggttagcaaaatagtcatttattaatatatctatgtctctaatatttatttatgtgcttattatatctccctgttagactataagctcaacaaggataaagactaagtctcttttgttcaacagttatctataacatctacaaagtttctggcacagagctagcattccataaatattcgctagaaaatggaaagaaggggttgacagaagaaaggagggaggattgagttagctagtctcctctagtattatttgtgcaattgtggagagaaaaatccctaaaaatgtacactgtatttaatcaatttacccatccaacaattcactgatacatcgatccttgaaaccaaaaagatttaaaatggcttccaaaagtacacaattatacaataaaataaattaaaacagatgaaaaatgaaagggatacaaaatatagttgggaacaggatatttctatacgtatactggtaaagtcagttaaatcacaggaaagagaaggaatttgctttttaatttctccaatttaaccttattgtaactactattataatagtgttataaacactaagcaaatatttactcgttccttatctaaccattactatggcaaatactctataaccaggtaccttatattatgagccaggcaatctattggatgagacaaatattcagttataagaaagtataatatgtatgttataacagtaaaattatagatttttgtaggagagaaaagtaggattctctgaaccaacaaaaatgcttacatggtaactgctgaactatgaacccaatacttcatgtaccaagagatttttctgatacatgtaaatatgcatagttcttgatacacagggaaatatgtggtctcaaatgttaccagtacaaatgagacttgcacatgtaaatcacaatatgataagaaaacacatttgaaaagcattatctttcttgtaagtgaaagcttaaatctgattccacttagcctggtaagtgtttttgtcattccgttgggccagcccacacatactgggctcttgataggtcctgggctcaaccagctggccctttgtgtacttaattctttttttaatactgacgagtgtattagtaacacttccttgatcactggtaaatatacagctaccacacaactaagattttccttaattctgaaattcactaattagttgtgggtacgggttagtattacaaaggtatgttgagtggtactacaatgagtaatgtaattcccaaaaagaactgtgttaatttacttcccacttcattagaggaataaaaaacatcttattatcactaaaggatacagaaagagacctgggtattttagggaatggtagacagggagaaagcatgaatgcagcattgaggcaagaaacacaaatcacctatacatcttggacaatgttcgtgcttcttcttaatactttctgcttgcttcatttattagtgtgtttcatgaaaacattttattcaattaataaacaggtttccaaagaaagcaaataaggtaaatgattcctattttcaaaaacttatcattctactggtacgtaagttatgcattagtcaactctggaagctgcattaatcttttcaagccaataaggtcacaatcaattacttgagatagcagaataaaatacaggcttaaaagaaataatgcagccgggggcggtggctcacgcctgtaatcccagcactttgggaggccgaggcgggcagatcacgaggtcagcagatcgagaccatcctggctaacgcggtgaaacctcgtgtctactaaaaatacaaaaaattagccaggcatggtagtgggcgcctgtagtcccagctacttgggaggctaaggcaggagaatagcaagaacccgggaggtggagcttgcagtgagcccagatcatgccactgcactccagcctgggcaacagagcgagactccgtcaaaaaaaaaaaaaagataatgcaatttccaaaggtgctaccaagtcatttagagagaacatatggtacaattatgagtatcaaaactgggaatttatatattttaagcctaccataaaacatatttactttttttcttttgttggatgagagatattctaacgctgtttattttttcggaagattcagattattcaaagtgtatcagctgattgttatgtgtgttaattcaagcactgagtttaaataatcataactcaactccctaaaactgaagattctgtgtaaggttgggccagtgccctcattcctaggatcaaaccatgtaagaccagacaaaggtctcagagattttggggggttccagtctttctcctttgtccatagacgtgttagggaaaggatgacattttcttatagtacttaccccaaataactaaaatctcaacaaaaaatagataaaagtgcggattgtaaaataggtgttaataattccttaatcaaatcttgtaactaatgaaaaaacactagtttatatgcagaagtaaactgacgaaaggatgaacagaataaacaaggaggaaaagacacatttttaaatatgtaatttagaaactgtcaaaaaaagtgggacatgtcttatttaactggtgtatgagaagaatggatggttttacaggcacataaatgcaggtacagaaaggtaataggagctttgtattacaatggaacttaaactcctctgggcagtgatcagctaagatggaacagagacagttacaatgcaatgattaactagtggacaaagctattatttatggcaggtatgtaagcaattggggcagcaatgttggaggcccctcctcatcaagcagctttgccagtacagactggatgcctggaaccaggaaagacacaaaaacaataaaacctagagccagctaagggagattcaatgcaatccatctccaaattttaaatattactggaaatctacactgaagaatgttttcccttgggattggcatacactgtggttatagaatgttgaccaacacttacctttatttatctcactatgcagagcaatatgcctaaaatacctacttagaaattctcattatattacagaaaaaggagattctaacattagttggcaaaaatttttgttgataggcatgaacatcatgtcattacatgaacagatcattaaagtgagtccatttcattgacagtatatattgtgggtctttttattctgaacaaccaaacaaaacaaacacacaagaggtcattgtgccttccctcatttggttggcagctttatctgtaaaatatgaaaataaaaaactaacatggactacaatcctgcatgtaccattggtacctgcatagtaccatttctgcataagatttaatcaaatattttattcatgttctgaaatcctgatatttgtgaagatggaaaaatacacgggatatttttaactttcaacttcatgatctccagtaaaagtagaaaaataatcatatttcatattatttggttttttgagctagccaaaaaattattagtatacaagaaaaaaggaagttaccactcttcacttgtcttcaggtcttttaatgtaatctcaggaaaaaaacatatttaacaaaaatggaaattatcatgttaaaatctattccactttgaaaagcgatattctttctccctctcagataattttaaatataaacctgaaatgttcataaccaaataaatcgtctagcagataaccaatcaccaaacattaattttacacaatgaggtttctttaatttctctctgtctctctcacagacacacacacacacacacattcacacagacaggttgctaacttgattcttagtatggtaacttaaactcataaccactccaaaatatactttaccttgattttgtgaataaaaataaataatcttatggggcaaggcagggataaaaattagaagtatatttctaactttaatagctaataataaaaagaacagcagaaattactgaaaattatattgctaaaatgtatctgtacatgtggctgtgaaaacttacgtgcaaagagaattctcgttaactaccttcagaaagaggtaatgaaatatgaggtttaagagtacatctttagtacttctgtaccttaaaatattgccgagtattaatttttcatcaagttgtcattttctctgacatttggttttattaatcaaggcatttatcattaatttgtagaaaatatcgtaattaagccaaataaaataaaatccttaaaaggttaaaattagaaagcaggtgaattagaactttgacattaccctgttgacatacaggagctttctggaagtatgagaatgaagtttttttcagtgagtttggtgcctcgatcttggggctggctggtttttaaaaaatgttataaagatttgatttaaacctctctgacagttttgacattcaggtgaaagtactgctgctgcatttggaacaatttgcatatcccactgctaaacggaatgtttgaggtgtgcactggtgtaaagaaattaaaaacaagctatcacacatgcttaagtgtatgtattcacaaaactgatggttggatcgcaccaccccatccccctccaatgtaatctgtgatttactcttctataataaattaccctaccatgttagtctcactggaaaatctaaccatgcatgtaagaagaaaagtaattacagccccctcttgtctaagaagcctccttcaatccctgtgagctctttatacacaatgcagccacacgagtctattgtaaacttcttgcctgaaattctggacttctgactatcagtagccactaaatctcatctgaagagtttcaatgtccccaacaaatacaattttatttcttatagttaattgtaaagctcttcctcaggagaaattgttactgacattctgactttaagccaatatgtctgtttaacaaaagaacacagtttaaaatcatgagttccaaaccagttaaaaaaaaaaaaaaaaaggaggacagagggacataatacataatgaaatagaaggaacaagagttagagcaacacctaattaagctgaaatattcagaaagagtataaaatttctactttttaacttacaatttcatattatttttaggtatacatagaaaaagatatttaatgtgtttaaggacaataaaagaaaaataataaaataaaagaaaagttgaggtagcaaatccaagaccttaaatattataagacaattcaagaagataaagcccattcaggaaaataccactggacattaccttcagccttcagagtcccaaaggcaattcttaacacttctttttatttgtctgtaaaaaaaggaatacttaaaattagaaatctgccaaggaaaacatttgcatttctataatatctttatgacccaggtagctgagtttgtgtatgccaactaatatctatagttttaaaaagaaaactgaaagctaacacattcatatgtgtacaagtactcagtaaaacgtggcccaaatatacaatctaaaccactgcatatacatttttgaggaggcatagcacggtgtttgctatagtatcataagaagttatcttaactcataaggatatttgcatttttatttcatgttttcttttaagaaaagcaaatcccaaattgcttttaacctatttacttgctcattcttattaacagagagttcgcaaagttctatgatgtataatgtactggtcatcactggtgagtttaaaagtatgcaaagataaaacacaagccctattctcaaaatagtaggtaaggttagagatatttgcataaactcagataaaccaaagaaaataaaaagaaaatgggtggaaagaaataaagatgcaaagggtaacatgttcagtacagcttagtacctaaggcattgacattaaaacatggcttaatatttcctgttttagcagaaaggctaatagtagggtcctacccatatttagatgcaaggatgccaaacaaatggatgggttgcttttaaatttctttagtaaagaattgaagctggatgggaacaggcaggatgttgagtttactttaaagccaatttggtgattttgactatagaaagatttaactaaaaacagctctcctattaaaaattgaatttgatgttgtgttcccattagaaaatgatctctctaaatttgctatgaaatctcaatgatgaccttgatgccacatttactaataatctccacagagatttaggcattcaaagtttcaaaagcagttttaataatggaaatgcaatacctaaacatatgcttgattatataatctagtacatctacagtaaaatgcccattaaaattttaaaaatctgaggattttaattgactatatcattaatatgcatgcacagtatttttgcaaacaacaaaccacactagtaaaccaaaacaaacctaaggattggttgcactaatagacaaatagggtccagaaaaggaatctgacactcctgttatatttggggtgcatcagcattattacagttattctgcatcagcaaactaggagggatgctaaaagttagtaactgctaggaggagtgagaccagaacaattaatgatgaagaaataggatgattaggaacagaaaagaaaaaatgttctgatcatagagataaagtggaggacacctttgagaaaattaatttggtaactacatgatatattacaaaagttacttttattaatttattacctgtctcttcctctagaatggaagtaacataagggcaggcactttctctttttcactgtaaccccattttcttgaatagtgcctgccatatactaggatatcaatgaatatgtactcagtgaatgaatgaacagcctaaccaataaaacaggcactaaatctgtatctatttacagatgagaaatttaggcttaaagaaattaaatcatgtacaccaaattaaattgtcattctgcaactacaaacttctacaatgcattctttattcttccattcaatattcattctagcaacaggagaaacagacaataaacaaataaactgttagacttataatgtcatataattagtactatgaagtcagataaaacaagataatgacactgagagttacctggcctgatattttagatagatttggacagggaaacttctcaaaggacgtaagaataataagaaacctgaatcaagtaaagaagacagtcaaaacaaaaaaatctgaaggactggctgggtgaggtggctcacacctgtaatcccagcagttcgggaggccgaggcaggcggatcacctgaggtcagaagttcaagaccagcctgctcaacatggcgaaaccccatctctactaaaatacaaaaaattagccgggcgtggtggcgggcacctgtaatcccagctactcaggaggctgaagcaggagaattgcttgatcctaagaggtggaggttgcagtgagccaagatcgcgccactgcccttcagcctgggtgataagagcaaaactccgcctcaaaaaaaaaaaaaaatctgaaggaccgtttgaattgttttaggattaaataatacatatttccttgcctagtataatggccagcatataccaaacagtgtactcaatactttttattatattgctaatatttttataaattatgtttccccactagattacattgtcaaaggcatttactgttattttccttaaggttccttaaatagtgcctagcaagagctcaataaacacttagagaacaaaaatagaaagacacaattttcagttcattaattagaaaataaacagactacatgaatatgaaaaagtcaccatctttcgtatacctgaatcaatcaaactctgttaaatcaatttcacataatatttcacctttcctaaattaaaaaaaaaagaaaaaggggaaaatatattaaatggctagggccaagaagtcatagataacaaaagaataagaaagaatcagaagaaaattaagttattaacatgaggccactctctttactatttacatgctgtctgactccatcagattaacacatttttccagtgaagggacattgctacacagatatctgattcatttatgtattcctaatgcaagcacaagccttgctatgtaacaaataatcaaaaaaatctttgttgtcctgaaatgaactaaaatgatgtttagtagttttgatgctttaaagctagctcaaaacaataacaacaaaccaggggactgacaaacttaaaaaacaaatttaaatgagaaaacatcaagcattaggtttgagtcctatagcaaagaagcagagaacaaggtaggttctttccaaagagttaaatataagtgacagtgtgatattggcattggaagagatagatcagtagaagaggccaggggaacttaggtatggggtaaatgttacaagtaacatttccatgaacaatgttgagatagctgactgattacctgtggcaaaataaattctgttctctaattcttatcagtactaaaatataaatcaggtcaataaaactcaatataatatataaaacaatcaaggacctctaagaaaatacatatgtataattttctgaactccaatgtgggaaggacttttaaagtacatacacagtggtatataatataagcataaagatttatgatgtttactacttaaaattaaaaattttagcctgggcaacatggtgaaaccctgtctccacaaaaaatacaaaaattagttggacatggtggtgcacaactgtagtcccagctactcaggaggctgaggtgggaggatcacctgagcctggagaggtcaaggctacagtgaaccatgatcctgccactgtactccagtatgggcaagagaacaagacccagtctcaaaaaaaaaaaaaaaaaaagtgtaaggcagaaaacatctttaacaaaattcaaacttaagaggccaataaaaaataaatatttttaaagtgtataatgttcattgggttaagagtctttataaataaataaacatattattctactttttaaaatgagcaaaatacatgaataggcaattcacaatagaattgtgagttctcttctaaaatatggaatgcatttataaatatatttaaacatatataaaatatattttaaactatatataaaatagtaatacttattactatttattattaaataatattattaattctaatacctataagtaataaggtgaaataagaagctaaaatacatatgaaataatattaatctgcaatagcaatgaaagaaatgcaaattaaataaactaaaatattttagaatagtgaactggttagataaattatatgtaataggatattaagtgttcattagacatggcaagtgaaaatatataatacatcattaagcttagaaaacaggttataaaatggtaataatgataacataccataccaatatttaataatttttctctatataatataaatacagactatgcacaacttttggttatgtgcatatgtaagtatagatctgtatgtaccaggtgtgtgtgtgtgtgtgtgcttgtgtgtgcattagaaaaagtatgtatgtgactgtaaaaaacttaaactacattattctttgaatttatcttaagattatgacagtttttttcttcttagaatttgtttccaaattttctgtaataaaaacaaattactttttataaacataaaaagcactaaagaaggcacctagtttatgtttcaggaaagaaaaatttaatttatattattagaattcctgaatgttaagaaagacatttgaaaatgtctatctgtcatttttggtgaaacctttttaactgcatagatttttttagagaaaaaaaaatgtaaggaaggaaaggagaaagggcaggtatcgtgaggaagggaagagaacaacaaagaaagaaaaataggatttataaagataacagcaactactcagaatggtatctattaggttcctagcaaccaaattttaactggtaacatctccaattaaactttcaaagaaaagcacagcctggaatgtagaaaacttaagttggaggttacatttatactgtgaacatacttttacaagagaaaatagatgaaatgttcatcgatttcaatgataggactactgtataaagagagacaaaatacaccatgagaacataagatgctccaaatcagttttggaaataggagtagtataaatttcaattaagtaaaagtttaaagtaagcaaattttaagtagctataaaatcatgctgttcattcccatataagaaattttcaatccatagtccttaacatgtcattcaaaacatatgaccctacaacatatgaactatgacttctggttaattgtttcaatggacattattttgtataaggccttcccaatgagtacaaaatgaatagaaactgttaaagaccattatctattaataattatagcaaacaagtcttcattaaataaaaatttaaacataaggtttaattgtattttattttaaaaggcaaatgaaagccaattgatcatcctgaaagatcataaagaacctgtacagttccatcgtcaagaagacaaggatacattccttcaaagactggaaaagctttaatttcagttcatccataatcatgcatcctaaggtggaggtattcattttggatttggatatattattagagtttttaaaacaccagggaaatctggtaagttctatggtatattctcaaagaacatttcataagattggtctggctaaaccccatactaaagccatctgaaataaagtcaaattccatggagctggagctcgagagcaacaacaaaagaccattcactgactcagttatacttgctcttaggtatttcaggttcgcttctaaatagggggaaaaagtacagaaagattaggtactaaatactgtttttaactctaaaatacaatcaatttttttctttacttgtctgtttaaaagtaacccgagcccttccttttattatgtgaagcttcattctgtttatttttatttcccaagagcagaatgccttaaataaattcttaaaaaccaacacatcaacaaataaataaattaaaactcagtgactataaaaagtacacaatctaacctgcttaattattaacaggtaaacacaatgaacttctaaattatttacttaatccccttcaactaaaaactttaaagtttttgggcttgaaatgtatatcctttctaagggtccataaaacaattatttaaaaatctatttagccattttagtaaaagcaattttaaaataccaaggtaaatatgcacttaaacatttacataagttcataaaaaatagaagactttttttaaatttcacaggtcagtaaaattatttttcttccagctttccctagtcttctgtcagatatttcactccaccatgagcagaaatattcagtactaaattatattagattgatataatagttttgaagtaagcatttatagaatactcttattcctgagtataccataagaaatgtataattatgaaactataaaaatattaataattttgaaacttcaagaaaaaaagaatgaataaattaaaaaatcaccattttctccagataagactggactattttcaccagcgtagctaatcactgaagaaagattgctgcttgatgcaagtaaccattgattacctgaaatgttggttagttaaatgttctggttagctaagggttctagggggaaaggtgtttttgtttttagatcattttaactaaaaatataagatgttctactagatttctctgctttagtaaatagggaattataattttatctttcacttaaaatgaaaaaattatgttgccttagaggatggctcttgaacttttgggaagtcagaagggcctctgggacgatgaaaaaaaaccaagaatcttttttctctagaaaagtgcatatgatcacgaaattttgtatgaaatttccagggatccagagacccaataaaaaccccttgctttctaattttacagaattctaaataactagacataggagattgcactcatacagtaacccccaggacaaaaggagaatgtttgaagttccttcagaagacaggcctaataatgagctattttgttatgatttgtaacctttcttctaaaaggggtgtgtaaaaacaattcttgttaatttagtcttggttaaaggttaaatatgtttcctttaaggacaattgcattacaaggtatttgagctttgaaacaaaatagtgctgctttaaaatcattccacattttagaagtgacagcaattttcttcctatatttttgtaacaatagaaggcagagtcaaagagaaatctatttaattttcatctttacttctaaagattaacagataatagcaaatacatgagcagtccccatattcaggttctgttcaaagcgcttttatttgtatttacttatttaaacctaacaaaaactctaggaggtaggtaatatcatcatacccactttatcaatgtgtaaactaaggaacagagggagtaagtaatttgccaaaggacacccttttactgagcggcagaaccaggatttatgcccccgtcaatctggttgcagagttcggattcctacagaccatgttccatttccagctttaatctttcatgagttcttcaatctttcatgagttgatggtttttcttgtgtgttattatatttaacacaagtctacttcttcactaccatgcaaggaactttcatactggttttcccagaaaaattcatttggtgaattgttcataagatgctgacaaaactggccccacctttgtgcagctggcagttttataccatagtaaatttcccagagtcaatgccaaaaattaaaaaactaaggtaccaccagctagtaagtgtggaattatacaatcaaagctgacctctcatttcctttttggaaatagttttcatgggataaatatgtgaatgattatattccaaaggcaaccaagacaacagtataaatgggcaatattatcataataacttctcaaaggcaggattgtctgctattcctaattcatctgatgagaggtacaccagtcgatacaacttttaatttctagtcctaaatcatttctatgaaataacatgtcaaagtaaaatgcatacttaatgagggccagcaaggggccaaatttgcagtatgactattttcttgaaatatcctcttggcagattgctaccaaagacagcaaccaatttgtaatgcaggatttgcttttagtgtaccaatctttacacattgagtaattccatgaagagaaaaggctgacttaaaaaataaataaaataaataaatcccatccttatggtttgcacagaacaggttttagttataaattcattccatttaatttttattgaattactccctaaaataaatgcaaacaggcaggtaccagtgagacacaagtataaaagggcacaataaagcagaatgttcaaagtcctgtgggtacatgtgcacaacacgcagtttagttacatatgtatacatgtgccttgttagtgtgctgcacccagtaactcgtcattttttaaaaatctttgtccttttctcaaatcctccctccaaagtccaaagtttttttttacattagacctatagacttttatgaagaaattcatttcaatgcagccaagctaggctgggaatgagaacctggtttaatataaaagtatgcctggaataaaatatcatcctttgcctctatctatctctatatcatcctacacaccataataaaacaaatatttggaaataatctagttatttcctataataattcctaatgatttacagtatcaagtcctatatacttggttttcaaattcctccataatctagttccattatatatcctaattccaaataatgcagaaattatactgtctcacccaatgaaataagattttaaataaatatacattgtttcagcaaacaattattgggtttacaatgtgtcatgcaatgttcatgtagctgaaatattttcacatatatatcaggcttttcctatgccctcaacatgtccttcacgatgtccttcctatatagttcagcatgaggtattcgtctctactctgtcaatttctgttaaattcatagtgaactcaaattaattttaactcgagaaatgccagttagagaaattaaagcatgatatataattacaccgaggaaccagatttagaaccggagaagcattgtttctcaaggccgttcttgtcttcatatttcatggtcaaaggtcaatgttgaaaaagctgatgaaagctaatagtaaaactctcaagtctgtacccaagcaaagcacctgatcagtatctgatccaagcaagtcaaaaaaggaaagaagtttgtgtgtaacttttggcttcagactgatatgaaaggcttcatcctttcaattaaggcatagacttttgcctatctgtgatataaaatatattaacagctatagactaggaatttttacatttaagccaaaatacagccaacagagtttaaattttaagtaatttgttaaactaaattaactgaattttcaattataggttttaaatgcttagaaattttccatacgtttgttatagacctcttgttattttctagtttcaaaaatgtgtctttgcataaactcacggttttcaggtttttcacaactgcttcaataagcattacagtaatgctttttaaaacgaaacgatttcctttgctatattattgcccagttgacgttcttatccaaagccagttttgctctctgaatttacttttttctttcttctccccaaaggtgtattgatatgatacacactccttccatttcctggtttaatttgaacatgtcatcctcccacatcataatccagtccatctaccaacaacttatttttcttctgtgagactggcattgatgatggagatcacagggtttaggatgtctcttttcagttattgagcctggcccattcccagtcctaatctttttcttgttaaaaatcaattatacatatatatatttttattatactttaagttttagggtacatgtgcacaatgcgcagtttagttacatatgtatacatgtgccttgttggtgtgctggacccagtaactagtcattttttaaaaatctttgtccttttctcaaatcctccctccaacaacaggagacagctttctttaaatgtccctgctccgtcaccattttctgtgaacaagtctctgctccatcaggatgcacaacaactacccagacccatgtagtgacattccaaataagcttctctttggtcttggagccaaagaaccaagtcctaattcccaatttctcccaaactttcactatctcagtgtattctctcttctcactcttatttctatcaagacacctatgaatggccttctctttcattgaacaacagttgattcagatacaatcaattcaataactctcattttagatcagaaacatacatttatgtttagaaaagactaatcaattgagtacctaagaaaacaaacaaggagctaatttaatgtcctgttcccaagagcactctcacacagacacagaaacaaacatacactcacacatccctacacaccaactgttttactaaaatccagccacactaccttttttgtcttccttcatcaggccatgcttgtttggggcttttgaacacgcttttctacaaggctcttctcccagatcatttcatgatggcttccccttctcatcattcagtcctcaactcaaatggcacgtggttactctttatcccactatccaccctatctgacccaagtcacttttgatcccactgcccagatttcttttcttcacaggatatcactatctgcaactattttacttatttataaactgactcattgtcgattttcctacattaaggaggctatctgtcttattctctgccaaatcacttgcccctaggtgtcatgcctggcacatagtaagcactgatagatctgagtaacgaataaatgaatttacagaaatcgttagccataaatagttttcaagtgcttacaatgtgcaaggtagttcttttttcagttgaatcctaggatgaaaaatgctctgtctctcagcattaatggggcacagtaagtccatttaagagataggtccaagatcaagtggatgaagcttattttgaaaaagttctaaacaaaatatattcctaccacattagacctaaaatgtattaatacataagattaacaacattgttcttctcagctattgtttccttcacacttccccattaaacttttgatatgtcattatgtccttttatgatgtcaaaaacaattgaatggaactgaatgaaagtagttacaacgacacatacccaatttgggacctttactgccaaaatagatgggtcaaaatgatgaaacatggtaagattcggggtgagaccaaaccctgaatctttacatgttcactccctcccacattcatacaatgtacaaatatcctgactatacctagccttgacaagcgttctaatgcctctacaggtgaaaacatccattcatttaaaccaggacctttatctataaagtgccaaataataaatattttagcctttgcaggtcataaagtttctgtttcaactactcaattctgctactatagtctgaaagcagccataagcaataaacatataaacaaatgaccatggctgtactccaataaaactttgtttacagaagggggtgggatgcatttggcaaaccctgatctaacccatcagtgaagcctccaaagtttatatatggggagatttagaaagaaaatttgatcagaaagtgtgttaggaggacttgtgttagaatctgcttttctgtgatacacattttgcttttatatgaaatatatgtgtatgggggggttggaaaagattacgggaaaactgaacccctcaggtcactcttatcactgccgcctaatcctgcaatccatttgagggtgttcttggcattacattttggccttctatagattcatcagctttctctgcatattttatccatcagattatttatatcgtaattctacaattatttttgaaaagctacaacaaacactcggttgaagttcaaaatatacattccccttaaccatgctaattctgcattctatttcaaacattattaattttgtcaggcaagatttgtttataataaactcatttttttcatcgctcatgattcctttgtcttcaagatgtttactgatttctcttacaatgttttatgagaatgttgtcagataccctgtaagccattcaacattacatttacatctattataacaattctttctccctcaaaatcttttaggtcttccaaatttcccaattggaatatacctttatccaaagtataataaatacacctttacctgtttctggttgatagctactttcaaaaggtattttaaacgcattatatgtttttcaaaattgtgttttaacaccaaaacagccacacaattaaactaaaatttagtaaagattctaaatgataacacactgtcataagatacattacatattaattagcaatgttatcattttctattctccatcttatagtttctgtaataaatcctactgccaatcagctttcattatcagcccgtctaatcatgataaccaataaattgtactctatgcttctgacatccaattctgctttatctattctagctatagtgtcaaaatatttttgtagcttcaactagggtttgacaaaaatgctaaaactataaaatctaaatgtaaagtttaccattaaattatatcagcatgtcatacaaccatgatttttaaaataaaatgagaaaatacataaagtaagattttagataacatgataaagtctgcttcagtttgattcagtattcaataaataaaaccacttgagaatcccagtaaaagtaaaccttgagatggttgaaatatccattttaaataacgggaacttttaggtaattgtctctatgaaacaagaatcaggcttttgaggtcataaaatgcttgaccttcccaggtacaatgaatgcagaaagcttactactaagttacacaataggggtaagactgttgaatctatctgaaaaattacattttcaaaagctccacaaagtaactgattcattaaagaaataattggaaagattctttctctttcctcatatgaaggagaaatcacaaaacgttgcaatattttcaaaagaggatgaagtgctcacatttcacttgtgaggtttcaatagctttattacctatgctcttgctgtttgttcagcatgctgaagaaaagtatttccaaaataacataggtttgctaatccttggttcctgataatatcacatgataggataggagctttcaaacacagtcaagctgacagtcacttgctctgtactcagagggaccaatttctccctgtagacatgaatacagcacaaataataaagtgccaaaagttgagtgtaagtgcaaacccttcaacatcactcaggtatcagcaaaaagtacctgtttagctacatgtagaagtcaggtacaacatgttgaaagggagggaagattagaattgaaataatttatctgcctctgctagtttatctgcatcactgaaaagaattaaaccaaccttgccaaaggtaagtcttgtctaggtacaaactgtcttatcaatgccatctcatctattccctatcgtcttctttttttttctttttttgaaagaaactttttatttattgtttttttcacattgcaagtgatggtatccagtttctttttttttttttttttaattatgctttaagttctagggtacatgtgcacaatgtgcaggtttgctacatatgtatacatgtaccatgttggtgtgctgcacccattaactcgtcatttacattaggtatatctcctaatgctacccctccctcccccctcccccaaccccatgacaggccccggggtgtgatgttccccttccggtgtccacgtgttctcattgttcaattccccacctaagagtgagaacatgcggtgtttggttttttgtccttgtgatagtttgctgagaatgatggtttccagcttcatccatgtccctacaaaggacatgaactcatcttttttatggctgcatagtattccatggtgtatatgtgccacattttcttaatccagtctatcattgatggacatttgggttgattccaagtctttgctattgtgaatagtgccgcaataagcatacgtgtgcatgtgtctttacagcagcatgatttataatcctttgggtatatactcagtaatgagatggctgggtcaaatggtatttctagttctagatccttgaggaattgccagactgtcttccacaatggttgaactagtttacagtcccaccaacagtgtaaaagtgttcctatttctccacatcctctccagcacctgttgtttcctgactttttaatgatcgccattctaactggtgtgagatggtgtctcattgtggttttgatttgcatttctctgatggccagtgatgatgagcattttttcatgtctctgttggctgcataaatgtcttcttttgagaagtgtctgttcacatccttcgcccagtttttgatggagttgtttgttttcttcttgtaaatttgtttgagttctttgtagattctggatattagccctttgtcagaagagtagattgtaaaaattttctcccattctgtaggttgcctgttcactctgatggtagtttcttttgctgtgcagaagctctttagtttaattagatcccatttgttaattttggcttttgttgccattgcttttggtgttttagacatgaagtccttgcccatgcctatgtcctgaatggtattgcctaggttttcttctaggatttttatggttttaggtctaacatttaagtctttaatccatcttgaattaatttttgtataaggcgtaaggaagggatccagtttcagctttctacagatggctagccagttttcccagcaccatttattaaatagggaatcctttccctatttcttgtttttgtcaggtttgtcaaatatcagatggttgtagatgtgtggtattatttctgagggctctgttctgttccattgctctatctctctgttttggtagcagcaccatgctgtttggttactgtagccttgtagtatagtttgaagtcagttagtgtgatgcctccagctttgttcttttggcttaagattgtcttggcaatgtgggctcttttttggttccatatgaattttaaactagttttttcccaattctgtgaagaaagtcattggtaacttgagggggatggcattgaatatataaattacgcaggacagtatggccattttcatgatattgattcttcctatccatgagcatggaatgttcttccatttgtttgtgtcctcttttatttcgttgagcagtggtttgtagttgtccttgaagaggtccttcacatcccttgtaagttggattcctaggtattttactctctttgaagcaattgtgaatgggagttcactcatgatctggctttctgtttgtctgttattggtgtataagaatgttcgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctgtatttatttctcctgcctgattgccctggccagaacttccaacactatgttgaataggagtggtgagagagggcatccctgtcttgtgcccgttttcaaagggaatgcttccagtttttgcccattcagtatgatattggctgtgggtttatcataaatagctctcattattttgagatacatcccatcaatacctaatttattgagagtttttagcatgaagggttgttgaattttgtcaaaggccttttctgcatctattgagataatcatgtggtttttgtctttggttctgtttatatgctggattacgtttattgatttgtgtatgttgaaccagccttgcatctcagggatgaagcccacttgatcatggtggataagctttttgatgtgctgctggattcggtttgccagtattttattgaggatttttgcatcgatgttttcatcagggatattggtctaaaattctctttttttgtggtgtctctgccaggctttggtatcaggatgatgctggcctcataaaatgagttagggaggattccctctttttctattgattggaatagtttcaggaggaatggtaccagctcctccttgtacctctggtagaattcggctgtggatccgtctggtcctggactttttttggttggtaggctattaattattgcctcaatttcagagcgtgttattggtctattcacggatttaacttcttcctagtttagtcttgggagagtgtgtgtgttcaggaatttatccatttctgctagattttctagtttatttgcatagaggtgtttatagtattctctgatggtagtttgtatttctgtggaatcgatggtgatatcccctttatcattttttattgcgtctatttgattcttttctcttttcttctttattactcttgctagcagtctaccaattttgttgatcttttcaaaaaaccagctcctggattcattgattttttgaagggttttttgtgtctctatctccttcagttctgctctgatcttagtgatttcttgccttctgctagcttttgaacgcttttgctcttgcttctctagttcttttaattgtgatgttcgggtgtcaattttggatctttcctgctttctcttgtgggcatttggtgctataaatttccctctacacacttctttgaatgtgtcccagagattctagtatgctgtgtctttgttctcattggtttcaaagaacatctttatttctgccttcatttcgttaggtacccagtagtcactcaggagcaggttattcagtttccgtagttgagtggttttgagtgagtttcttaatcccgagttctagtttgattgcactgtggtctgagagaaagtttgttataatttctgttcttttacatttgctgaggagtgctttacttccaactatgtggtcaattttggaataagtgcgatgtggtgctgagaagaatgtatattctgttgatttggggtggagagttctgtagatgtctattaggtctgcttggtgcagagctgagttcaaatcctggatatcctttttaactttctgtctcgttgatctgtctaatgttaacagtggggtgttaaagtctcccattattattatgtgggagtctaagtctctttgtaggtctctaaggacttgctttatgaatctgggtgctcctgtattgggtgcatatatatttaggatagttagctcttctttttgaattgatccctttaccatcatgtaatggccttctttgtctcttttgatctttgttggtttaaagtctgttttatcagagactaggattgcaaccactgcctttttttgttttccatttgctccgtagatcttcctccatccctttattttgagcctatgtgtctatgcacgttcttatctctctttctctcctaaactttttttttgtaataatctctctctccacctaaacttttcaacttctctctctttctgtcttttttactccctccactagacatacccactctctctcacaaataaatactcactgtatgatgctaactgctaacttaaaggagatgtaattttatcactcacatatgattattgatgtgaaagtgcaagagtaaatatgtcagcaactgaaaaattagggcaacatgatccaaatcaagtgctaaatatattaatcatatacatactatgcacttctatagaaaaattattaggctataagcaatcataaagattagcataaataacctaaaaaaactattaaaagtcaagacagggagattcagctgacagagttgtatctctctttcttttcatataaagagatattcagtatgatgttgctaattaagaagtgaaacaagttagaatgaaagctataaagggaaatctctgggtgtcagacaaaaagaaagaactcaaagccagagcagaaggtggggctgaactcttggtgtccccctagagcaccatagccacatatatccatatatttgtccgcagtgtggggaaacagacaaagcctgaagccaatgagaggagtggaacagaagctgagactcccacttattaatggatgtcccctcacgcatctgtaagatttagactagaaaagtctataggtctatagactagcccagagacagagtaataaaactagaaatcttcttagggttctgggggaaaaaaaaacatagaaaatgaaacccagatacgtgccatgagtgccttaggaatcagcattgcattatttgggacagaaaactcaaagctaaaaattaacacaaaaccaattaggttttctgtagaccagtacaggcacagatcatgggtcacagaatagaaggaaatactaaattactttggaaggacccaaggcactcacagagaaaacaactttcttcacctgagaatgagctaaccataggatcaaaaactgatactcttttgttcaattcaacatctacctattaaatgcttttttaggcagataatattttagaccctgaagatatattagtgaataaaacataattcctgtttatactctcatgaggaagacaatgaatacagaaatataaaatataatgttcagtactaacaaatgccacaagagaaaagcagtacaaaagaaaatagaagaagagatggagaaacagatatgtagaaaaaatatttatagaaagactctaagaaggtgatatttgagcagaaccctgaacaaagtaaaggagtgagtcatgaggcagaagatacatcaacaggaaagaatacaattagtaaagatatagaagatttaaattacatcattttgaactaactgatgtgtaaaaacttcaccttttgaaaattgcacattctttccaactaatgtgtaatatttataaaattcaaccattatgatctaaaaagaggtgttaacaaataccaaagaattggtattacaaaataaggtatctgaccacaatggaataaaataagaaattaagatgaaaagatagattaaaaagccctatatatttagaaactaaaaaaacattcataaatattccatgagtcaaagaagaaatcataattgaaatattaattatttaaaatgaacacaataaaggcactacatatcaaaacctgtgggatgcagctaaagtggttcttagtggaaaatttatggctttaaatgcatatattagattttttaaatacgtaaaattaattagtttaggatctcacttagcaagttaaaaaataatagcagaataatccatgtaaaagagaaggaaagaataatgattagaacaaaaattaataacatgaaacaaatgtacaatagagagtatcagcaaaaccaaaatttgttctttaagaagaggtgtaatatattaggctaaaccatattattttttcagtattcaacccatagtaaaacttatgctgatcaaaaaatattaatcattaaatatttaagaaagaaaatagaggcactgattagaaactttaggaataaagagaatgtatctcaaacaatataggaaagatttaaaataacctgagaatatactaaacaactaaatggcaatcaatttacaaactcaaatgaaataagcagtttcctagaaacatgaaatgtaagaaaaatatgtaattagaaatagaaaacctgaataaatttatgatcaataattgagagaaaaaataatctcctgacaagttacatctcacatggtttaacagttgaatcctgccaagcctttaaggaatggataatcgtagcctgatataaactattacagaaagaaaaataaatatccaaacttcactgtcttcttacttttttctcagagcacttagtgtcttagtaatattttcacaacaaacttagcttaaaagtatgtaacagatccattaatttagtacttaggtctaaacaattaaataagtatttttgtcccagcaatacagccatatagaaataataaacacaaatttttaaaaattatttttacttcattcttatatagccatctttaagtttattattattgggatgtgtgtgcctgtcaggcactgcacaacttttcaaaccttgaaatctgattggacactgccacacttatttcctgttctatattgattttcatgcagtacctgctttctatgacagcaaccacaaaaaccaagcttcacgaagacatgacaccatcaggatgaatttactgaaatcccacgctaaaactgaactattcagggtagtgtctgacctggtgtctgacagatgttgaatattgctacgtttctcttaaaaattttaaatagctcatggcccacctgtgagttcactgtggccctacaggagtgccttggaacatagattgcaaaccatggcattatggtgagaaatgacttatgtaaatttttaagtaaacaaaactgcaccgaatgttcatggataagtgtgtgcgcatgtgctgcatgaaatgaaatgaaaatataaaaatagtaaaaatatgaactgaaagcatatgcattaacttcagaagagtggttacctctagggacaaaaggtggaactgtaaacacaagggaacttcaactatttctgcaatgactaatttctgtaaaaacaaaattcaagcaaatatggcaaatgctaatgtttttaaaatatgggtgatgggtatttggtatttattacattaatttcgtgccttattatacttttgaaatagttcataaaagaaaataagaaatgacaagcattgtgagttttcaaaagcttcatataggttgctacttttagcatgccattctaaatcccaggacatctggttactgttagacctgcttttctagtttccatttagaatcattaaactatccattcagagtagtcttaacatttaaagacaaaaaatcatataaagacccctatttcataagcttcaccctaagtcacaaatgctgcttttatttagtaactttgaaaaaatctcagcagaaatcagatataagtgctttctattcacttcttcaaaatatacttattttctcatttcagttattgaaaataataccatagtatgatagaacataacatgtattcatttagtgctatcccaaaccccacaaatctctggtctattgcaagaaatatactcattttcaaacttagtattaatatatttattttgtaggatactaaccaagtcaaaaatgaaactacattgaattaactgatgattatgccagatgtacattaagtttgtgttagtcacgtatgccagttcctcacatccatctcccctttaccttctcccaaccccaacttttcaaaataaaattaatattattcattagaagcaggaaactatagagggaatgtcagcaaatgtcagaagttccatgtatcagtcaaggatcaaagaagttccacaataataacatgagctacaataataaagtaaataagatagcaattatcccaccttactctgaactggccagatcatggcacatgtcttttattatgaggacactgccttatcaaaaagcctaaagagaaaaacatgtagaatggtgagaaatcttatttttttcttttcttttttttattattatgctttaagctccggggtacatgtgtagaacatgcaggtttgttacataggtatacatatgccatggtggcttgctgcacccatcaacctgtcatctacatgaggtatttctcctaatgctatccctcccctagcctcccaccccccaaaaggccctggtgtgtgatgttcccctccctgtgtccatgtgttctcattgttcaaatcccacttatgagtgagaacacgtggtgtctggttttctgttcttgtgttagtttgctgagaatgatggtttccagcttcatccatgtccctgcaaagaacatgaactcatccatttttatggctgcatagtattccatggtgtatatgtgccacattttctttatccagtctatcattgatgggcatttgggttggttccaagtctttgttattgtgaacagtgccacaataaacatacgtgtattttttataacatacacatatgtctttatagtagaatgatttataatcctttgggtatatacccagtaatgggattcctagatcatgtggtatttctagttctagatacaagataaaaacaaacaaccccatcagagagtgggtgaaggatatgaacagacatttctcaaaagaagacatttatgcagccaataaacatggaaaaaaaagctcatcatcactggtcattagagaaatgcaaatcaaaaccacagtaagataccatctcatgccagttagaatggtgatcattaaaaagtcaggaaacaacagatgctgaagaggatgtggagaaataggaacgcttttaccctgttggtgggagtgtaaattagttcaaccattgtggaagacagtgtggcaattcctcaagaatggtgagaaatcttaaacagtaggggcagttgaggcaactagagaggtttaacttggaaaacagaagacaaagagagaaatctccagtatcaccatgtttttggtagagtattatgtggagagataatcaggtagttacaaatcactggaagacaagagcatggatctccaggaatgactgctagatccacagtgtagaacctttggggtgattaaaacgttctggaattagatagtggtgatgtttgtacaaccttgcgaatatgctaaactctattcttgaaatgtgtgaaattttatggtatgtgtaaaacaaatttttaagtgtccattagattcagtaacatgattagtataatccaaataatacatgaaaagtcaaaaagcaaacaataaaaacaatggtttccaaagaaataaagtaatttttcaagacagattgaaatgttaggaaagagttttctttttcttttctttaaaaaaaaaatagtgaagggcttgaacaagttcgaatgttgataacaaaggagtttacaaagagacaaagcatgaagacatagaaaagataaaattaatcaatactgcaaaatttctaaaaaagtagaattagtgttcaaaacataggtaaacagattagtctttttaagtggtaggttaatttctttttacaaaacttcatgaaaagaggataccactagctagtcccacccagctgacccaggatatttacagattttatcttgggatgttaagcatgtacttagatggatgtgtctacttttttttgactagatgataatgtagtctgctggggagaagaaggagcaaaggtagaaagggtaaataatttgttcaacattagccagctagaaatggatagatttcatttttgaaatcatttatttttttaggatatatttaaggtgctcagcatgttttgatataactataaatagtgaaatgattactacagtcaagcaaattaacttctttttattttgaagtgattatatacacacatgaagttgcaaattagtatagataggtcaaatttacccgttacccagctttccacattggtaccatcttacataaccatgtacattatgaaaatgaggaagttgacctagtacaataaaataaacaacaaattttatttggatttcatcaatttgtgcatgcactcattttttgtacgtctttgtatcacatgtattgatataaccaccaaaaaaatcaagatacaaagctgttgtgccatcacaaaagaatttgtgacctctttatatgcctgaccttctgaaacctctgaaaataactagacttaatcataagagtaatgggaaactactgaagagtattaagtgataaagtcacatggcagactgtttcatgtttccctttatctcaaataaaaacaggggtgcataactgaagaaagaagaggcattagaatattatttcaataactaaggtaaagcatgatgatgtagaatagaatagtgactctagatatgcagcagagtggataatttcaaagatgtagattcaaaagaatatggtagttaactgaatgtggtagtcaggaagggatcaagctgagcttacctgacttggatatctgggttggtggtaatatcattcacagagatgtgaatcatgagagaagtggcttggatgtgctaagtttatttctttatatgtcaagttacttatgggttattcaaatgaagatgtctagaaggtaatttggtattggagtctgaggttcaggaagaggatcttgtttaagataaagatgtggctgtaattgatccatatatagtaactgaagccagaaaattgggtaagatcaatcagaatatggtatcatcgaagtcaagagaaaagaatgaggatagtggagggaaaaggaggggaaaggaggggaggttggggaggggaggggagggaaaaggaggggaaaggagaggagaggagagcagaggagaggagaggagcagggaaatgaaaggaggaaggaaagggaagggaaggggaagaggaagggggaaagggagagggagagagaaagggaaagggagagggaaaggaaaggaggaaggaaaggaaaggaggagggaaatgaaaggaaaggaaagggggagggaaatgaaagcaggaaggaaaggaaaggaggagggaaatgaaaggaaaggaaagggggagggaaatgaaagggggagggaaattttcagggcaaaacagaaagaatggaaggacagaaagatggaagagaggaaggaaggaacttgcacaaattgagggcacatgtaaaaacttcaaatatcatgtactcattacatataatttgtgctatataaaacttaatgcaaacttatcagcttttctttctttaaacctactttttttttacttactgtttttccctcgaaaagttctttattcttagaaggaatttcctcaaatatttatattcgataccaatattttttctaaaatgaaacatctctattttcttggcccaagaactgtggtaactagcttgaaaacagtgctatatatttgttatgtcaggaaaaatatagttgaatgaagtgttctctttcccataaagaaaaaagagtttcaagctacatttaagttttctttatactaccacctctccaagcgtttcagctatcattgttttttaactgcctctataatatacaatatgcagccaaatatttggagatattttggtcaaaaggtatgttagcaacaacaatagaaataataaaacaattctcaatgataactgaagctattgcataatttaaataaaatggaaaaagtcagcatcaactttgaattcattggcctttgtcaatttatgttgcaatgttatatttgtttaaggcataactctgaattcatttaatgacctagactatttagtgttggactttcatttaaaaaaaaaatagcaaaataaaatgccatctcgtagagtgctatttaccatatgagatccatctggcaataccatctaatatttaactttgaaggcactgttatcaaatagttgctctaaagtgcttataagaggcaaattcttctggtttttcttctaaggcatattatattactgataattttaggataacagatctgaatgtagatgattttaaatgttgattacagcacattatttaatattttaaatattgactaattcatttttaaattatttgtaaattagcagactatttcttttataaaattaaatattttgtattctcccaccccaccgctagaagtctttaaggggaatattataattttaaaataaaggatttaaagtaacagtttcctgttagttttgtggactgttttcttttccagtaatattttgagtccagttcaccataacttaccaataccctttcacattgcccaacccctagaaacacttaacagatttttctctccataggttggctatattcaaaagaaacattggcctatcaggacctctcagtatccatgttgtggacaagaccaaagagaacttaacactttgaaaacagctactttaccttatgtgcgactcataaacatttaactcagtgttactcagtgatgtgctgccaaaagtaatttaccaggttccaaatgctatatatctggataaactggtctccaaaagcaaacaaacaaaaaacctcattatatatttttaaagaaaaatgtggcccccactactaggtcagcagagaattctgagaatatataacaagtcctatgacttcagtcccaaaagctctggcacaggaaaacactataaacttcttgcaacaagagaataccatcaatactagcagggacatgcttatgtctacatttaggtgaactagcaaaatctttcatctgatatgtactaaattcttgaccattacgaggaaaaaaattatatctgaagtggcatattctaaacctgatgaatttcccacaaatcaaaaaaaaaaaaaaacaaatttctcacaagttaaaaaaaggagcctatatttcaaactattacttgtattgtaggcttctgaacaattttattatactcttcagtgttttccaggtttgttaaaataagcactttaaaaacaggaaaaaataagtttgaaaagataaattctagcactctattcctacaagataaagaagtcagattactcttttatatccaatggaatacatgaattagacttataagatggttggaaacacaccacaccacatttaatacacattccagaataaacttcaaataaaaatatgagctgttgaccaatagcagtattataaatttaaaatggggagctttttttaaatcacatattaaaaaagaagaattgggaaccatgtggaagcaaagagcaatttaatatacatacacaagtttagggattttttttttaaagagaaattgagagtcaggcattaaaggtatacaaaatttgtgtctcaatatattaccaattaaatattgaaatgtaaaattgaaagcacaacacctacactaaaaccaaaaaattaaataaattcttcatataaaatctaacaaaatatgtataagatctattatgaagaaaactacaaaactctgatcaaaggtatcaaaaaagaactaaataaactgagagatattccatgttcatggatagtaagactcaatactatcaaaatattacttcttcccaatttaatttttagattcaacataatcccaatcaaaatcccacaaagttattttgtggatattcacaaactgattctaaagtttatatggagaggcaaaagatctagaataggaaacacaatattgaagaaagagtcagaatgctgacactacccaaccccaaggcttactatatagctacatgagtcaaggtactgtggtatttgcaaacatacaacttagatcaatggaacagaagagagaggccagaaattgacccacataagtacagtcaactgttctttgacaaagaagtaaaggcaatacaatagagcaaaagtcttttcaacaaatagtccaataactgaacatccacatgaaaaaaaatctagacactgacattaaattcacaaaatttaactcaaaataaatcatagacctaaatgtacaatgcaaaactgtaaaacttttagaagataaataggagaacatctagttgatcttgggtttggcaataaggtcttagatataacaccacaagccagatttatgaaagaaataattgacgttagagtttattaaaattaaaacttccatatttgtgaaagacaaatcacagactagaagaaaatatttgctaaacacatttctgatattcgaccgtcatccaaaatacaccaaaaactattaaaactcaagaagaaaaacaacttgattaaaatgtgagcaaaagatctgaacagacatctcaccaaagaaatgcagatgaaaaacctgcatagaaaatgatcaacataatatgccattagagaattgcaaattaaaacaatgagatatcactaaacatctattggaacggctaaaactcaaaatactggcaacaacaattgccgtcaaggatgtggagaaatacaaactctcactcattgctggtgggaatgcaaaatgctatttggcactttcttaaaaaattaaacatacacttaccatatgatctagcaatcatactcattggtatttcattgaaaattatgttccacaaaatcctacacataaatgtttatagcagcccaatttataattgcaaaaaaattggaggcaacgacgatgtctttaagtaggtgaatgcatgaacaaatttctacatccatacaatggaagattattcagcactaaagagaagtgagctattaatcatgaaactatacagggaaaccttaagtgcatactgctaaatgaaataaaccagtctaaacagctatatcccgtatgattccaactatatgacattctggaaatggcaaaactatagataccgtaaaaaagatgccagggtttggaaatggggagggataaacaggtagagtacagaggatttctatggcagtgaaagtaatttgtatgatattatgatggtgggcacataacatcatgcatttgtcaaaatccattaaatgtacacccagtgaaccctaatgtactatagttataataatgcatcaatattggttcattagttgtaacaaatgtaccaccatagttaataatggggaaaagtggggaggagaagggtgaatgggcatacaggaactctactttctccccaggttttttttttgtttgttttttgtttgtttgttttttgtaaacttaaaactgctacaataattaaaggctattgttttagttaaatccatttatttctaaaatttaaaacaggaaacataaaacaactaagtttaagaagctgagtgtggtgatatgagcctataatcccagcaacttgggaggctgaggtgggaaaattgcttgagctcagaagtttaaggttagcctgggaaacatagtgagcacgcccctactaaaaaacaaaacaaaacaaaacaacaacaaaaacactaagtttaacaaatattatgtttgcaagtgtcaggtgacaggcatgtttcatttttttcaatattacctgtctagtgaaatcaaagataaatatgtagctgaattttacttactgtgaacaatcaggtggtttgaatttctcttttcagcagtagaaacaaacgttttggaaatcaatatggatttttaaaaactccaaaaaacattaatttgtatttattaatattatgtcttcattattatattgtcagaacaaaaggattcaggttatttataaaatttttaaaatgtgtgtttttatctaggaatatagtcattttaaaattaatgctactgtcaggatgaaggcagggagctctgatacttttcaaaccacctattctagcacttgagatctctgcagaatttgggcctatactgtcatgagaacttgggatttcaatagatctgctcgtggtttcaatctctagttggtctgcaaagaaattaactctgtgctactgcccaaaactatcccccaactttcaaggtttcctgccttgaaaacatgcacattttgtcctcaaaagagtacagaaaggtacctataaaacctgcactgctatggtctaaaatgaccaaaaagatgccttgcctataatctccgtatatgcaagactgaacattacattacatggaagtattctgtaaccaagagtctttgcctttaaaacaaaatatttttttttccttagaggatagctatttggggacttagcaaaactggacaactctcagaaacaagtttttcttcagtagaacacacactagggtttgtgcctcttttctttgttcagttttatacatgtataaaggaaagacaaaaaacaagagggtctttcatttttccacagttccctttcttgggtgccattcctctcattgttcatagatgaatattcagcgtattcttctcacacagaacacttggccagttttttcttttgctctatattaaagggcataatatttctttaactgaggaagacatatttataatataattttggattaagatttttatttacaaatcatttcatagaaagtttctctaaatttttagcaagagatatttggctataattggtcagatttatctgtcttcatttcaaggatctctatggtactgaaatttctgtttaaagaattttaagtaagttcatttatatacagttcatgcaacttatttacttatcccccttcaacatgccagccatttctttccaaatgttaaacagagttactaaaagttatgtgtgtgtatgagtgtgtgtatgtgtgtgtgtgggcctgtttatgaaggagaagcagagacagagggaaagtgggtagtcattgtattcaagccaacaaccccatttcaaaggagagggattcttaccctgaaaatttgttttcaattcttcacttttaaattaatacatttagaaaaggtttaatagaatgtggctgaacctcaattaaataaaaatttccacctcttgattttatttttttgttgtaattaattggtcattgggtttatctgtatacattttatctgtatttgtatttattgtatgtgtatttgtatttatttgtataaatttatctgtataaatttttaatgaccccaaatatatcatgaaaacatttaaatgttttcctttatctaggaaattatacacatgtttgaaaaccaaacagtttatatctgactagatgtttagttgctattactattttgaacttggaatggacattattttaaaataagttatttgtaaagaactgagatttactgcatcctaccttatgtcaggtactcatgtcttgtctcaaatcatgttctgaacatctctttgcattaatataattaatcccagtttacagaagacaaaattaagaaccaaagagagagagtaggtaacaatcaaggtgattcaggacttaactgacaaatctatcaacttctctctacctctactgctgccttcttagttgaggtcactgtgatttccatcctggaccactgaaccactgtattcaccttctaactggattcctcactaactgccttgataattccaatccattctgcaccagaagcaggtttattatgggactgtgtcatacttccctggcttcccatttcatttagggcaaaattctatgaggtctgtctctccatttctctttaacttcatttcaatctactctctttttagctcacagcattctacccacgttaatgtcctttttgttcctagacattgccaaatgttttttttttcttttttcttttttgttattgctttctgatctactataaaatgcttttcttctatggaggcttcaaacatcctattccttgccctggatttctgcatcactggatccttcttatcatttgagtctcaacagaaacaccacctcttaaaatggtcaccctctgattcttgcccagacctttgttagttactgtcagaaaaaaataacttctttatgtacaatgaactagtttgcttgtttgtttgtttgtttatcatctattcctccactccctctccattccccctccatagtaggacaggaatattctattttatttactaccctcatatagtttctagcacttcgggtactgaataaatatttgctggatgaatgaagtctttgttttctccactctaaaatgtgctcatattaattaaatatagtcataaaatttatccagttggatatatatatatatatatataaccatttgtccttagtaaagcttgaaatatgtgaaatcatggcacttcttttttttcccctgaatattatttcttggtcagaacattatcttcctccttggcaaaaatatattgtgcctttatgttttagcaaagtatctcaaagaatcatataaccgtagcaaaatggagctgaagggcaccttagagcccacctacccctatcatgcacctggcacctgagcctcttctacagcatcaagtggccactgagacataccaggctggaggaactaagtaccttttaaggcaacacatctaattcttagtgttttaatagcctaatatttgtttagcgttttggtactaatacattccaagtttctgctgtctactgacttttcactatttgttcccttagatattcatttgaaatctttttagtttaacctgatttagctgtttctttttattaaaaaaaactcgaggtaacttcttttctgatttaatgtagcaataccagaaaatcccttttgagtttagtctttcagattgttagtaaacttaatgatgagaataggagtatttgttatttttctgcaaaatagttctatctatatttctttctacttctcattgtgcaaagtctgttctttcattaagacactgtaattacattatagtcagtatgttttaagtaaaattctgagattcctttactttttcttgagtcgtctaaaaaaatatgttttgataaaatcaagtgaaatatcctttatgacttcaacttcttctggaaatacttgtcctctatatattttatcacttaatttgccaattatgtctactccttttgaataaggaggaaataccattttctgaaataaaaaaaagagaaagagaaaaaacagaaattagagaatattttaaacaatgtgttttatgtgttttttaaatgtcatcaaactcattcttcaggactttactcataataagctgttcaatgaatacttatttaacaatcgctctgtgttctattacttatccctttttctcacttatatgctcaactttttattctttataagttctttcttcttagcatataaacatgcatgattatctcccatcaaatatacataaaaataagcatacaatagaaaagaaagaaaatccttttttgaagatttgctctgttaccactttcttctctattatttctagtcaaatctttgaagagagtttttacttctttacccctcatcctgtttacagtccactgaaaactgacttctgcccttataacataatttaattattcccaccaagatcgcaaatcacaagacggtcaaatccaattgaatatattttgacttgaccttactttatatctcagatgttttgacattcttgacaactcctttctttcaaaaacactgtcctctcactggcttcatactttttggctcttctcctgcccttttctcttcctttgcaggctcttctgcttcttcttgaccctatatatgggttcttcttctgctttccaacagtctcttgctctcacatcatccttttccttgagtgattatattcacatcttcaacttcaaacatcacctttattttgatgactctcaagtctgtagctcctgcccttatcacagctcttctatatctctccagttgtatacatactgctgactatggaatatctttagctgaatgccccatagatacttcaacttatgacatatcaaactgcagtttttaaatcttcactccaaaatgatatttttctgttattcccgtctcttttaatggcactgtcatccaccaaggggatttggaagaaccttgagttcaagccctttcctttgtttccctacagttgccctgtaatctgtatgctgagggttaaaggcagggctaggagaaaatatgtttctattagatgagatgtatcatcaatattcaactggtattagaaaaataaccataaaaatgctcctgataataagcagctaaaacataaagaacatctttttgtaagtaatcgtgaacaatgtttgagagatagaaggatcattcaataatctaaaaattctaaacataattttacatatgaaaaaacagtcctagagaggaaagataaatgtctaatataaaagtaacttaatgaaaaagtgtggactaaaatctagatccacttctgtaagttttgtatttccttggtattagaagtaacttactcctccctgtccctgatctatgtaatggcaaacattttttcttggtaggagataaatcaggtcattacaagcatagaaagcaagatttaaacaaagtatatctgtaatacaaatttctgctagtagaatgtacctacattttaaaaagtgagagttctttctcagctgctttctaagtaatttacactatttatgctcccaccaatcctgtatatttcctatatgctcacaaaccatgaatattatctaatttgtaaaaccttgtcaatctgataaggaaacttagtatgtgtgtatgtaagattgaatatttttatacgttattggacacatatttttatgaattatgtttttagatcctttgaacattatctactgggttatttatatttcttgttcttgaattttcttctgtttcttggataatgttttcttctggaatgtattcttcaaatttttttaatgctatatatttttgttctgtattatttttacagttatgtcatctcatttgaatgtacaatcactatatagcccttaatctatatggttaaaaattgtgtgagtaaaaactctttgccactctccccaccccatctgaattcagattgacttatcctgtaagcttttattccaggactaaaattttgctttaacaaagccaataagcccaggtgcttagtttctcctacatacctattctcccaacaatgctttctcatcccctttcaggcagtgagaataaatccagtaaaataattacgttctatcacattattagtccagagctggcaagtagaggttacatatgtgcatgttcatgtgcctctacaccagcttcctcttcctgagatgactaggtatttactgtgatttgaatgtatccctcaaagttcatgtgttggaaactcaatctccaatgcaacagtgttgaaaggtgggacttttgagagatgattaggtcatgagggctccacactcttgaatggattaatgttatcacagcagtagctttgttataaaagcaagtttggctctttcttgctccccatttgatgagctctttcaccatgtgatgccttctaccacgttgggatacagaaaaaaggccctcactagatgcccaacacccttttatagggcttcacagcctcgagaacagtgagcaataaatttttctttatacattacccagtctgtggtattctgttatggcaacacaaaataaactaagacagtattatgtattttttcttttgttttacattttactaagtgccgacttattcgaaaaggtaattagctttggttaattatcaaagttttgtctttcctttcctacttttgtcccactaagcaaaaaacaaaacaatgagcattgacctttacctttctctggtaagggagtatggaaggttttctactactttgtaaaaatactgctacagatggtacttctggacccatgtggaacctgggggtccttgctgtcctgaagagaagtacacaggcctggctggcttttccacttactgattgtagaatctcaggcattgagcaaatataggcagtagccagggagcagttacatcaggccttaggtgaaacccactgctgtgctggcttcaggtctgacccaacacagtcatagtggtgatggccacaagggagcttgggttactccaccctgcaaaggagcttgggtcactctgagctttgcatagcttagagcagagaaagaaggactctgtattcttgggagaaaacaaggaaagagaacaagagtctctgcctggtaatcaagagaattctcccagatcttagccaagaccataaagcttatacctctataaatcagcaagaaccacagtgttattaggcttgggatgcccctaaagtagatatttcttagatcacaacattcaggtcttttcaaatatctggaacatctttccaagaagggcggctacaaataaacccagaaggtgaagactacaataaacacataactcttcaatgcctggacaaacatctataagcatcaacaccatccagggaaatgacatgacatccccgtatgaactaaataaggcaccagggaccaatgctggagaagcagagatatgtgtgacctttcagacagagaattcaaaatacctgtgttgaggaaactcaattaatttcaagataacacagagaaggaattcagaattttatcagataaatttaacaaagagaataaagtaattaaaaagaggcaggcagaaattctggagctttaacatacaattggcctactaaagaatgtctcagagtcctttaacagcagaatggatcaagcggaagaaagaatcagtgagcttgaagacaggctatttgaaaatatacaatcagatgagacaaaagaaaaaagaataaaaaacaatgaagcacacctacaggatctaaaaaatagcttcaaacaggaaacctgattattggccttaaagaggaggaagagaaagagacaggggtagaaagtttatccgaaggaataataacagagaacttcccaaccctagagaaatatatcaatattccaagtacgagaaggttatagaatgccaagcagatttaacccaaagaagactacctcagggcatttaataatcaaactcccaaagatcaaggataaaaaaggatcctaaaagcaccaaaagaaatgtaacaaataacatacaatggatctccaacacatctggcagcagacttttcactggaaactttataggccagcagagagtggcaggtaatatttaaagtactgaaggaaaaaatcttttaccctagaatagcatatctggtgaaaatatccttcaaacatgaaggagaaatgaagactttcccagacaaacaaaagctgagggatttcatcaacaccagacctgttctacaagaaatgctaaagggagtacttcaatcaaataaaaaaggatgttaatgagcaataaaaaaatcatctaacagtacaaaactcactggtaatagtaaatacacagaacaacacagaacattttaatactgtaactgcagtgtataaactgctatctcttaagtacaaagagtaaatgatgaaccgataaaaaaaataaatacaactttttgagacatagtacagtaagatacaagtacaaataataaaaagtttaaaagctagtggacaaggttaatgtgtagagtttttcttagttttctatttgcctgtttgtttgttcatgcaaacagtgttaagttgttgtcaccttaaaataattgcttataagatagtagatgcaagctttgtggtaacttaaactttaaaaaaatacaatggatacacaaaaagtaaaaagcaagaaattaatcatatcaccagagaaaatcatcttcacgaaaagaaaagaggaagaaaggaaagaaggaagagaagaccacaaaacaaccaggaaacaaaaaacaaaatggcgggagtaagttcttacttatcaagaatacattgaatgtaaatgaactaaactctccaatcaaaagacacaaagtggatgaatgaacaaacaaacaaaaaagatccaatgatctgttgcctataagaacacacaatacctataaagacacatacagactgaaaataaaaggatgggaaaagatattccatgccaatggaaactaaaaaagagcaggagttgctacacttagaccaggcaaaatagattccaaggatgaaaactataagaagagacaaagaaggtcaccacataatgataaaggggttgattgagcacaaggatataacaattgtaatataggtacccaacactagagtatccagatttacaaagcaaacatttttatagctaaagatagagatagaccccaatactataatagttggagactttaacaccccactttcagcattggacagatcttccagacagaaaatccataaagaaacttcagatttaatctgtgctatagaccaaatggatctaatagatatttacagaacatttcatccaacagctgcagaataaacattcttttcctcagcacatagttcatactcaaggatagaccatacgtcgggtcacaaaacaagtcttaagacattcaaaaaattgaaatattatcaagcaccttttctgaccacaatggaataaagccagaaatgaataccaagaggaattctggaaactatacaaacacatggaaattaaacaatatgttccagaatgacaagtggtaaatgagtaaattaagaaggaaacttaaagatttattggaacaaatgatagtaaaaacacaacatgccaaaatctatgggatacagcaaaagcagtactaagagggaagtttatagctttaagtacttacatgaaaaaatagaaaaacttcaaataaacaacccagtgatgcatattaaagaacttcaaaagcaagagcaaatcaaacacaaaattagtggaagaaaataaataataaagattagagataaatgagtagaaaatgaagaaaataatacaaaagatcgctaaacaaaaagttgttttttaaaaaaaggtaaacaaaattgacaaacttttagacccaaataagtaaaatcagagatgtaaaaggagacatcacaactgataccgcagaatttaaaggatcgttagtggctgctataaatagctatatagaaagaaatagaaaaatttggaagaaatggataaattgctagacacatgcaagctactaaaattgaaccaggaacatatccaaaacctgagcagaccaataacaagtaatgagatcaaaaccataataggaagtctcttagcaaataaaagcccactacctgatggcttccctgctgaattttaccaaacctttaaagaacacccaatcctactcaaatactctgaaaaacagaggaggaggaaatacattctaactcattctatatttgacagtattaccctaatgttcaaatcagaaaaaggcacaacaaagacacatttcggatcaaatggctttgatccaaaagacagtaacaaatgctggcaaggacatggagaaaagggaacccttgtacactattggtggaaatgtatattagtacaaccactatggagaacagtttggaagttcctcaaaaaactaaaaacatctaccataagatccagcaatccctatatgtgtgtgtgtgtgtgtgtgtgtgtacactaaaaagaaaggaaatgagtatattgaagatatatctgcactcctatgtttattgcagtgatatttataatagcaacctaagtatccatcaacagatggataaagaaaatgcagtatttaaacagaatgcagtactattcagccataaacagaatgagatcctgtcatttaaaacaacattgataaactggaaattattaggttaagtgaaataagctaggcacagaaagacaaacttgatatgtttgaacttatttgtggaagctaaaattaaaataattgaaccatagagataaagagaaggatggctatcagaggttgggaaagatagttgtttggggtagggggagaagtggggatggttaatgggttaaaaatagttagaaagattaaataatacctagtatttgctagcacaatggaatggctatagtcaaaaataatttaattgtacattttaaaaaaactaaaagtgtacaattggattgtttgtactacaaaggataaatgcttgaagtggtggatactcgatactccatttactcttatgtgattattactcattgcatgcctctatcaaaatacctcatgtaccccataaatatatatacctactaagtatccacaaaaattaaaaataaaaataataaataaatatttttattgagtttttttctgtgaattatacaatctcctaggctcttagtctgctaggagatgtagcgatgaaccaaaaagtgctcttatggatcttagggtatactagttaacgtagaagggttgctctaaatttcaaagtgtctgtttatcaaagcatctatgattatcggtgtcttttttgttttttgtttccttattgtttgtttttcatttgagtacttttctcattaaaacactagcttaagcaacatgtcaaggagaaagacaagacaatacaaaagacaacaaaacaagctcttcactgcattgcctcacccataaacttataaagtggctgtcactttataaaaggctaagaaaagctatttcgctgaaaaccttattgactgttttaatgacatcacatttgtagttctgttatgaggaaataaatcatggaaggagtgaggagaagtttagcaatagttgtggtcttacttgctgtgtggtgggtctcagatgccctatatgctatgcaagtagaaatcattgcttatcattttaatgtaagtttgattggaatgtgactaattacataatagttatacaaaaaaacatattctagatcagctaattaagcaatataaaatatgttttgtgcacaaataaagaaacatattgtttcattcctataagatacataaataaagttattttggactgataaatatttttttcaactttcaaaagttccagggtacatgtgcaggatgtgcaagtttgttacgtgggtaaatgtgtgccatggtggtttgctgcacagatcaacccatcacctaggtattaaacccagcatccattaactattcttcctgatgctctcacttcccccaacccaaacccctgagaggccccagtatgtgttgtccccctccccatgtgtccatgtgttctcattgttcagctcccacttataagtgagaatatgtgttgtttggttctctgttcctctatcagtttgctgaggataatggcttccagctccatccatgtccctgaaaaggacatgatctcatttctttttatggctgcatagtattccatgatatatatttactacattttctttatccagtttatcactgatgggcttttgggttgattccatgtctctgttattgtgaatactgctgcaattggcataaacgtgcatgtatctttataataaaatgatttatattcctttgggtatatacccagtaatgggattgctgggtcaaatggtatttctgcctctagatctctgaagaatctccacactgtcttccacaatggttgaactaatttacactccccccaacagtgcaaaagcattcctttttctccgcaacctcaccagcatctgttgtttctggactgtttaataattgccattctgactggcatgagatggtatctcactgtggttctgatttgcatttctctaatgatcattgatgttgagcttttttcacgtttgttggctgcataaatgtcttccttgagaagtgtctgttcatgtgctctgcccactttttaatgggattgtttgttttttcttgtaaatttgtttaagttccttgtagactctggatattagacctttgtcagatgggtagaatgcaaaaattttctctcattctgtaggttgtctgttcactctgatgatagtttcttttgctgagcagaagctctttagtttaattagatcccatttgtcattttgcttttgttgcaattgcttttagcgtttttgtcatgaaatccttccccatggctacatcctgactggtattgtcagattttcttctagggtttttatagtttggggttttacatttaagtccttaatccatcttgggttaatttttgtataaggtgtaaagaaggggttcagtttcaattttctgcatatggctagccagttctcccagtaccatttattagagggaatcctttccccattgcttgtttttgtcaggtttgtcgaagatcagatggttgtaggcatgtggtctcatttctgagttctctattctgttccatgggtctatgtgtctgtttttgtaccagtgccatgctgttttggttactgtagccttgtagtgtagtttgaagtccagtagtatgatgcctgcagctttgttatttttgcttaggattgtctttgctttttgggtgctttttgggttccatatgaattttaaaattcaacatcccttcacgttaaaaactctcaataaactaggtattgaaagaacatacctcaaaatagtaagagccatatatgacaaacccacagccaatatcatacagaatggacaaaagctgggagcattcccctttaaaaccagcacaagacaaggatgccctctctcaccactcctactcaacatagtattggaagttctggccagggcaatcaagcaagagaaagaaataaacatattcaaatagggagagaggaagttaaattatctttgtttgcagataacaggatcctatgtctagaaaagcacatcatctcagcccaaaaccttcttaagctgataagcaacttcagcagtctcaggatacataatcaatgtgcaaaagtcgctagcgttcctatacaccaacaacaggcaagcagaaagccaaatcatgaatgaactcccattcacaactgctacaaaaacaatgagatacctaggaatacagctgacaagggaagtgaaggacctcttcaaggacagctacaaaccactcctcatggaaaactagaaaggacacaaacaaaaggaaaaacattccatgttcatggatagaaagaattcatatcacaaaaatgaccatagtgcccaaagtaatttatagattcaatgctatttccattaaactatcattggtaaatctttttaagaaaaatttatagtataaattaatagtttaaagatggcaatttttatttagatagatcaaaaaaaatgctgtcacagagagatgtgaattgaactacctattgaggaagtatgttatcattaatgctttctcacaatttctttcatattaaggattttaaaaagttaaattatatacaatttcatttgtatcatcactatagtttctttatcaaatatgtgttgagtaaatgctgtgtttcagacattgtgctggaattggagatataatggtaatgaaatgaaggatgcctcatggatcttacagtctaattgaggtagaaatacaaatacacatacatatatacaacacatatgcacatactaaataatcacacaaatatatgaatatttactttcagataatgttactaaattgtggttatttctgtgctggcaagaaacacccagtttcttgaaatttacttttcaatgacttcttccaaatttaatcctgtttatgcctaaggatttttgttgttgtttttttaatctcttaaagttgcacattgaatcactgctgatttgtatgcatgaagttaccaggacttctaattttgtaccaagtttatatgtgctaatattttccattagtaaagaagactgaaagatgcctcagttgcctggaatttatgccaccaaggaaaaacagtgattagtgtgtttaaagagttagatcattgggttaatcatgctttgccatagtatcattgctatcctttaaataaaaaaaaaaggtttagttagaaaattttttaacaagataaaattaaccacagactataacgaaaagtaatttcagcaggattatttattctcccaaagttgaaaaaacaacaaaccaaaaaaggtgtatatgtgacatctacttaattttttaaatatgattatttccatcttttgttctttgatctccacatgagcagagacacataaagtggcaatggggccaagggtgctagatggcttggcattcattaactatggcaattagcaccatttagattgatatgttcccaagatgaaagtaagaattggactagacaaaaaaaatgatgatcgcatttgtgaaagtggaacaacactgaccaacaagaaacaaagaaacagagctcaccttaaaagacttggaatatttgaaaaattgattatgagataagataatttcaacataactacaattccttgaagagttattaatgcttcggtagcattaaagtaaaatgaaaagacaccagggcagtctgctttaatagcttgctggcttgaaccctaatacataatgttcttgtaatagtttatgggtgactgcagtaaattggtagtgaatgtttttcatttttttggctcttcatatcagatctgctcttggagaacattttgttctgagaatattatgaaggcagttcatctactttagaagttgcttgacaattttaatacagtgttaacttttctcccctccagattgtgtgatttttttgtcctttgtacccgacatcaatttatggtttgaaattcagcaatttgctcagttatactttacctaccctgactaaatattttaagtgctgccacaagaaaagaaaaaatctaatttttcccaatgttgttgttacccctctctgtttatatagcagtttaaatctgcccttcatcttgacagagaaaaaattttagatggattaattttgaacctaaataatttgttgacaaataatttatgatcatattcaggggttgttttgaggtaaaaagaaaactgcattgaatgaattataccaagtgaaatcatggtattttaaacaaaatgaggtttataattacctgggatttagtgaacaaaagtatgtgatgcagggctccctgaagaatttagtgcatgtcctatgttttagtgcttcaagcagcaaatattatgtatatacaataaaaaaggaagttgcagacttaatacatactgaaatggtctcaatgttaacattagactcatgaaaaattagcggacatctaagtactttattcgttcttttagtctttgctgtacctaggaacatttgtttcatataaaagttatattacaaaattaatggactgagggtggaaagagaatttgaaagaatgtgaaataaagtctggatatatactgaatgcaggtggaagatgtctgaggaacattaatgacaataaagagaagtctcttcctaagttacagacatccaaaaccaaaataagagccaatgtggttacataaaactgcaaagaaaatcttggttggacagagaactccgaagaggtagtaaaaggaaaaactgagcaaactagggaagacaaatgcagagaaaagttagaaataattagagaagaaataaaatgcttccacaaaaataagaacaacaaaaattcaggagataaatgcagaacagtccagctaacagaaaaggatttttgaactgtgtatgcaagaagcagacagcatgattggaaatgaagtatttgctctttcctctaagagtggaagaacaagacattcctgggcagcacaactctgcgtaggattagttgcacttcctcaaatgtattttcaagcaaaaagctgaaacccaaatgtcttgagccaccagaagtacccaggctcttatgtaatacaggctttagtgttttattgcttattcaaaaagacaaattatattttaaaattgatatatgtgtgagcatggttatgctacacctataaattaccaaacgtaataccaatagcagccaaccaacagtttagcctcagtattttcacaacagttcaaaatgttttgttaaatcccatgaaagtagcttcagtgacaaaggtttcagatctttgcaaatgataattaattcagaggcatataatgggaaacactacagtcaggtctagacaggtttagataaactaatggcccaactagttatggcagctacagtttttaacttcaagtaaaggaatcttaaagcagttcaaggaagaaacattttctttcttttcctttttaaaacatttaattgtcttttttgaggatgataaaagataaaatctagagactttattgtactgtactcattatagtctctcccctgcctcatatgtaaatctagtttgcttcttcatgtttattcatctctactttaaataaacatattgtacatatactctatacacacacacatataatacctattctcttccatttatgcttacattgtaagtcttttaaacatttattgaaacatttttgttggattgactctacattgaatagctttattataaatgaaagacttcccttctattaaacagaaatttcttttaataccactatgaggcagaacattattgctatggtataactttgtacgatcgaatgtcctactggttagatctgtgagttaatttaaatttttacaggctgttagatggagtaaaaggcaggatacagccatggactgtaggttttttatcctttagttacttctttaacttttaatttacattaatggacaagtttcatctagtctaattttatgtattacttgagtctttcctcatatttttggaatgccatttttaatttagagtgttttctaagttaaagtcttaattgttcttttcctgaataatagcttgcatgaatacaaagaactttatgtttgaattttggatttagtcagcttgatttttcactgaaatcaggcctaaacatatgaagttcagcagcaaaaacaaaagcaagcttacttactgaaaacgcattgtctttctataacaagcttactgtaaagactggggtagtatgtatatttccatagatacatatatatagtatctgtgtgtacacatatacacgtaaagttaagaaagtttgtaaaaaaactacacatacgcaacattagaaatactgttaaatatttatgtgtaatgaagctgttcttttcaatgatgtcctacattgtaaaggttttatttaaaaatttttatataatgaatgcaaacttgagtcactgttcaaacatgaatattttctcaaatgaacatatttgcatgtgttatgctatataaactgagttctgtaaaaaggatcctttttcttctgctaccaagaaattctacttttataattcaaacaatctactctctcccacactcaaaataagtcatcattacttaaaatatgtgtagtgtaacaatggaaatgtttgtatatttgtcaaactaaatattatgttaaaatattttatacatttccactgagaatgctcttcttagttaaaaataaataaaatttaaaaaaatttgaatggagacattttgaaagtggctattccaggtaggataaatatttaatttactccatagcataataattttaggaatcacttcattttgaaaaattattctgaatactagcaacattttggcctttaagacactttattaacagttttgaagaaaaagttgagacatttgttcaaaagatttgaatctattcacataatagttcagacaatctccatttttaaattcctaaattttgaaaatttaggatacgtaaaaaagataaattaaggaatgatggtttaccacatggaaaaagtattatttataaaaattttaaaagtataatttatttacaaaatttagttatttaataacatatataaaaagactcaagttgatattctaaaacatacttttaaacaaaaggaactgtctattacataatgaaaatttatgcaaccaaaatgagtattattctttgcaaagtagttgccttgggagacagttctttaaacagtatagctattgctctaaatattgcacaatgtgcgaacaatgttgaccttcagtgccaacaacatatcattttgaatattttcactgacaactgctctttaattttcgttgctttttagaaatagtcaagagtaacttagagccatgtttacctgacagagccaagtttattgccatagcaaaacctggcctgtatagttatagaaatcccttatcttcatttcttcacctccaactctacaatctactccaatttgttgtcctttgcctcctctactcccttcaaactaatctttctaaggctgtaactatctgttttcagtcaccaaatgggcaatcatttaaaaaatattatggaaatgataaaagccatttatcttgggtggttttgtgcagtttctaaaggcagtttcaaaagaggtaagtaactttgatagtgatagaatcattggaataaatatattaccttcactatgacaaggatatttggatgtttaacttttggatatctgatatgtattttccattcagtgcagtatttattgagcacctatattatgcaaaacactgtgcgagatgctgagacaaaatatgaagatgaagaaacaatgagaccagccctgactcatgaacaaatagtgaggtaaggagataaccttcaatgactctactgtgagacagatttaagtgttctcttggagttagaatgcactatataaatagagagggaagaattcattttaactgaagcatgacagttaaattgtgcctagaaggacagagattgaaaccttaacaggtagaaatggaagaaagaactaggaagaggaagtaagttgttcaatgtagaatagggtttctatctttttttaaaaaatggacagtttactttctattcatagcttacacagtaaaactgtgcttgtttcaactttgctggcactacacaatatgcctagattcaattctgttgaatcccataaactctctttttttgttttgtttttcattccatctttctatgcctgtgccccatgtgttctttctcagctctcatgtctgtgtctttttcagttctgcatcaccttcttttcttctacatctgtttctcacctttccctgtctctgctatcccctctcgtagtcatctttccgtcttgattgccataaggaattgaaatatgctatacttctctttgacaaatccaaacttgaataaactcttacactatggagttttcaacaaatccttactctttgtacttttttccttttttaaattgttccttcccttcacttaattccttgtaatctgtccaaattttatattctcctcccccacttttctcccttttctttctctcctttttgattcttacactacactactggtgtactcagaggaaaaaatgatgctaaaataaagaaaatgttctttacaatcagaatattattaaccagtacttccaagcataactagttcaatcataaaagttcatttaagatttcaatgattccaacttatatctctttatctctttttgagtcaagtattaaatgactagtacttcaaagttaaatgtattttactgtataatttttgagactgatcatttatatttgatatctatatctcatttcataactatactacatggtctaatgtatagcatatggaaagtttttgtagcttacctcttcttgcaagactaaatgagaggactactgttggcagaaagcaaagttggtcaaggccaaaaataggactgactgttttctttagaccctccctttttcttccttgtaataatcttgaactcctagattccagtttttcctttatttagccaataaatatttactgaatcctaactattttccaggaactatggtaagtgctattgatagatgtattaggccttctttgacacggaagagcttacaacctaggtggagagggagaaacataactgcaatataaattgataaggcccataatgggacgaagaacaggctactatcctcattatacatctggtactcagagacctctacgttattccttggattttccccatacttgcaacccacctttttatcctcctcattaaaacttacctgttattgaatcccattttcccttaaggcaccccttttggataggtgctttgggaaaacaatcccacaaattaactcacactggatattaaaagagtaaagcatatacctcacatccctcttgcattttaacaagtcagtccatttgaaaagaactggttgctagtgatgggaatttcaagaactgtacagtaggccattagaaaagtaaaactttcctcatacacttcaatcacaacagagaggggttgaccgtacaacataaaacttccttttagatgccctaacactattattatttaaacaacatagcagctacatattcactaagaaaatacaattgaatttaattgttgttagtagtagtagttaccgctagtaactactgttactaaaatagaaattatatatcgatttaaaattataaaatttgccttattctttctttaacttttattttaagttcaggggtacaagtacatgtttgttacataggtaaatttgtgtcatgggggtctgttgtacagattatttcatcaaccaggtattaagccaagtatccattagttatttttcctgatcctttccctcctcccaccttccatcctctgatgggcccagtgtgtgttgttcccctctatgtgttcatgtgttctcatcatttagctcccacttataaatgagaacatatggtatttggttttttgttcctttgttagttcgctaaggctaacggcttacagccctatccatccatgtccctgagaagaacacgatcgcattctttttatggctgcctagtattccatggtgtatatgtactacattttctttaaccagtctatcattgatgggcatttaggttgaatccatgactttgctattgtgaatagtgctgcaatgaacatacacatgcatgtgtctttataatagaatgatttatattcctttaggtatattctttgatattattatgaagattcacatgaaatagcaaggaatggttttctagttggaaaagtatgattcccacaataaaagtaataaaatataataagaaatatttacatatatcaagaaaaaatgattcatgggatcacaaaataaaaattatacaaattgaggaaagccttatttaatataatgtctttaggaaaaaaattagtatctgtggacctgggattcctcccctgtaaaatgaagggtttaaataagaaaaactccactttcttgcttccaggcttaacacatatgtgaatcatttgcataaatatttctcaattttcctactacatgaaattttagttgctacaatatcacaattaggcagtctgcataaataaaggagtttctcttatatttctaaatataagagaaatatataaaatatactaaaatactaaatatataaaatatttaaaaatactaaatatactaaaatacagtactaaaataatgcctaacacaaagtaactgccttagcataatttaggtggctgattggatggattaaagcttggattaatagaaaaacacaatgatgcaaatgtgaagtcaggtatatgtctacacatctaacaacatttaatgagagacactgaagacccagaaatgagtatttttacaggcttacaaataaccgatgttcaatttgggggtcaaaacaagaaatagagaaaactgaagtaagttaggtaaggtccattttgactaggattatttctggcaatttcccctcatctactttctgcaaattcatgcatgttcactgtactgtgcttactgacaatctgtaccaaataactcctggcagtttgaaatcatttcatctataacatataaataccttatttgcttcaactgtacaaatgctggaccccatctcaccaaagttttctagaatttaattgttcttcacctaacatctttaaaactcaatttattggtctgtaaaacagtaagacctacattatagagttattgtgacaatcagacggactcaaagcatgtcatagtttcacttacgtatctaccaacccactatcattagccttctacttgagaccaacccctttacctaagtactaaatgtggtaatccttgaagtctctgggacttttctatacaattatcatttttctctgcttgacttcaatgtcttctctgctggctctttatttttcaaaacatgtaaatcatttgtattctaacattaccttgactctgtgcctctttttaccaacaattctccctcctttcatcacctgtgtatattgattaaataaacaaaaaacaattcaaagtaattttatatgaaaaacattgcgggaggaaaatagaataaaaagcaacagtaacaatataaaaaaaaaatcacctgttgtcaaccacaggcatttcttcccaggtgtaatatagttatataaaataaacttgtcatcagaagttttgaatctcagtatttttgcttaatattaaattttatatagcattaccttttctaaaaaaagtgttaaaatagtattttaatgactgcataatatcctatagtaagaatgaaatataattcatttattcattcctacatttagacatttaggtactgtcaaaaatttttgctactataaatggttctgataaacatgcttgcagataaatctttgcatacgtctctgaatatttctacaaaataatcttcaagattggaaattattgactaaagtaaaataaacaatgtgaatagcttttacctttctgacacaagcttaaagtctttgttctttcattaagggaaatttttccatttaaatttatactaaaaatattgtgttattgacaaggcaagtaaagaaaagaaatcaatgctactgaatcaggcactctgatggatattctgtctcttcctattcaacacattttcctttggcaatctcttttcatgagcttatcaactaccaatgtattgatggcttccaaatttctcttcaggtatgaattctcctttgagcttgaaactcccatgtccaaaggcttcttgactatatcctatggtgtgtcatgcagtcctttggattctgcattaataaaagtaaagtattcttacttcacaaaatattctgtaaataattacccaattttgttaatcaagtcatatggaagacaatgcataaatatacaaaataaagaataagaaatgtactacaaatattcagaaagcattaaaatatgtcaaaatactgttacagatatatactaataaaattgaaaatctcaggacataatcttctaagaaaatatacattttcaaaattgactctataaatggaaaattttaacaggccaataaatttaaaaattaattaagaaaggttccagaaacaggtggttcaagagcaaattctatttaatttcctttttcaaaaattgatagataaaattctatgtattttccatgtataacatgtttttaagtatacataccttgtagaacaactaaatttagctaattaacacatgtattacctcacagttatttctgagtaaacatccattcattatttttcaagaatacatgtattattaactatagtcatcatgttgtacaacagatctcttaaacttattccacctaattgaaatgtcatatcatttgaccaatatctccttaaaccccagttttaatagaaaattgaatttcattaagttttcaaggatcaaaataaacccataacatagtaacaaaaacaaaatatttccaaattcattttctgaagctagcaaaagcctaaaacagtacagcaaaggaggctactgagcactgttacttcactccattgaattaggactggatgcaagtgtaaagcatcagatttatagaacttactataaaaaactctaaaatatctcattaacattttcatattacatattaaaatggtaatatcttggctatattgttttaaataaaatacattattaaaattaacttcatctgtttctttttactttttaaaaatgtagtcacaagaaaattttaaattgcatatatggctcacattgtattcctattagtattaatatagataattttgcttataaggatacaaaacttctcagcgagttaaatataacaatatattaaaaataatttgtgatgaccaagaaagttgaaagttttccattagaatatctactaatatatatgataaatttatataagtatgattttaaaaacaataattttgatagtgctgaaaatgcatgcaataaaaatcaaccacaattcttaattttaaaactcttaataaactatgatgaaactctttaatgtaatgaagaatatctacctataaaatggttgacactacacctaatggtgaaaacattagtggtattcccagtgaagccaagagaaaaacaaactcttgctagcacttattattataatttggaagctccagcaataccacctaacatgaactataaacatgagaaaggagtagaataaaaaaattaagaaataattagaacttataaatcagtaacctgcttgtttactatacacacacacatacacacacacacacaccaaaaacagccatttaaaaatgcaaaggaaagaacaatctcttattaccaatgataaaaaataaaaactacatagaaactaacactacaagaaaaatgtcagacttatatggaaaaaatgtttttctaagtaatgttaaaaaattttgaataaattaagacatcttccagatgagaaacctctatgtcaattctccctaaaacagttcataaatttaatgcaaccactctcagaagtccaataaaattgaagggggggggcagtggtagagagaccttgattaaataattctaaatctcttataaaaaattggttaagaatagccagtaaccttttaaaatgaaaaatactaaaaagaaacttttattagcaggtttaaactgtattgtaaaagccacaataaatagtgtagtcctagtaaaccatatagaaactgatagaactgaagagaaaaaataggctggaaatcaaatagaaagacaagaaacaagcctatttgtaaattaagtatttagcatatgataaataatgcattttaaatcagtgggaaaaacatagattttttttcaattgatggtgctgagacaactggttaaatatttagaacagagtaaatttagagcctatctcacactgtatatcaaaataaaattccagatggtttgaagagttatatgtaaacaataaaaccataaaagaaatagaagcaaatacagaagaatttttaatcttatcttgggttggagaaggtcttcctaagcataaaagcaaaggcagaagccataaaaaatgtaatatggtttttaaaaatagaatatttgaacacataaaaatgaaaggtcagtatagcaaaaacaaatgaaactaaaaggcaaacaataaatttagaaaaaactatttgcaacatatgacagagtatcatatagcagctgaaaacaatgtcctatgaaaaataattaaggacctgggaaaaacaactagcacatagtgttaaacggagaaattgttataaaacagtacatacattattataggaactttgtaaaatacacttacatttgggtataatggtttcccacatataccatgtttataatttccatgcttttatacatatagtcccctttgactgaagagatcctccttccttccctgtctatacatctcctattcatctttcaagcatcatttctgacatccctttagacaacaagaagtcttctttgaattatcaggctggaatatgtgcccttcctttgtttgcccatagtacattgttgtacaccatcaaattaatgctatttaatattatctgtttacatgtattactccacccctatgattaaagttccttaagagaaagggtaatattttacctctttctgcatgctcatttcctagtattatatctgtcaattagtacacattcgaaaatattggtttgaattattgctaaaatgtcttctaattaagattattccaaaatgaagctaacatcaatagggagacaaacaacacaagaggcatcaaactgtataagaagtctgaaagaaaaaaaagacttaacgtcatgagagatgattctgtcctcattttcacgttaaaccagaagcttccttcagggtacagctcaatgagtcaccctagagtattctaggtatatattgatattcctaaaaatctaaacatatgtaccatatacaaaccgtgtcccacaatttatcacttaaagtttattgtttttaaatgatttctcatttatgagtcttttctctcattagacgttaatctctgttatgtgaagaggtcatgccttatctaggcagatatcctacaaagtgtttggctaagtaccctagtactttaataaaaattcaatatgcacaaattttctatacagctttaagtaattttctgtttttatttacatacatcccttcataattttctaagaaaatcaggatctactccaatttcctcattacccatcatcatccagaatgatgaagagatgtatagattattaagaaaatatttgcgtttgctgagtaaacccgatattatctaatcaaaagaacagcttcggctgtgctgctcctagctgtgctagtccacacagctttcccagttttcatgaattagtggaggtaatgttaaaccacttttctagtaagagtgcataaggatatttaagtgagctcatccctctaacaaaggaaagaataattttcattaatcattattcaacagtacatcttcttgaactaaatcatgagaggaggaacttatgatgttttttattagtcaaaacattttctatatatagcttagtatatgcaacgtgccaaattacagaattctatttactgctaatgtcaatttaccaccacattgcttgatataattcaaagttttccaaggagctatttgacctcctatagactgaaaataaaatcatgagatttaaattacttaatgccaaaaaggaaagtcatctttttctccttcttatgtctttgtttcataaaactattatcagacagtccatgcaaacaactaaaaacaaaaaattatatggtgtagttaattgaaaaaatgcttttgctacacacagaaattgacactaagtgctgtattagaaggaaatcagtgattttcaattgacattgcacaggaaatcatttagtgtcaattgatattaaatgggtaaaattgtactgaattagtacaaaatgatttggtggaaaaaaatgtgcttccattaggtgacttgatattaagtgggcttaaatgtaataagttttagaggtcactagtcaacaaaaattggggcatgctattcaaccctgagtacatcagactgcttgctcttaataccctcatcaaaagataagttagtgtcatactatcatgacaaaattgtcttcctttgggctttcaagggaagtgggaaaattcaaattgtttaaatgagctaaattagccagtggtaaggaccatgacttcttagatttatctggtggtcctaatcctttaaaaatatttttttttctagaatttttggcatgaaatgaaaggcaacataacagcacgtattttatgtaatatggtccagattgcgctttctttataaaatggctttgacagtaagcacacaataaattatattgtgttagggagtgatatgattatatataatgaagtaaccactttattgatcttttaagaaacctatgtttttaaacctgagtaatgaggaaagagaagtgtgtggctgcaggagacacaaggaaggagaagaaacaggaaaagttacattacacagtcactacaagaacaaattgaataaaatattatagatattttctgggaagagaaatgggggtttgtgaggtacagaaaattgtaaaactcatttgttacttagtaatacaagaaacaataacaataaaacagacatactgggaacactccacccaacaaaaacagaatacgcaatcttctcaagtgtatgtaaggcaattaccagtgtccaggatagaccacatattaggccacaaattaagtctccatagatttaaatagacaaatatcatacaaagtatcctttctgaccacaaagggataaagttagaaatcagtaacaaaatgaaaacagttaggcaacatactcttaaacaaaggatcaaaaaagaaatcacaagagaaattagaaaacacccagagatgaatgaaaaagtattatcccaaatcaaaacttaagaaacacagcaaaaggagtgctaaggggaaagtttataattataaatgcttacattaaacaacaaaaaagacctcaaatcagaacctaactttacaacctaaggaactaaaaaaaaaaaaaaaaaaacaaactaaacccacagctagcagaaggaaagaaatacgtattagagcagatgtaaaatacagaatagaaaaataagataaaaccaataaaaccaaaagttggttcttcaaaaatattaataagattgacaaacctttggatatatatactaagaaaaaaagagaagactcaaattacaaaaatcagaagtgagagaggaaacactactactattctacagaaataaaaatgattataaaagagtacgatgagcaattgctaggccaacgaattggataacctagttgaaatgtagaaattcctagaaaaacaaaacctaccataactaaaccacaaaggaatagaaaatctgaatagacctatataacttgtaaggagattgaatcaatattcaaaaatctcccaataaagaaaagtcctggacctgatgacttcactggtgagttctaccaattatttttaaaaagaataatatcaactaaagtttcctcaaaaaacaaaaaattgagctaccacatgatccagcaatcccactgctgggtatgtatatacccaaaagaaaggaaatcagtatatcaaagaggtatctgcactcttatatttgttgcagcactgtttacaatagctaagatttggaagtgtccatcaacagatgaatagataaagaagatgtggcatatatacataatgaagtactattcagcaataaaaaagaatccctctcaaacttttccaaaaaaatcagagaaggaaacactccctgattgattacatgaggcctgtattaccctgatgccaaaaccagacaaaaacacaataaataaaaacaacagaccaatatctcttatgagcattgacaaggattgaaaatccttaacaaattatagcaaaccaaattcagtagcatattaaaaggattttaccctatgaccaagtaggatttgtcgttgaaatgcaaggatttttaacagatgtaaacccatcaacataatacaccacattaacaaaataaagggaaaaaacaataatcttgattaatgcagaaaaactacttgacaaaatctgacatccttttataataaaaatcctcaaaaactaagaataaaagtaaaaaaccctaacataataaaatccatgtattaaaaactcacagctaaaataatactcaagggtaaaatactgaaagctcttcctctgagatcagcaacaaggcaagtactattccacataatactgaaagtcctagtcagagcagttaattaggaaaaaaagaaatgaaaggcacccaaatcagaaagaaataagtaaaattatctctgttcacatatcatatgatctcatatgtaaaaaacatattccacaatttccaccaaaaaaaaaccctgttagaactaataaataaatacaacaaagcagcaggataaaaaaaatcatcacgcaaaaatcagtcacattgctacacactaacactgaacaatctaaaaagaaaactaagaaaacaattccatatacagtagtatcacaaagaataatactatttagaaattaaccaaagaaataaaatttttaccaataaaatctataaaacttttctgaaagaaattaaagaagacataaatgaaaagaattgtgttcacgaattggaaggcttaacattgtcaagatatcagttctgcccaaagtaagatataatgtattccctataaaaatccaaattatgttttcacagaaatagaaaaactcatcccaaaattcacacgaagtatcagagaacccccaaacagccaaaacaaaactaaaaatgaagaataaaaccaaagcactcaaacttcctggtttcaaaacgtactacaaagctacagtaatcaaaacagcacggtactggcgtaaagacaaactaagaaataaaatagagtccagaaataaaccctcaccagtgtggttaaatgatccttgaaaagggtgctaaaattattcaatggggaacagacagtcttttcaataaatagtgattgggaaaagtgggtatccacatgcaaaagaataaacttcaatccttacctaacaccatatataaaattaattcaaaatagattctaaatataagctttaaatataagatctaaaactataaaactcttggaagaaagcatgaggcaaaagcttcatcatactggatttggcaattatttgagtatgacaacaggccataggcaatgacaacaaaaaagacaaattgagcttcataaaaattaaaaattaaatgcacctcaaaagtcaccatcaacagagtaaaaagccaaaccactgaataagggaacatgtttgcaagtctcatattggataaggggttaacatccaaaatatacagagaactcctaaaaacacaacaacaaaaatctgaatcaaaactgtgcaaagaacttgaatagacatatttccaagaaagatatacagatggcaaacaagcacatgaaaagatgttcaacatgactaatcatttgggaaatgtaaatcaaagctacaatgaaatggaatctcacaccaattagaattgctactatcaaacacacacacacacacacacacacacaaaacaagttttagtgaggatatggagaagttggaaccattttacacctttgatagaaatgtgaaaaacagcatggcagtttctcaaaaagttaaaaaatagaactaccatatgacagagcaattccacctctgggtatatattcaaaagaactgacagcagggtcttgaagagatatttgttaatatgttcatagcagccatattcacaacacccatattcacaattactaaaatatggaagcaattcaagtgtctattggatggataaatggatacacaaattgtgatatatatacacaatggaatattattcagtcttaaaaagtaaggaaattgtgacatatgctacaacatcagtgaactttgaggacactatgctaaatgaaataaagccaaacacaaaaagacaaatattgtatgatccaatttatatgaagtacttagggaaattaaatcataaagacagaaagtacaacggtggttgccaggttgctggtgggaaggaaaaatgaggagttgttcttttatgtgtataggctttaagtttgcaagatgaaaataattctggagatacttggtggtaatgggttcacaataatatgaatgtacttaatgccaccaaactgtacagttaaaattgaataaggtggtgtattttatgttatgtgtattttactacaataaaaaagttgaaaaaaaaatgaaagaaaagctttgtgatttttttttctttcttttttttttccgagacggagtctcgctctgtcgccaggctgaagtgtagtgtcgcgatctcggctcactgtaacctccgcttcccgggttcaagtgattctcctgcatcagcctcccgactagctgggactacagtcttgctctgtcaccaggctggagtgcagtggtgcgatctcggctcactgcaacctccgcctcccaggttcgagcgattctcctgcctcagcctcccgagtagctgggactacaggtgcgtgccatcacgcccagctaacttttgtatttttagtagagacggcgtttcaccatgttggccaggatggtctcgatctcttgacctcatgatctgcctgcctcggcctcccaaagtgctgggattacaggtgtgcaccgcagcgcccggccactttgtgattttttaaatgtgacctgccccaccccaaaaatacatagatagggaactcttcatggtaatcactgggcttgaagagatagcattaaccttttttctaatttggccctgagactgaaaaatatatatatccataggaacccatacagaacttacgatgaatgtccacgaagtaaaccaagaacattccccctagcattagcagagagcattctaaaatataatttagtttcatcacagaggaagcttacaatgaaactggagctacattcaggacagtctttaaggttcaggagaatgatttgctgattcaaatggacaacagagaaatctgattaaataataatatatttatgatcattactgtttattaagcttttactaatagtgaggataatcttcagcattcttcattaactatcaatcgttttgcttaacaatctgataaggtccacctatttcagaaacaaagatcatgagattaagaaaactgaccaaagtaacaagcacagtaaggtgttaaacccacatctatctgaatccaaagtaaagaaatttttggggggggcggagtgaggaggtggaaacagagtctcactccgtcacccaagctagagtgcagtggtgcaatctcagctcactgcaacctccgtctcccaggttcaagcaattctcctgcctcagcctcctgagcagctgggattacaggcttgcacaccatgcccagctcaatttttggatttttagtagaggcagggtttcaaaacgttggccaggctggtctcaaactcctgacctcaaatgatccgccagcctcgacctcccaaagtgctgggattacaggcgtggccaccatggtgggccccaagtaaagaatttttaactaggtaatttggactttcaaaactgggacatagttggtgatttaaaataaaaatcctcttgcaagaatctgaagctaaaatgttccaaagcacaacaggagctgtgaacaagttagtagtctataaggagaagtataaatacattggaagaattaatctagggggaggaatgtggtttaagcagtaattgataggtgaagatgagcacaaaaatcagaaaacacataactgtacctgtaagttgctattcctttaaatcttgccttatttttaaataaataaatatgctagaaaacatttattctttgtggttttagtacatagaataatattttaatttccaaataccacaaatgaggtctaaaacatgattaaataattaactccattatccttacaatagaaaacttagctattcaaacaatgaagtttcacatgggtgatgccacctcctacattgtcacacattaaaaagttatagtcacaggtttttaaagaaataacagcttttccgggttaaacttccaatctcaagcctattcatgatgataaatgtcacagggtcaaagacctacagggaaaatctacgttagctctaaggtgggttaaccagtacacactgattaatccaaaatccatttgttaggaacaaggcaagtactacacacccttcattttgaagatactcataaacccaattaacaattttcaatgacaaagcttgtccctttgtatgtatgtataataacatcatagaactctatacaagcacatacaaaacaaggtgaaaactgacttggccatacaggtttgcaatctaactagaaagcataaatatcacaaataaatagatgtaaatacaattagtacattgataaacatacttcatactcttatgcagtaaatactcaaaaaaataagcaatgaaaataacatagaatacttgttgaactgactaaactcatcccagtgaagtttcctgaatacattttccttgaatttttattataaaactgcagctaaattttgcctaaacaagtttatccctaaatgtaaacaatgcatccaacattatagaaatcatcaatttttaaaaatctgttgttggtaaactattaacgtcattatattcaaaggaaatgttaaaattattaaaattttaatattttaattctaaaaactatatactactatcaacatttgcttcacacatctgcaatatgaaagtggtaacgtctaaaggtttaacattttaaaataatattttcaccttttagccattgcattatatcaaagttatgcaattttttacctttttattattattttttgcattctctccctttactggagattattgccttcttctctgacatcataactagataatatctcaatgacctgttactgtatccttggataagaggagatagcatctccagtaaggtcaaatatgagtcaaccatgtgatatgggtactgaaaaattccaattaaatcttaaactgacctgacagaataacagtatctagaatgagggagatgacattcccactctcatcagcaatggtcagatggcatgatcaatactgtgatacatgacccagaagcacaataatatcctaagaagggggaagaggaagggtgaaagactagaatcataacatatttggaatggtagaaagaatcaagggtattacatgttgactatgcgattaggaaaacaatcgggatagaaaacgtttcaaatgtttgaaaacttcaaatgagattactctgtatgttcccaaggcatatactattaataaaatgatgggttgagaatactagatacaggtttcaactcaaagtaaataagaacctcttaacatcagaattgctcacagatgacgtgttgcttgaaatattagtgaacatatttcaagcagagactggaggtgtttaaagcagttttacaatatgattctattagtcttctcaaagctcagaattaaaatatttaataatgctgagtggtggatgtttttacagtgtggcctggaatctgcagttatcaacctacaagtgtctgatttttattagcaaagtattaaaaagttgttcattttcccaatttaagaagaagtttatgcactggacattgcttttcaaaagttattttttgaatagtggtaaccaaaggttggggcttgcgtagtggggagaatggggacatgttggtcaaagggtacaaaatttcagttaggagatataaattatggccatctattttacagcatgaaaacacatagttggtaacaaataatgcactacacacctgaaaattgctgaggatagattttaaatgttatcaccatacacacacatatacatacacacaaatgataagtatgtgagatgatagatatgttaagtagcttgatttattatttcacactgagtatatatatgttaaaacatcctttgctcaccataaatatatacaatttcatttgtcaattaaaaataataacaaagttacatatataattttttttatttcaagtggtatggctttatataatgctgaatgactcactgactgattgaatcactgtcattcattcaacagacatttattcagagcctggtatgtgccaaagactgcaaagtggcatacaaaaagaaagaataagacaaagcctatgcttataatatgtcagggtaagtagacacccaaaaataatcattttcaaagtttaagatcttattctagaagcctgtgctctgggagcacactggaatggcatttaactttccagaagaatcaaggaagacttcactgaggaggtgatatttgagctgggctttaaaagattaataggatttaactagatagcaagggaatggaatgatatttcaggcagaagaagcattatgtactcagaggcatgaaagtacatggtgtggttagtgaaaaaggcaagaaatttggtaaagctgaaatgtgaggtataaagtatggaaagagtgaaaataagactgacaaagtagatcatgactaaatatttggggtcaatataagccatgctaaggtgtttgggtttaatcttgggcacaaagaaatgttttcaagtagaaaggtaacatggttacatttgcattttagacaatatatgtgcatcatgtgtgagaaactcatttctataaatactagtttttgccttgaaacatttcagggggagtggaatcctcgagttactggcaccagcaagggtaaattaatgggcactagatggcggcatagagtgcccaattcttcataatatcagttactatttctgagcctgtatttttgacttaaataattcctttattcaaaaatcccattaaatgaatatgcactatttagactgattggcatgaagtaatagactactgtaaggggaacacgcattttttaaaagaggtaaagcccatgttggtgcatgatggaaaaggcagttgaggattataaaaatatttggataaaattaaaaatacaactttgagttcaatggaatcttaaatttctcttgcagaagttgccattcgtctttaaataataatacatatatgtgtaaaacacctaaacttcataaagtcatgttatattcaccatctgtcctcttcttcaattaccaccattaccacatggacaaacattacaattcacattttacaaggaacgaaactgaggctcatgtaaatgtttttcccagtttatatggtacagttaataaataatagtaccaaaaccaaaactctagtttttttattacaaatccagtctttggttcactttgtcatgtttcacaactgaaaaacaattgggaactaggacaagattaagacaaggaaatgatagaaccaaatgattctaatgccattctgtgataaacagagagcaaatactgtaaattggattgtatattcattaagcccatggtttctgacaattattttggaagaatttacatgtcaaagaaaattatgaccaatatttagttataccaaggaatttacattggagaagctctatatatttttaatgtttggttgataatatgttaacaagatgattagtaagaaacacaaaaatagtttgtaacttaagatgtaaaagattccaaataactataaattccctatggagaagccatctctgccccatgtcatcatgcctttaaaattagacgcaaaagtttgaatactcaacagtagaattgtttatttagtagtgtggaaggtctacctctgtctatttcctgagggaaagcggctataatgagcctgcctgaattatgagaataaagttttccttttttaaagagtttattctaacagataggaggtaacttttatttctgccttcctctcttgccactccatccccagctaagaatccaatccctcaagagctgtcatcgtttttgttgttgttgatactctccaccaagacaaactaaaccagactgagaccatgccattttagcattatgaaacaagaaagaaagcaaaagtcaccaacagagcaatacaggaatttgagatgtacagaggaactgaaaaaagaggagctgataggagcattctctttcaaagctcaatttagtgttccaactacttaaaaccctatcacaatatactctatgccatcagggaagaaaaatgccaattttaaaacattattttcacttttttataaaaggtaaaacatgttaaggtccatacgtaaaatctttccaacacatcagttcatctgcaaattagtagctgaagtctgctcaaacgcagaggaaacttccatttaggtcttgaaaaagaatagagctcattttaaaacatctttatttatttgtgcaacagtgagtttagaaacaaagtatccagtgtattttcctagagttaaaaaaagaaatatttttattgagtacattccaaaacaattaaatattctcttaccccacccttttcaccaactgaatagttttcgtttgactttgaattaccacccacttactgatttacaaactggtcaaattcagcatatatacccacactcatacaaaatgcatttcaggtttccctttttggattaaaaactaaaattttattttacagtgagagctaatttgttaggtaagacacaattaaaccaagaaagataaatctaaacttacttacttcttccaaatttgaaaattgtccatgagatcttcaccaataagctacatcttttccatgctttatgatcataccccattttttgtatgcaaagaagaaaggggactaatatctttgatcataagtgttgagatcctaaattaaatctaagatttggggccttattaatacaaagggagaaaatagttaactgaagatgtcattagtaaaaattttcattaacttctatctctataatttctggcctttccagttttcggttgcatctttctagaaatgcatgtccttttcctagccttagctctgaaaatattgcttctacccataaaatgtcatgttgataatgctttaaatattgaactataaaatttctatatcagaattaatgagcctatttcatgttttaacactgaaaatacattctaagagtttagaacttctttaataatttgtttaaaaagtagttgaaggccaggcatggtggctcacacctgtaatcccagcactctgggaggccaaggtgggcggatcacttgaggtcaggagtttgaaaccagcctggccaacatggtgaaaccccatctctactaaaaactaaaaaaaaaaaaaaaattagccaggtgtggtggcagccgcctgtaatcccagctactcgggaggctgaggcaagagactcgcttgaaaccaggaggcagaggttgcactgagccgagattgtaccactacactccagcctgggcaacactcagcaagactctggtctcaaaaagaaataaaataaaataaaataaaataaaataaaataaaataaaataaaataaaataataaaataaataaaagtagttgaaaccagaaaaaaagagatcatctaacatataggagtagaattttgagatataaagttttactccacattttctttgtcactaatatttccccactattccttgcactcataagcccttattttcagaatttattgtctattatggttttaatatgtgtcccctccaaatctcatgatgaaatgtggtctccggtgttggaggagggcctggtgggaggtgtttggatcatgggggttgatacctaatgaatggcttggcaccatctccttggtaataagtgagctctcactctaagttcacatgagatctggttgcttaaatgcatgtggcacctcctcacctccttgctcctgcttttgccatgtgaagtacctgctcctcctttgccttctgccattactgtaagattccttaggcctccccagaaaccaagcagattccagcaccatgcttcctgtacagcctgcagaactatgagccaattaaacctcttttctttataaattaacttgcttcaggtatttctttatagcaatacaagaatggcctactacactctccaggaagtttcaaatcacgtaagactaaatgttagtattcttactgcaagccaaccagcgtaggttcaccctcttttattttgcagcgagaaaaacaaaacaaaacaaaactaaatccatagagctgattttgatttacagatacattcattttatttataggtatcaggcatacttttttccaagcttcagacctccaatgagaaggcaaagcctaatgtggttcagtcttattacctggctaatttgaaaggcaaaataaatgacagtgaagaaataaaagacagctaaaccagatgatgttggtttgtaaactttaatgactacttattaaaattttgcaaaaaatgaaattggttattatctatatcagtgatttccaatggtggctaccagaagaattgcttgggaaccttttaaaacataccaatgccagagccctgccttacaccaattaaatcatatttggcagtgccaagtttaaaacatacctgaggtagcattttgttaagactgtttaacaaagttatcgagaacacaagctactttcaatctgaacttcatttgcctcatccccaaaatgggcagaataactacactatgtggatattgtgagaattaaatgaaataatgcttaagaagaatccagaacaatgactggctcacagtatgtactcatttgtaggtggtattgctattagagctcctgttgatctgcactggtaaaacctgtaggtgttacagaaaggaaatggtatgcctatgaataaggaaaaggaagaacactctttaaacatcaatcgcagccagcaatgtgctatacccatgagacataggaaatacagcagcaaatcatacttagcattcctgtgatagatgttagccttaatgaagtatcttcatgccatacacaggaccacaaaagcctctgtgggacccaacatacaatttcctataataactcgtgaatcccattcattaaattagtcatattgaacattcttattcaatttctctatatctaatgccaataaactaaaaaacatgtagtatatgttcctatttatatctgcatataaacataaatacatatttttacatatatatgaaacattaaaaaacagaggtaatttttttgtctatataattttcccgtagtggccgaatttcctaaaataagcatacatcatttttataagtaagatgctgatttcattttaattaaacaaataaaaagtcatatatatttaaaaatacaaagaaactacacctttctacaattaatttattagaagtttgtttactggtattgttattgtctgcactgaccttaagcctccttaaagaaaaaaaaaaggcaaacaactaaaatgcaatcaatccagtcaaattcatggtgttataaagttcttcagaacagcactaacatggaagacttttataataggaaaggaaaaaccaaataagagagaaagagaatataaataaattattcagccctccctttcaaaaagtaaagaaaatattttcagaatagattatttctttcattatactactgacatattctttccctaaattctaattctgatcctaatctttttctctacttcttttttctcctcatattttaagattctaagattgttctcaaactgttggcaactgctagatcacttgatgagggttcaacaagcatgtggaccaccagttttagttggaagaatgccattgtttacaatctttcatcaaggtatctcttactggctcaatgataaattgtgtgagccatagatcaggtgaaatttttatccagaaaaataattttaaaacatcttcatttgtactgaatcagaaaatcatgacatacttagaggtcactgggattaatactgaattcgagatggctctgtcaggtagttctagataatttgcaataagcatcaacccagaggttacgaaaaggtttctcactgaagactaccttcaatatgtaacagatgctaagtcaaaaattatattacacacaaacctaaaacgttgaaggttttaactcggaagatggagaaaaaaggattcttaatccatcttttgacagcactcagtcctataaagttgttagaaaaaaaaagtcttcatgttttgcacctggaaattatttttaaatgggcttaataatgtggcatcaattcctttcccccaaaatgagtaaacacatcaaatgttgggtaaaagtcatgttctcagtgatcgttgagccatatgtaccaaaattaatattctaaagaaattctgctatcttgtcctcaactaaaaatcttgttgaccttaaattaataggtcaaggctacttaagaattgatatgtatgacttaataagactacttgaaattataggaatagtttttataggatttacaagtattatgaagaaatagtttttcattttttcattcatagttgcaaaatgtaggttatgaaataactttaaaaaacaacatttccattcatgtaaaaacctccctctccttgctatgggcaagtctggttctccataccgtcacaatgacactttcgcagtcaacatcacagctcaggaaataattattaaaaacaaacaaacaaacacaaatatctattatagagtatgggtttttagtgataagaaaaacaaaagtcatcaagcatttcttcacatattcacagaacaaatgccaagagctgatttagaccttccaacttaaaatttaattatctgctaccacatacgttagatggtatctgtttttccacagtacagtaatatgttgatataatgcagaatccaacaatttggtatgataaaggaattttatcaatactttcttctgctttctctctgaacatatttgtcatcatctttgaggctgatttaccagttttgaagcaatcctgcgcattacttgtaactgtttttgctatgaggagtacaattctgaatgaagtctttgtagttttgatcttttcacctttagtaataaaagtcatctattttgtaccagaaaacagtaaaatggcaaaaacaaaaagtttcaatagcttcctttgattatttgacaaagtttgagaaaagacaacatacttggaaccagaggaatcaggaagaaaaaggactgctggtatttgtcagtgggctttctatttgtgcttcttaagctgattgtacgaaatcctcacacctccatgttcactttacccagcacttattaaatgtacattttattgctccagaaaactattcactatttatacttataatcattattgtacattattgttagaattttcatatttttatattttaatgaatctcctttaaactactgatgtatttttgtgaattggaaatacaacagaaaagtaacaatgaataatgcaaaatttaataaatgtaaacaatctgcaagttatgtaaaacatattaacccggacatattatatactgtatcctgttaaatgcctgttggttgagataaacacaagcaaatcagtttcaggatctaattggtggtgaacagctttcactatagtaaagttaactttatgtataacgaaattgtttacaaggcctgcattccacacaatgacctggaattgtgacagttcctcagtcccagagatgctatattcatgattttgcaataaacaaaactaatacttattaagagctaagaaaattttctggccgggcgcggtggctcacgtctgtaatcccagcactttgggaggctgaggcaggcagaacacgaggtcaggagatcgagaccatcctggctaacacggtgaaaccccagtctctactaaaaatacaaaaaaaaaattggccgggcgtggtggcgggcgcctgtggtcccagctacttgggaggctgaggcaggagaatggcgtgaacccgggaggcggagcttgcagtgagctgagttcgcgccactgcactccagcctgggcgacagagcgagactctgtctcaaaaaataaaaataaaaaaagagctagcaaaattttctaaattaaatcctaaatcttttcttaattgtatcacatcttcacatacacacaaatctactatttctatctcaattcagttagctttatattcctgaattggtttgactcagatagaaaagttcccacaacaactcattttgagaccatttcaaggtctgcctatttaatgtagtttaaatcctatgtcaaagtcagggccttgggtttatataatttatactgataaatcataatgataatcataataatatctcaacagaaatgtctgtcatttcaggtaagataaataatcttgactaaattaaaacaaatgttgaggtaattattactatgtacatttgaaagcaaccataagcttcacaaaatgaatcaaattcacaatcgctactctcacaaagtttatgtattaaggactattgcaaaagtcatccattagtcttttcttacacaaataggaagtgaaaccaatgatttaccctttgtttacaaagatgtgactatttttaaattgttatttacatttaaattgagcatttatttagcacttgtcttaaaacagtaatttttggatgatatataaaagagtatttattaaagacttctatctaaaaaaaaggatttataccaatccatgcacatattagcttacttctacaacctcacctttcacaggtacacatacttgaacctccaaacttactccattcatactgaactatgtgaactatatgcaaacccatgaacgggtcatatactttttttttaatgctaaactttttaataagctgtttctcttcttataaaacccttaatacttgtaactggctaattcctactcaccttttcagtgctctcttagccatcatgtcctgtaggaagtcttccctgacttgggttaagtgccccttcttgtgactctatacctctctggtatatagagagaggaattatcactcaacagcaattattataagatattgaaaatgtccagtgcccagcctgtctctcccactataccatacattctcaaagaaaaggagtatctggtggttacttttttatttctagcatctagacaaataacaagtattgactaaataaagtatatttcagaatacaagttgggtattccttgtccaaagtgtttcgtatttcagattttttcagattttagaatatttgcatacacataatgaaatattcttacaatagaacccaagtctaaacacaaaatttatgtttcacatataccttatatacgtagccttaaggtaattttgtacaatattttataataattttgtgcacctctcaagtgaagttaggtgtgaaattttccacttctggcatcatggcagtgctcaaaaagttttggactttggaatattttacttcagattttcagattatggatgttcaactggtataaggcaaactgtttagtcaatgttatttctcagaagaaagactctcatattatgggccacacttccaattactttcttataaacaacaaagtagtatttaggaaagatttattagcaaggaattacctcagttggtactggtttgtcatggctttagaggtcaatctgctagaatagttaaaaatagaggcaaaataaaatgtaatacaagtttagtttttatttctggaatttttttcacaattgcaaatgttagctgctgatttaaatatgcctttcaaacatcatataaaacagccaaaagattatatcattacatagtacagatcgtaaatatatgcttaaggaacaagtgttgaaaaaaattcccctagtgttatggaaatggtatttgtgtcttctgatgaaattttaagtgacagtatcaaagatgaatttaaaacatgttataactaaaataacttaggtaaaaccaaaaatgatgtggttcggaaaacattgaaaaggtacgaattttataaatgtatgtgacgaatatgaataaaacgttcataaagttaggattgaaaattaacattagtaaattaaaatattattttatatgactttagttataattatgtatatgctatgaaattataagtaaatatttgtctctcatatctaaagctcccttcaaaagagtttttttatgataaaatataaaattcattagcttagagttatttgggggcatgtatgacatttgataaatacatgattaagtgaatgaattaagctctcttcatcttagaaatcaaaactagaattatattatcaaacacctttatgtttgtttatataaaaataattttaatacattttataaattatgatactttaaagaatgtatgcattcctaggggtcctctgaatctctcaatgatttattaacttttatttcactttctataatccctaccataaatattcagtcacataccatctcacgcatacaggcataactggcatgtaaacttaggtaacttttcaccgaaacttttatgtgcagatgacagttctgattaaaggctatgatcaatatgtcctctgatatggacatatggttaaaatatcactgtgtagttttccctacagaaaagggtaataataaaaggatggtaataagatgaaaggtactctacaactctattagaaacaatagaaaaacaaagtcaatccaaaatcataggaggacaaaattacaaactattgtttttaaaataatgatctatcattttttagcacaatcttcaatttcaggtataagcttcaattcctatactcagaaattccaaaacgctgttatttaaattattaatgatttaacggaaattttataatactaaaacttaaagcttaaggtatcttggctaaatttttttgctaggtacattcattcaataattcattcagacatttaggtaataattaaatgactattaaagtcctactatattttgggtagtatgttagttcctatggtgacaatgagaagaaaaaagcagacacaattccgttttcatattactaatgccttgtgggaaccagacattaatcaataatcataaaattattatataactataaatagattttggagagaaaaatgagattccatgatagcatctgaggaaaaaaaattgacatgcttaagaagatttcactgagaaagtgatgtttaagctgatatgatagatgggtaggagtttagagactagcaaattaaagctaatagggaccaggattaatattaagaggttcttttttaaatgaatacataggtattcataggtagtaagagctgttgattagtaaattgttgggacaggaattaacgttgttacagtaataccttcaaaatagtttgttttcctaaattggcgagaaatcattctagaaatgctggccataggatctttgtgtttgacaaacccgtgttttgtaagacaaatttcagcaagttctttttccaattatcataaatttagaattatattttctgtcttcatccagtttcacactgctctaaagaactacctctgattgggtagtttatgaagaaaagaggattaattgacttaatagttccacaggctgtacaggaagcatgcctggggggcctcagaaaacttaaaggtgaaggggaagcaagcatggcttactatggaggagcaggagagagaaaatgaagagggaagtgctacacacttttaaccaaccagatctcggtgagaactcactcactatcatgagaacagcaagcgggaaatttgcacccatgatctgatcacctcccatcaagtccctcccccaacattggggattaaaatacaacatgagatttgggtggggacacagagcccaaccatatcagtgaaatcctaattgatgagactttagccacaatttaatgatataataaaactttctaaagataaaagtgtggttaggcatggtggctcatgcctgtaatcccagcactttaggaggtggaggcgggcagatcacaaggtcaggagatccagacaatcctggacaacatggtgaaaccctgtctctactaaaaatacaaaaattagctgggcatggtggtgcatgcctgtaatcccagctactcgggaggctgaggcaggagaatcgctagaaccaggtagttggaggttgcagtgagccaaaattgcaccggtgcactccaacctaggtaatggagtgagacgctttctcatggaaaaaaaaaaagtgactagaccacagtactatcttgtatactaaagaaatacagagttaaagagatgagattataattatattgcactaataaatggaaattcgtcatctttcctcctgcaaagtttaactaaaagacaaatatcttgttcaggaagaagcttgtcaagttttcattcctatcactgattatcctacaaacacacacacagacacaaaagtgagctaatttaagaaatcataaatttaaattactgagagttttgttataatgtttgaggtatatctaattttcactataaactgtaaatgctattataggagactcagaaaatgcaaaaagctagaaatttcagaagataaaattattcagaatcccatcactgcaaaatgagcactgtaaaaattttcatgtttgaattgtttttagtaataataattttcattctttaattgaatttttaattaatttcaaaaaacgtttatagctaatcaaactctctggtcattcagttttttgtactcttcagtaaagtccacagtaaaggctaatctgaatgctgacatcactgcctataactctctctgttgtggtttagccattttagctcccctttcaagaacagtaattccccctgaactaaatattgttaaccacagataaagaagtacaaaacaaagcctatgttgttttcctgtgaatccaaatgagaaataacgactttaaagcatttgatctatccctttaaaagatgtaacacattggagactataaatcttctccctataaatccaacagagcttttcttatccttcatcgttggaacagtttcttgtttgtttgttttgctttgttttgtttttatttcagttcagaaccatataaagtaactgaattggttttaggtcaaagctatgtattttttggtgtcatcaaatattagaatcactcagaatggcaagatgctcacatcctgagaagtaaacagggatggaagccaaccataactccaatctcactcagggtggtgagttcactaatcagcaagagcttatttaagtggaatagtgagagtacttgctcaataatttgataaaaatttcttttttaaatgaatgcatatggttaaatttgtgtaaattaagtatgtgtatattaactcacatttattgatgagattctactgtatttcatcccaactttcattagaatacatattctttctataatttaagaatttccatattgaaacctgcaaataatttgttctctgcttatattatccgaatgccctataaacctgtctgatacttaaattctgaatgaaacttctaggagatgtaagatgataatatccagaaaaataaagaggaaaaaggatgaaaacaacagaatgtgtcggtataaggacatgttacaaagtttttactgggtttagtctgtggttggtttatcattatattgcaaaaaactctcccataaactactaatgattgtaattcctattaaattgggctttcatattaaattgtttaaattagttctttactctgtaagcataatcataatccattgtcccccattagtcaatttctgctttgtaaaattaaatattctgaattttaacatgtgaggcattgaaatatacaatgcttttcacatacccaagacagaaagcctatgactaaacttatgaagaaacaaactatagagaaatagctgtgaaaaaatacttcttattgtgataaaaatatcaaatgatctgtttacagggagcaataaaaggcaccatttcaactttcaacataggttgttccttttcatttgtatttccaggaaagcgctgaaataaccaatagtcatccagtttaattattctttaaacttttttaatttaagctcaactatttgaatcatagcaagtttgtaagtttcacaaccaacgtcttaatattaaaaatgaagaacttaggcttagagagattgtatgaattatctcacatttttgcacttactcagtagcagcattagaacccaaactcaaatcttttccccgtcaagtattccattagaacactacagcatgttctattttgagtctctctaggctaagactacatagttcaagtgaaaattaataatgcataattaattatttgccaaacaggaggaatatttaaggttaacctttatcatgcaagcaacaattacttagataatacaaaatcaactgatttgacactttgattattataaatcacaaaacaaataaaaaactaggaatggctcccaggttggcccatagagggattattaagatccctacatgtattcataaaagtaatgcaataattttgatttttcttagctctttatgcttttcacactcaatattttactcttatagtgacttacaggcatcaggaaaatgcagaaattaattataagaagtgttaggacttgcctcaattctcctgctaatccatgtagaaggtcttcaacctcaggtctgagttcttatagaaatcaaaacttttataggagtccatgctttcctgacaacagacaaacattccaggggttccttgagacaaagccatgtacacaatgcaggtcccagtttcttggacttctttctattatcactaatatatatagccatagagtaattttaacttacaaacttttgctccctccaacttacaatcttttgctccctcctggtaatctctctctctctctctctctctctctctctctctctcactgtccactagccttggaagaaaccaactgtcatgtcataaggacactcaagcagccctacagacaggactttgtggtcagaaactgagacttcctaccaagaaccataggattaatccattttggaaacagattattctttagatgaccactgacctggtcaatatcttcactgcaacctacaagaggctctgaactagaagcacccagtaaagcaggtcccaaattcctgacccacagaaatagtgagataaatgtttgttgttttaagctgctaagtctgtggtaatttgttatatgacaatagatagcaaacacccactatgagaaatccaggttaactactgaatctgtttcttcaccgttacaatgagataatagagatataaatatctaacatatcgcattgttgtaaagataaagaatataaaaaacactgtccctagaagacagtaaaagctcaatgaatgtcattttttatttttctattaatattataactatcattatcaatctcagaagtttgccatgtttcataatcttttgctggctcatgtttacttcattagctgagcaagtgaaattcatacactaaaataaatacagataattgaaattaattatagagaacagtacaataaacgtattataagaaaacactaagaatattttcatagctttggggtagaaaaatgttccttggcataatccaaggtaaagaccctcaaaaagttgagagatatgactacataaaaattgaaaacatctttagagtaaataattccatataaaagttagaagtcaaatgccaaaagggtgaaaatattttatatatgtcaaaaagtgagtatctttaaaatacagtcttacaaaataatgagagatacatataagcatgtatgggagtgtgtaaaacattttttacagcagaataaaacaaaaacatgcaagtaagtgaatggaaatttcacagtagttcaaatgactagtaaacatataaagagatgctcaaaaaataaaggaaatacaaaatgaaaaagtcatgggtatcactttttaccttggcttagactgaaaatgtttattatcgatgagagggtagagaaactagcacaaccctgtgagaggtaaagaattcttgaagagtattctggcaatatgtatcataaccttatatgtgctccctcatgcccctgcaacctggcaatgattttatcctaaagaaataatcataaaagtcacacatgatttgcaaagagtcatggacactgatacacataaatacttgaaaaacaagcatctttcatatttttgcattttaacaagttagcttatagaataatatgtattatatgttgccatttttgtattttaaaaagtgtcttctcttcaaaagttattttaaaaataccgaactatactaatgattgcgtgagggtatgtggatagcatcaggaggatcttctgtttatatccagaaaataataaaccataaagctacctagttgtttaatagtcaaatcttaccatctcaattttatggtacaccatttatgtaagtggttatccatatttcattatagggtgtttgggcttaatatgagaaaaggaagagcaaagaagtagaataaggaataatgtactctctttatttaaccagaaaatatggattgagatgtagctacttaacaataacaggtttgtgtctaatgagagcctcaaggagttggagtcattctgttgtagcacatatctattccagaatatatgtgcttgtataaattctgttgagaataaaaataatctacatactctaattacttaaacataattttcaaaattattatagagtcaaaacagttaaccccttttcattatccttctgtcttctctaacacctctggtggatgagctgctattgcaactgtcattgcaattattgattgcaatttttgtcattgcatttattgatataagaaagtttaaatccattaactttaacttcgtatttcttttctgtcccatgtgttctttatttttttttctctttgtctgcctttttttgaaatagttgagtattcaatgttccattttatctctattttggccttactgttatatctctttattttgtaatgattattgtagggtttacaatatgtaacttttaacttatcaaggctaccttgaaataataatataccacttcatatataatatcaaaccatttcaacaacacacttctatttccctgctccaattatttatgtaatttatgtcaaacatcttactactatataacccacaatacattgttaattattttgctgcaaagtgttaccttttaaataaaattttaaaagaaaaaagtgtgttatatttactcatatatttaccatttctggtactcctctttactttgtgttattacaaatttccatcttatttggtatcattttccttcttcctgaagaacctccattaacacatcttgtagtgcttgtctgtgggtgatgatttctctttcagcttttatgtccccaaaagtctttattttatagaattctaggttgactctttttatctttcagcattttaaagatgtctatattagtccgttctcatgctgctaataaagatatactcaagactgggtaatttataaaagaaaaaatttaattgactcacagttcagcacagctggggtggcctcaggaaacttacaatcatgatggaagaggaggcaaacacatccttcttcacatggcagcagcaagaagtgctgagcaaaagggggaaaagccccttataaaaccatcagatcttgtgagaactcactcattatcatgagaacagcatgaggtaaccactcccgtgattaaattacctcccaccgggtccctcccacaacacggggattatgggaactacaattcccgatgagatttgggtggggacatagccaaacatatcaatgaaattctaagtcttctagtttatattgtttctgacaagaagtatttaatatttgtgtcttcctcctgtacataatgcctccatttcctgtctctttctgggattttcttgttatcaattgttttcaacaattttagtatcatgtgtcttgatgccatttccttcatttttctcctcttacttatagttgaaatctctagatctttgtaaatacagttttagtcaaatttgaaatattttcagtggccaggcatggtgggtcatgcctctaatcacagcactttgggaggctgaggcaggcagatcacttgaggtcaggagtttgagaccagcctggccaacatggcaaaaccctgtctctactagaaatacaaaaattagccgggcaaggtgggggttgcttgtagtcccagctactcaggaggttgaggcaggagaatcacttgaacccaggaggcagaggttgcagtaagccacgatgtgccactgcactccagcctgggcaacagagcaagactccatatatatatatttcagcctttgattgtccaagtaatttttcttccttccttccccacctcctttttaggactaacatacaggttaaactgcttcatagtgtcccataaatctctgaggttatatttgtgtgtctgtttcaatcttttttctcagattgtgtgtgtgcttcagattggatagtttctattgctatgtcttcacattcactaatcctttttctgtagtatctaatatcctgttataccataccaatgtagtaaattttttcattccaaatatatttttcatctctaaaagttccatttagttcccttttatgccactcatttctctcctgatcatagtcaagctttcctttaaatccttgatcacatttataataatggttacaaaatatttttcttctaattccgtcatctctgccatttctgaacgttttttcattggtaatttttttcccagttacatgtcacattttccagctttttcatgtaacataaattttattttgatgtcattcatcataaactttttgttgttgactgctgaattttgttgaacttcacaaagtattagacatttttctggcaggctggttaatagcttgcagatcagtttggtccttttgagtcttattcttaagctctattagggcaggcttgttaggccctactgaaaaagaattatcctttttgggatctcatttccctggctattaacaaagtgtctccactttggctgaacaaaactcaaacacttccaatccgcgaaagctccaggagtggttcaccttttcagctctctggttgttctttgccggccttctggaggtttacccaaagtatgcacagtttaatattcagcattcaataggctcaaggcaatccttttgcagatttccaaagttccttgtctgcatatctcccttcctccggtattctacctgcaaattctactgcctcatctccctgaatttcaatttctatctcctaatctcagtgtgatcactgtgctctgtttaggtttcccttctgtacattatgatcaggaaagtacatccaagcataaaattttttctatgcaacagaagaagatattatttttaagtgtatacctctccctattatgtcatacaaatttcagggcttattttcaagaaccatgtcttttatatggtatctggttatgttgttactattttgaaataaaatacaggaattgaatttattcagtgtttcatctttgaataacctgaaaattgtatagtaattccttatcttctcacccaaaccactgatatataaaatactatttaagacgacaagatcaaacaaggtcacttactatcttcctttgggcatacctatattttagccatgcttaactttgtatcattactcaaacaacctcttttaacacccatcttcttgattctatttttaagagaatgagatctatggtaaactgtctaagttcaaatcctgacccaactagtttataaagcaagttatacttaaagcatctttgacttcatattatcatgtccatgtagaaataataatatagtctacctcaaaatgattatgaagaataaaagaaacaatatacagtcaatgaatgtgagctaatgttatcacttgcaaaccttttccctatttctttatatgcaaaccctatccgtaattccatttcagttaaaatgccatctctacaggaaggctttcccgggatccatgctgagaggattctttcttaagatactcatcacagggcatttatgtgatttatatttttcttcttagcttctatactaagcaattaagttcttgaaaggagcttccatgttttactctctcttttttcaaaaagatatcccacagtggacagtaaattgctttgtatttagtaggctattcacaaatacttgcctcagaaaagaaaattaaacatgactatatgggggaagtttttcaaataacttatgaatctccctaaatctactgccatcattttatcaaatcccttgtttacaccaagatacatatgtttgcaaaattttcttagctaacaacccagttaactttatcagaaaaggagaaatgagattagtatgacatgacttgttcttggtaaaataacaccttggtttctacatggtcacaaataatctattcaatatttcagaattttgcaggagataaagttaactctgtaggttagagaattcacctttatttcatctttaatattttatatgtttgcttgtatccattattttatatcttccgattctccaaatatgatcatttctggaagttatgatgttcagtcaaagaaagtttagactttggagcaaaagtccttaggtttggattccagttgttctgatagacagcagtgtggcttgaaaaagatatatttactttcagttaacacatctataaatggagataataaaattttcttggagcatggtgattattaaatgagaataagtgaaaaggtatgacctactgcctactgctaaaaactttttatttgcttccttttggtttcctcacctgcaaaatgcaaatagtcatccctgtttacttttcaggattcccttaaggattcagtgaatacatacattgtgatactttgaaaaacacacattatataaatatgcaagtttttaaaaaaattatggtcattattattcttgaataaaagttaccaaactctgtggacttagattgtaaatttgccaaaatagtctcctattaaccaatttattgatttccattcatttcttctaatttgaagattattcttcttggaaagaaaaatataggcaaaatatttgttcatcatctctgccttctctgtgtcatctctgaaaattatgtcatattctcccaagtaatgcctctatctattcagtctgaggtgacttttcaaatctcttctaaaagtttacgattttacaagagtaaattagagtgttcttgtacacacacacaagagaccaaaaaaaatcagaacacattttcacaaacagctgaaactatttaatatgggtatccttaaaaacaataaaatattatgaacagtaaaagtcaattatttattttatgacagaaatatttcagtgtgattatatctgagtatatcttcaattttttttgttcaggcagcaagcattggtcctttttaccaaccactacaaattatgcaccctaaacattatgcactctatgctataaaatgacaatataaaaatataatccaatctacattaattgaacataaagtacattctgatactcagcttagactaaccataacacagaatttgtcattaaacgttcagttcacacacatacactcaaaactgatccaacaactcctattatgccagttaccagcattgccagcccctttgcccttcactgcctggagaacgtccatcagaaacagggaagcagagcaaactgccacaatgcaccattgatgtttgagcaaggctgcctaagcagctgcaataacagggcaactcttcaaagtgtcagcattgaaacttacaattctctctcccatacactatcaatgaaaacctttataagctacaatcaattataaaataaatctttgagacaaatcatgttctttcttcatttcttctctccttcttttcctcccaaaaccaaatgtccttggttaaaagaaaaattcaaggagaaatatcccccctttctatcttggtctctgcctctgcctctcttatgtctaaaaattctctcaaggaggtttaaggatatctgctaaacacttttgtttacaagacaagttctggggttttttgtttgtttgctgttgggtttttattgttggaatgtttttattttaaaaattcaaaaggcacttgatattttgagcacactcatactagatttttggcaaagcatgtttttgattattaaaagacaatctaaattctgaaatgcatgcaccaaatcacataacctccatatttttgtaaaccacaacaaaagtgcctcatattagctacagatgaatagctaatgagtcagcaaacagttaaaaacattccatgagaatagatgcactagccatgcaaagtttttgagggaaaaatatattaagtatttaaaaactacttagaatgaagggaaactattctttctttaacaaagcaactatgtttaatttgtcttatgattatacctaccaaaccaaatgaaagtttatctgtctttttctatttctccttagccatcaatagttaatgcctttttaaattttgtaacatatatttaaggtctcagaattgtagcaacaacttttagattcttcatcattgtttttatcattcaaacagcatgcgaaaaccccttcaaatataatgtcaaggtataactctaattcctgcagataacaaaaatatatacacttcatcatgagttaatctactacctgaacaatcaaagtccaaaatacttggtatctgagttcagggtgcaataataataaattgccatagacttggttaaacaacagaatttaacaacaaaaatgtatttctcacagttctgagggctgagaagtctgagattagaatgccagcatgaccaggttttgatgaatgcctttgtcctggtttgcatatagtagtcttctcactgcgtcctcacatgatggagggccaagagacagagtggaagcaagcttctataagggcactattcccatcttgagggccccaccttcatggcctaattacctaccaaaggccccatgtacaaatgccatcacattaaagattaggttttcaatatatgaattttgaggtgacacaaacattcagctcatagcatttagaaatctgtaagaatttttagttatcatttctcattattgtcaaagcaacacacacacacacacacacacacacacacaaacacacacacacagtttaccagttaaatagtaccacaaagtttatacaaaatacagcatcccgtatccaaaactttgaccctctgccaaaactcattctagtgtttgcctgatttctaaataatatgcttctattgttatttttatttataaattttagacataatatattaacttcctatcatggcagaagacttagttctttgatactacctcatttccctttcttccatccttccagtaatcagtgaagtaatatttttgaatacatttggtaccttgagtagtaacaatatttccttcctattgttaatattgtcactttgccccccacattcccaaggtttgcaacagaaatgtaaaacctctataaatataatatttcacactcttacacatgaagaatcctattctaattctttcccctgaagacatccctttcgggagttctccatcttctagctcaagtaaagactgcttatttttaagatcaatgcacagaagttatccagtaacttcccttcacctttctcacctcattttaatcacctgtttcctgaaccctctatcttggtcttttctcctcagtttttcctcacttggacgtagcatacccttgaaacaattccggagaaagcaagtgtgggggtacatttggagaaccatgtgtctaaaaataaaaatgttttttctacccttatacgtaattggtagtttgggtgtagaattcaaagttaaaagtaattttctctcataattctttttttttttttttttttttttttgagacggaatttcgctctcgtttcccaggctggagtgcaatggcaaaatcttggctcactgcaacctccgcctcccgggttcaagtgattctcctgcctcagcctcccaagtagctaggattacaggcatgtgccaacacacccagctagttttaaattttttagagatgaggtttcaccatgttggtcaggctggtctcgagctcctgacctcaggtgatccacctgcctcagcctcccaaagtgttgggattacttacaggcgtgagccaccgtgcccggccttctctctgaattttaaagccacatcttctagctttgaatgttgtcattaagaaatcagataccattctggttcttgagccaatgtatgaggcctatatttctctcgggaactttctattatcatctatttattactgttattttgaaattttccaattatgcatcttggtgtggaattgctttcacatttttatgggcactcagaagatccttccaaactggaacctttggggctgaaaaattttaccatatacttttataacagtttcctccctatcattttctttgctctcgcctgccttctgaacttcccattaatcagatgttcagcttgttggatcgtttgtttgatttttatctcttctctcctattttccatttatttgacttttttttgctctattttcaggaaaatttctatcatataaaagcttatttcagttattataaaagtgcttattctctggttatttcttctttttatataatcttgtcatgtttcatagtagcagtatcttctgctatctctctgagtatattaattatactttatttctacttcagctactgttttctacaggacatactgcctctaattcttaaacaggttctggagtatgaactgtcttgtttctcattgacacaacactctccagtcacatgtattcggctttcccatttctgccagttcctcctttacatcttccaaaagttgtgtctctttaatatgttgcttcctcttccttatgcctgtggatttatatattttttagtcttttgctcaaaatttttagtcccttactaggaaggaacatggaaaaacatgtgttcaatcacgaagtttaactggaagtctgctgttaaatttcctgaagatgttaatcctagagctataatcatgctattcacagggtcataaaatcatagggctcttactataaaaaggttatcagagatcatccgattcaaccctcttattttataaaagtgagaaaatggaaacccaaagaggttaagtggtttgtgcaaggttatttaaatagcaatccatacatttggtatttgacttgctttcattaccatagtgcctcctcaaatagatatccccttaaagtagtgactcagaagactcccagacacatcctagggttaacacatttgaataagccaatctagcttttggatataaaatggaggagagctgtcattaaagaaaatctgggaaaaaatgtctccaagaataaatatttgactctggacatcctgttttctactagtagaaattccctaatcaatactctcccatgaaactcattccccttattcagcttcagcataacacacttatcctaacttttactctttcaggttacagaatcacatcatattttctcaaagcaaggtaaatctgtgtttgaaattcaaatgaatcttttatatctttcctaagtttctaccctcaattccttcctgacctctggctggccaccaacctcctactcctaaaatagtccttttttttttctgcaaatggcaccacccaggtactcgagaaaaacatcttgagagtcatcctaaacttctctttttctttaacagcatccaacttccaccccttcaccgatacagtacccaaatcttatcaattctacttcctaaaaatcccttgaatccattcctcttaggttcctcatagcttcacagtcactgtttcagttcatgccctcactatacttcaccctgatttccattaattgtcttctaacagtctcacagactctggtctgctttcttcataccccttcttccacactcaattgctgaagtgctttttctcaatagaactaagaagtcatttcctcacttaaaacccttcagaggatcccacctcatttctgacttcttagtatagcatatataaggcacttcatgataggcacctacttatccctccatcttcatctcctgtggctcttcaccttgcatgttatggaactagaaatcagaaaatcaaaagtctcctctcgggtttctattcacactggattttcaacaccaaatgccaaatgtcccttcccctgtcttctcccaaataaaggaatccaacaaaagagagtgaaaagattaaaaaccagttaaaaccatttaaaattattaaagtgcttttaccataatattttacatttatatttataatattttatctttatcttttagggattatagtctgtttaaatatgttggtagtacattaaattattattcagaacactgaagatgtaaattaaatatgaccataacaataataattagactcttatcatgtgaaataattaaggaattaacacattattatagtaagggccaaatctaagaaatgtactataccataccaccagactgcacacttttagtagacaggactgtgtcttaatcatctttacattccctactatgccaaatactatccccaacataatagatgcacagtgaattagtaaatgattaaataaaattagaaataatatcacacccacaaacccgggaagcaattatttgcctactacttgatgaggccaataattcaatgatatttattattatagttgatcgagttagtcaaatgtcatgagtgcctcttaaaaaatttatatatatacacacatttttctgcagatctttatacggaacatcaatctaatctttatttgggcatataaatcattcaatggataacacagtgaaaattttcaacataacagaaagacatatgctatttgaaaaatcagtaaaaaaaaaaaaaaagatgattctattgttggtattcttatcttcagattgtcctccacagcacatccctctgatacagagaaataaaaactttcttacctagaactctgatcaagttactgccttttataccactataatgatattcaaactggcttctaagcaaaatagaacagaaacattgcacatgcacatgcacttgaattgtacacttcttctatcgtatcaacttcatgtaccatgatatgctcgccattaatatgcactaaagctaacttgctagcctgccgcaattttattgttgcagcaaaacaatagtggtggattaacccatcacctcaagtttagcaatacatcctggaccagttatagatatgcattaatccacaacttaaaatgtaaaatatcaaggagctgggccaatccaggcatatgagtcaagaacacagcacttcaaacatatccaaactgaaactggttcttttctctgcctagaaaggtacttaacaatgggttctgaatatcatgttgactgacaggtatgtcatataaagaaggaaatcctcttaaatcttacctccttaaaaatatcaggtttaacagaagagtatgatgtgtagatccctactagatagaagcctgaatacctaacccattatataaatagtatgtattgtatagtatataaaggctgcgattttctgggctgctgcctactttttatgttttactgttgtcttcatgtaaaataactgtatggaaatggtatacctaaagagacaaaacgggtgaaatttaaatcaaccaactaaagaataaacagtataggttaaaaaggatacatgttaacaaaatgatgacacacagcagaataaagaaaatatatgaagaatacacatctgagggcaaaaggctgaggacagttgaaattgatagaatttgtaatgactgaaataaaagcacaagaaagagtagagaagaaacttgaataatattcatagataggaatgaactgtggaaattccaatgccatgataaggcacgatatagaatgattgtatttcttttatccaaaagcttcacgacaggtaaagatagactataatctgaagaacaaatagacctaatttccattataggccccgaaagtgaccaatagtgatacttataatatttaagaaagcaactgggcacttaactttagattataccatttaaatttttttcaacttgggaaaatgtttcaaattccactttgctacctacttgctttattttttaaaaaattagaaaaatgccatgtaaatcactgtagatagtattgcattgcttgtttgaaaaaaaaaaaagttgacagtttgatagtgcattcattcttatgcctccagcactgaatcaaccactataacattcaaaccaagaggaaactttcagcagtcttgatgctgtctcctactctgaagtgtgagtctcttttctacaaagagcacatgcttagggaggaaaacaggatatgaaattacacaaaaatatgtgccccagcattcagaaagaaagcaggtaaaagcttaattctcctccaaaaaaagcagtttctaaatgtggattcattaatgaaaacttacaacctagcagtcagcagaagcatttaggaatggaaggcatacagtacaatgccaactattagaatcagtgttctactaccacacaactattctagcttagctaacagtcttttttgtcacgacttttgtttctttttcctttgtttcctctgttttcaatcgggagagaactgtgtgaagctgagtgttcgtttaagtcagaaacacgttggctagatctaggttcagtgtgggtgagtactgtgtaagcattccacacacctccactaatatgccacgaactctccatatcccaagctttctgataggattcagttgagactacacatagcgcttttacttatgtcacacatgtgatctcaggtctcagcacgtactgacataggtagttaccatcaaacttgctcttctcataaatcctgagaaaaaaaggtaggttggaggtagaaaatggacagaatgtctctgctaacctaaacagaactagtatgtgttgctgctaaaatattccaatagctggcagcaatgatccataacattatatttgtaatataagtatacataaacactacaacagatgatctcagattgtcattgataatgatgatggctaactttttttagtatgttacttgtaccaagcattgctctatgtactatacatctcatttaatcctcatatacaaaaaaaaaaaaatattcttgggtaaagttattttcattttcattttacacaaaaggacattgagatacagaaagaaactgaataaattgattttaacatatttaacttatttaaagttaaaacatgaaattatttactaaccctttgatgtaggaccaatggctgtcactgactcttgatctgctatataaagtttcatgttttccttcttgcttaaactacaccatgatgtatcacctatgatttcctgttttggtttatttaaactcaatgacagcttaaaggtacttggaaagcaaactgaatgagggatccttccagctttttacattttttcacccctacctcaggcaatctttcacagttgtctagcccacacctttttaaactgcaatttgttttagcaactcacctttaaaaagtctttccaaagcaccaacttaaatttcataaaatcaacaactctttatatttttgaactcatattttatcagtttgcataattaaattacaattgcacattcatttggcataaacaaattcaaaaacaaacacaaatgactgtagataagcatggcagcaggtaaacagatgaacagaaacacaccattttttcagagtattctgttggccagaagcaggaataacctaagagggagtctactgtatacctaccatttcctaattataaacaatactatttaataggtatattagctttctggaagaatggatttaccatggaaaaatacaaacaaatttagcagggaggttcacaatgataccaaaattctacactagaaaagtaatacattccttcttatctttctttaattagaaattgtaggagacttcttcactgacaaaaactaagagcacaaaattccaccccaaactcaattcagcataagaagactcctacccaaagcataaacatatatactcacataaaaaataaaaaaaacttttaaaattaataaagaaattaaggttttaagaaagaaactttctccctactagagaaaaccatcacctcttggtggggaaaactgaatttaaagttcaggttcgggcagttactacttatgtgatggagtaaatcaattcacctcactgagctatagtatccttttctgaaaaaaaaaagataataataatggttctctcctcacaaaactgtagtcagaattatataaaataaaatatataaagacactctgcaaactatcaatcatcttatacatataaattgttattactggaaatcctagcttatattttggacagagaatttcagagtcaagggaagtcatttcacaaatgacaaggctgtgattcaaaagcctaaattactttcctacttacagtggcatggatgacggagcagaaatagagaattcttgattaaccaggagaagaatatcataggcatgggtgtgagatcaactggagattcaaggaagctaaagtgcccagaatgaactaatgttgtaatgtagactgtgagcagagataaaattccagaagccaaggagtgttgtacggtaagtcctggcagtgcctttggtgaggagagtaaagaagaaatagaaagattagccaaaaaaaatttcaactataccaaattagtattccatcctgcacagtaaaattttgatgcctttacaaactaaacaaagtagggaatttaagataattcccatgtttatgctgtttctttccactggtcagaataattaaccataggttaggaagttaagaaaacaataggatagacgtcagtgaagttcaagtgctttaattggattcctttgggtacagtttgtttccctttttctctgaccattaatccagcagaggaaagtgatctaacacagcaccatgacatgaagggacggaccctgagagcctgtctctctatgatgactgttcttgtgcatccaggcagcctattgaaactaacaatgcctgctgctgctgccgaagaggatcatccaaactctgaaaatgaaacacatcacacaaagggatgaaagaattcttattccacagggtttagcttgcagctggtcatgcatgccagagggatgtgccacgaggatgacaaagaagcttccaaagagaatggaaggggcagccagccggacattttgaaatacttagaaaactattcttttgaaactaaggcaataaactagacttctttatggcagaacttgagaaatatcagggtttatttcttttatctctgcaattcacccacatttaaacattcttgcgagtaaaagaaatttgaataatttctaattggttatacagttttgagggtttcccattcataagagaccatattatataattgattattttttcctccgagttgaagctctatatcaccccagagtttaaaactgtatggaagaataggtattgggcttttctgtaactgatgtagatacaatgaataataaatatgcttgttataccaagtagcatgctggttaagatcacagactttgaggtctcagtgatgtaactgacggaatactcattgcatggcatcaggtctcatgggttctaaggatctcgaatagctgtgtcaggtaagagtttgcccacaggaagtgctccaaatagaattaagagtcataagaacctgccatacagctgccattgctcttggcccctcagttggtcacagcaacgcataatccaactcttaagctgccttggatatccatgtttaaagagggtcaaaagcagcacctaaagttttgaaagacaatgctgcactggggcatcggccttttctgattaagttcactcattcatagcaatctaaaaagaacactggctctccctctctggcccttctccactactgttccaaaaagctcaccttcctctgtttacaggataaacgtgaaaggctcttttcattgcccttaacagtacacacaatagacttggcaatcatttctaccaattacatcaatgactcatatgaactctgcataaccagatgcgtgactttgtggaagttatttaatctcatttagccttagattcctcattggtcaaatgaaaataatatctgtcttatgagattgttgtgaagaataataagataatatttacctcacagtttagttataagcacaaggggtgattcaataaatgtcagtcattatcagtgtcattttctataacaggagtaacaaatagttcatgtaagaaactgaaatgagaactggaacacagtatcaaaaatattcccctatcctgtcaggatgctgtcattgattcaaacattctgtcatttatttcaggttagaacacagtttaagaaaagcattgcttcctcaaaagattatgtcaaagtgaaaataactaattgggagaaatatttcttttccatgtattcaacttgtttgttctaaataatctacttcaaactactgtaaataagttcttgttaaaagtgttttaacttttcaaatggctactaatatacgatgttttacagataaatctttggcattggagggtttccctaattgttctgatatttcttattcccgactcctaccatccacttgctcagaagctcttccaacctctctcaaaaagagaaaataatttgaatgaaaactcatactacaaaagcaacgttaaaatatatttgagaaaaaatgactctcaccctaggtcatgctacaagtgctgtaccattcaatggcacaaaattaacttttagctctaagttcattaccaaagaattctaaagactaaagaaagcatagggaaattaaaaatatttataactataaacaaagataagagattataatgagaaaaaattgtatataaggagatatttataatataattaaaaattaaccgtatacaataaaatttaactcaaaataaacctttccctaagaattataaaatattttaaattcaaacttaattctagtaaactaaataaatccctaccattaattactactttgcattatgaaactttgctcccaaaattttatgctaaaatcttccacataagttctgaagaccaaaaaaatccctactatttcattctaaaacaattggtccataattagtgaaaatctaagtcatttttctcacctttcctttcagcaatgcccatccaatcaatcactagatcctgtcaattctttatttccactattatagcctagaatcctaaataatctaattattttcagcctcttacctctttcatccatatttatgcttcaagaattaccttctattaaaaagaaaggctcaaagaatttccctcacctcctcaaaaaccttagattgtttacagaataaaatgtatctctaagcatagcattcagtctttcacagtgtggcacagaactacaattaacagtaattaaataaatgtaaaaggtattcattaactgcctgataggttccagactccaaacttgatagtgggttggtagtggtgacaaagatgagctcaacacagtacctgttctcaaagaagccagtttagtaaggaagcaggtaagtaaactaaaacttgtactgccatttagttagtacaaaaaaggtaactaactacactgtgctactagaattagacagtaagtcccaactcattgaaaagtaaaatagaaatatgttggttttctgcttctgaaaatgatgaagtaacagaaatagcatacacctcctgccttaaacaactaaaaatctaaacaaaatatataaaatatttgcttgcagacattgcacaacaggcacagcacagcaattgctgagaaaaggaaattaacaaggttattcctgctattgctgtagtatgctgtcttgagagagttatcagaccatgactcagggaggtagaatcctaacagagattgttttatctagggtcacactaatagtgaggagtggagctgggcctctgataggaacctttctgactgcaaagtccccagaagttttaatttttactcacctctacctttttattttttcttttacactatagaaatcatacttcaaaatttaaatactaatgcattcagtgaatctccccgatcccaactgttcccagtcacagtaaagatattaccatcctctaaatactgtattactttgtgtttacggttatataacattaactttcctgctatatttaataataattttaatgtgaattaacatttattgaagccttactacattattttatgttagtaagaacacttaaaatgagatctaccctcttagcaaatcttaatagtacaatatttttaagtgtgcagtattgttgactacaggtacaatgctatacagaagatctctagaacttattcatctgcttaactgaaactttatgtccattaattagtaacttcccattttccctttccttcagcccttggcaaccaccatcattctattccttgattctatgaatttaattattttagatacttcatataagtggaatcatgtagtatctgtctttctatgactggctcatttcaattagcacagtgtcctcaagttttagccatgttgtctcattgcagtatttcctcttttttaaagactgaataatattccactgtgtatatataccattttccttatccattcatccatagaaggacatttaggttgtttccacatcttggtcattgctaatctttttgagatcccgatttcaattcctttagataaacaacaaagtaccaacagaagtaaagtacatcaacatgataagcacatatatgaaaaggctacatatcagttttcaatggaaaaaactgaaagctattcctctaaaatcagcaacacagcaaggatgttcactctcggcacttctattctacatagtactggaagtcttacccagggcaattaggaaagaaaaagaaacaaaagccattcaaattgtaaaggaaaaagtaaaattgtctagttggtagagtctatgcttttatatacagaaaatcctaaagactccattaaaaaactgttagaattaataaatgaattcaatagagttgtaggacacaaaatcaacagacaaaatcagctgcatttctatatattaacaaggaaccatctgaaaaaaaattggaaaaacattcccatctaaaatagcaccaagaagtataaaataggaagacaattaaggagattaaagattatatactgaaaactacaaaacattgatgaaagaaattcaagatggaagatatcctgtgttcatggattggaagactttaatattgttaaaatgtccatacccaaagtgatctatagagtcaattctacatttctgtaattcacatggaaccacaaataccatgaatagccaaatcgatcttgagaaagaaaaacaaagattgaggcatcacattttattgcttcaaaatatattacaaaacaaaaataatcaaaacaatatggttctggcataaagatagatatatagacaaatgaaacaaaatatagagccaagaaataaatctacacataaatggtcaactaattttttacaagggtgtcaagaatacacaatgagaaaaggatagtctcgtcaacaaatggttctgggaaaaacagcaaaataataaaattggacctttatcttacaacatacacaaaaataaactcaacatcgattaaagacttaaatgtaagacctgaaactaaaacttttagaataaaacatacaggaaaagcttcataacattcatcatagtaataatttcatggctgtaacatcaaaagtacaggcaacaaaaataaaaataaacaggtaagactatacatcttgactgcacagcaaacaacatagtgaaaaggcaacctatggaatagaagaaaatatctacaaaccttatatctcagtgattcccaacctttctggcaccaggaactggttttgtggaagacaatttatccaaggacaggaggatggttttgggatgaaactgttccctctcagatcctcaagcattagttagagccttataagaagtccacaatctagatcccttgcatgcacagttcgcaatagggttcacactcccatgagaatctcatgccactgctgatctgactggatgcagagctcaggcggtaatgctcactggccggacactcacctcctgctgggcagtccagttcctaacaggccagggaccattactggtctgcagcctggggcgtggcgagcaggggtgaattccctgatatatctgataaggggttaatatccaaaatacatgaagaactcctataatttaagagcaaaaagaaaaaaaaaactaataatccaacttttaataatgcactaaggaatttgctaaggtctgaatattacccctcccccaaattcatacgttgaaacttaattgcaatgtgatagtattaagaagcagggcttttaggaggtgattaaatcatgaaggcagatcactcatgaatgggactagtaattttaaaaagagatgatgagctgtttgcccttccacaatgtgtgggcacagaggccaccatctatgaagaagaggcccttaccagatacaaaaactgccagtgccttgaccttggactttccagcctccagaactacgagtaataaatttctgttgttcataaattaccctgtatttccttagagcagcccagactaagagacacttgaataaagatttatttaaagtagacatacaaatggccaagagatatatttaaaaatatttaacatcacttatcatcatcagagtaattcaaattacaaccacaatgaggaattgcctcacacctgtcagggctgttattaataaaacaaaagacaagtgttgatgaggatgtagagaaatttgaatccttgtacactgttggtaggaatgcaaaatggtgaagcactatggaagatagtctgaagtttcctcaaaaaattaaaaatagaactgttatacaattcagaattctcacttttaggtatttatcaaaagaaactaaaattagtatcttgaaaagagcttaccacggtatttctctaaatgatgcacttgtaccaaatcatttaatcctcaggacaacccaataggtactacttttagcctcaatttgtagataaggaaactgaaacccaggctaaataacttgcctgaagtgaaataactagtgagtttcagagcaggaattcaaaacagaaaatctggctccaaagtccatgcacataacctcattgcttccctatctgaatcacctaatagacttcttaaatatagagacaattcatataactaatcttgttatttgtatatctcacactatctagaacaacgtgttattgctaatagatattctatgttgtttttgatatgaatgaatgaataaaagagcaatatgaagctatggaggaataatcacactgagtgctaagccagaactctggtaaaccataaactatatataaagtgtgcctaaaattctttatgagaaattattcttcatcctcacaactcctcagaaattttatccacaagtaactaaagttttcacatgtttcactcataggatcttcactcttagctaacttcaatattggaaaattacagacgattattttatgtctattcttaatgaccattatggcacatatttcatacattttagtctaagtatagaacaacattatcagtaagaatatgtgtgtgtgtgtgtgtgtatatatatatatatatatatatatatgaagagtgagagagagagtggggtagatgatatgggggttgaggtagttgggaatgaagaaaccagcaatggtaataacaagataatagaaatgaaaacaactaacattttctcaaacacctatcaagagctcggcaccttattaggtcttttatgttaatcatctcacctggtcctcacaacaaccatgaggtaaaaaaaagttgaaccctgaaattttgatattccttttctttaacaatagattgtatcaagtgaattaaaagaatgtaaagtgaataaccattttattagagttgaagcttaaaagttattggactgctataatacatgaactacatttttttcaattagcgttttcaccaactttataaaaaaagttatataaagggctgacaatcactattattctgtttatactgataccatcatgagttcacatatgtttaatatttattccacataaacttatttacaagttagtacactgttcactaagaaaatatggtaaagttgtcagattcttgaggtagggcacaataacaagtgctagaatcaacacactgtatgaattgccttgaataatcactctagatgttcaagaagtttccacttactctccagggctaatgagtattacatgcaataatcataattaaaacagaagtaatggaaatatgtgcgcatagctacaaaatatcataatctcagaattaatcttcagttcctcaagtctttcttatttatttatttatttatttatttagagacagagtctccctctgtcacccaggctggagtgcagtggtgcaatctcagctcactgcatcctccgcctcctgggttcaagcgattctcctgcctcagcctcctgagtagctggaattgcagttgcctgccaccacacccaggtaatttttgtattattggtagagatggggtttcaccatgttgtccagtccaggctggtctcgaactcctgacctcaagtgatccacccaccttggcctcccaaagtgcagggattacaagtgtgagccactgcgccctgcccctagagtcttaaatcacaaatgtttatcaagaagtttaagttctgttcattaatttaattcactccattcttcgtaaaaaccctgatatgctaaaccttcaataattcaattgcatattatccatactttaaaaataattgctcaagtgacatattgcattacattacattacattattaatggatactagaaatagagtgcctacaatgtgctggggaaaatattaggtgtttacgatatgatcttatttattctccatcattctagtttggctttcttatctgcattttacagatgaggaaaatagctcagtgttacaaactgaatgttcatgcccaaatttatatgttgaaactatacccccaatgtaatgccactagcagatggggcttttgagaggtaactgggattagataaagtcatgaggtttatgggattagtactcttataaaagagacccccaagagctagcttgatctctttctaccagaaacacaatgaagagttagcagtctgcagcccagaagaaggtcttcaccagaactcaaccgtgctggcactctgatcttggacttccagcctccagaactgtgaggttacagcagcccaaattgactaagacactcagaataagctgtccatggtcttacaaagatcaaacattgtactagaaggggaactcaaatccaccttgggctaccacaaacaataagaaaattttgcaaaataggagactataaagttaacatacaaaaatcaacagccttcctacacagaaacaaatgccagctagaaaatatagaagaaaagagcctgtttagtatagtaaggctgtaagaaagtaagcaagtaaataaataagtggatgcaataccaaaaggcagacttaataataaatgtttaaacctaaagccaaaaggaaaattagaacatttcagcaagatacaacagttactgagcaaatggaaataaaaaacagattcttggataaaaagattcaccctcataagaacattaattgttgtgatgttaattcataaattccttataatttcaatagaaatgccatcagggattttctttttcctcaagatctgctagttgattataaagttcacttggaataacaagtatgcaagaaaagccagaaaacactgaaaaagagtaatggtagaagcagggagggaagctaacatttcagatataaaaacaagttataaagcttctataattaaaataatgtgataatatcacatgcatagacaggtcaatggcacagaatagaagaatatagaaatacatctgactgtatagaaaaacttactataggatatcatgcaagtactagaagaaacattgatgaattcccttacaaactggcactgggaaaactgtttctaattatgcttcaatgtgataatatccaagaaagtcaactaaacaactgggtattaaaggcaaatacctctttttatcaaataatcatcattctctggattctatgtaaagcaatatctaaaacaaccctgggaatcacataaatctcaaaattgttgagtagaacaaactttaacagtttctcttccttcatcatcatttttaaaccccagcagaaagatcacagtaatataaccaaaacctaaaagagcctaaaacacacatctgtagggtttggttggaaataaactacactatcctatatccagttcatatctaagacttttccttgcatttcagtacgatgctgcttactttttaagaaggattacaatccttgaatatctcaatccacaatttatatttaaaaatgcataagtaatttctatgtgctagagggcaagggcccttaatagatatttagatttatactataattaaaaaataataataatgcaaatgtatgtcaaagctctgtaaacaatattttcagaaaatttgttgtggagaaggacccctggtgtccagctggatttaagccagtctataatatagctgttgactgcattgccttcaaatctattatcagacagatctttacttaccttgaaatgtttgacttcaccataaaatatatcaagcttctaaaatttgtaaagattatatttatgaataaaaatattggtagtgctacatttccaaataaacattttgagaagcatgatatagattctttagacacggaatacaccatcactgactggcaggaatgtatctcagacacaatagttacagtgtctgattggtgtctctggaacgtatagatagcatctacatttataaaaataaatactatattcacaagtggcttctggaaaagcttcttttaaaaaaacaacattaaaatggcacattggcaaaagacatcacagccttgctgtatactaacactgccttgcaaatgaaaaacctgcactattccttatgatcagggtttcacccatttatttggttaatcattcaaatggctaaacagacctctaatttgaaaataaaaaccaattgatgcaatcacaaacaagttctaaaattgcggtttataaaaattgaaatcttgttctaagccaaaacacacacacagttaccttttcctaatcagagcattcatttctcctcattatgatctcacaagcacattaaaatcttattaacattaattacttctgagcgcctatgcatgagcagtgacagtcgtgagtgtgcgcgtgtctggatcatatctacatttatataccttgctgcactttgcttataaaacatgtgaaaatatttctgctaacaccaattagctaatttcacacacacacagatagtaaactgctgtctcactgcacagcctatcagaaaccagtaaacatatggacaaacggacgggaaagaaagcagaaacacctcttgaatgtgaaaactaaaatgccttatacttgagcctgaatacttaaggtgaaaacaagttgggaggacaaaataacaaaaatagaaaacaatttaaaatgataaaaccaagcatactattttctacacagatggtttcagtgataaaatgatagagacaaagaaaaactggcaagcaaaaagcagcaaacacaggagaaatatacagaaatgaaaatgtccttccttacatgtgtgtacatgcacacacatgcacaaacacacacatatctgctcctcttaaatatactcatattgtaatttgaataaaaacaatataaactttactctgaccataaggtaatagcacactacatttcaaagtcaaacaggtctatcctcacaagcaaataaatattcctgctcaaaccaaatgctttatggattctacttatactaagaacattatatacaggagccattaatacctacaatggaaactcaaggtaaatgcaaaaaccaaggcaattatagccacaaagctacatataactcttatctctttgcttcacaatctccttctctcagcatacaactattttatcattcatacatatactccatcaatttgtattcttctttgcctcatcatatgtccttcattaggaatattattaaagaataaccattgatcatcgcatccacattttctttttcaatccatgtgcccatcttctcctcacagcctagagtttataaatccaaagtcttattagataccactatatctatatagtctttctgccatctttaatttccttgttgccatcaaactatactgtttcacaaagaaaataccaaaaaagtctgtattccataatgaaattttcagtgatgaaaacacttaccctcattggattacaatacctatgtttgtaaacaaaggtgaataataaaacttaaacctaagagtattatactttttatagaaagttattttagaacatttgactacaaaataaatatagaaagaatatattcagccattcagcacaattcatgttaagttgatttaagcagttaagctataattatagctcatgctataattccaattttctacctattgtccagcaggctcattggcctatagcataggggtcaatgacccatagcaatataggtgtgcatgatagagatgggctacataacaaattcctaagtgctctctctgtagagtaggatatatattggagaagaaatggtagggagcagagagagggtttctaaatatttttgaaatagcattaaaatatatgacattggtattaatataaaatgtaaatggtaaccaagaatatactgtattttgttttaatttagtattattcaacatgctcataactgaacaaagtttagtggatattgtctgtgaaaactaaaacttgctaatataagcactattagctaataaagtgttaaaagtttttttaataaaggatagtaaaataatgttagatgcaataaaatggtatttaaagatgagcaagagttatttcaagtaatttccagtttaccataacaatttacaaattaaaattatcatccttacgatgtttacatagactttgtataggtaagtagcaactgtcacagtaatatttactacttgtaaatattctgacttaaccaggcttaccatactgcatgaagagtgccaaaaaaaaaaaaaaaaagactagagaactaagaaaataaaaagttgaaaacctaacagaattagtggttgcctgtctcataacacaatagcactctatgcttaaaaaaaatactgatttttaattagtaaacactgaaatatttgtttataggccatttatagcccactaaacaaaatctgtgaaccaaaaattaaagtattaacaacaattgccaaatgaaggtcaatctgtttttttaatatctaaattaacagatcagtggaaaaatatgagatttgtttttttaaaagattaatttatattaacatcttcaagaatactttgcattaagatagatccctaatgatcagaaaattatggaaaatcaggagtgaacaaagaaataatcttgagtaaatataaaaagtatcatcatgttaatcagttagctatgctgcagaaagcgtcccaagaatccactgacatatgaccaagaccgaactagcaaaaagtgcacaaatatgttgagacttagaacccaccttctctttcataaatgccccatcacaaactgcaaagattaggtggccaaatttcaacatcaaagattcacttggcattctgaaccagatctaagaatcatggtctttattttccagtaaaagctaataagctgagacttacttaacgctttcctgttttgttttgttgttgttgttgttgttgttttgagcttctcaaggaatactgaaattggagactacatgtgaaaacgatagttcatcttttccaaaaaaagatattcatccagattgccctccaatcggtgaaatctgagatgtctaaaaagtcttctttgtgaaagccttacaaatatatccaaagatgttgagtcccatatggctctgataaatgaaacccgttattgtgaatttcaagctcttccttaaatcaaaacactattgggtgaatttggtgctcatgaaataaagcactaattgcgtggcctaacaacactgaatcctctgcctagcagacattttaagttgtgccaaattggttttgggatgtgaacaaatatcctggagccagactctctcacatgcacacactactccctggaagtaagttggacactcttggaaactgcattaactctttcaggccaccagggaacctaactctcactaaaggaaaggcctcttttaagataaaaacaagtcatttcatctaaagttaaacctaagaaagaggtaaaagagcaaaaactaatttgtggctaaacactaaaatgtccatagacataaaatagtccttaaaccccagtggatgctttttcaaatgtatccagaaaatcttatttgggcataatttccaagacattaataagagttgtgtgcattcaggaaaagagaattcattttaagcttaatatgccacatttgcctcaggccgagtgataagaaacttttgtttctttggtaatcactctcaagcttattatatcaggaaatttcttgagtttctatttcaccacatgaaatatgatttccacactagaaatttttttatggtctttttgttctggttcagaaagatgcctacaaacatgaagctgagtatttaaatggcaattaatgtaatcccatctcccttgcactcaaatttaggagttcataaaaacaatttttaaaagcacctaaatataagaaaaatgtacaaaaacgggcgttgtatttctttctctattttttagtcttaatttcttcagcagtaatttcttagaaataagttgtttactttggtagggcattttaattaagcattttatttgcagtatgatgaaagcacagcatttctttccccttttatctcactaataaataccctggattatatttgtccccgggattacctaaactaactacaattttatgcttttaggtcactgtcattttgttgctgtcattcatctttcaccttaaaggcttatgaagatatagataaagtaaaaactacttttttggaggtggaaatagctaaatgcttgtgaaaatggtatttttcagtcatttctagtttaagccttctatatttcttagagaaccgtatttattttgtgtcaattggtgtgaatttaagagtattactagaaccctatgttccacctccaacaaagctttatattctaacaattagcctgcatgtgctgctgctattgactcttaataatatataaaaaaaacaacagccttgtcagccaaccctacaaggaaactagctgctatttgcaagtagacaggacacagttgtaaatcaaatgtgtgtagctgcttcgggcttctattggttcaaactgcaattcttagaatggaatacaggctatgggtgtgtttatatgaaggtcctctacctgattttctctggggttttggatctctgaataattcatatatttccaaatcaaaatttagaggatctgtagtgcactagtctgtgtttgtactatgtctgatgtgatggcatcacttctaagttctgttgcatattcagttagtcagctctggtaaccgagtaaaactcacactctagtagaaattgtttggtatctagaaccttactaaggacactaaggggtaaatggtaatattcaacagataccacattaaaaagttttcactaatttttaagtcaaatatttatcatatcagtgagaagttgatccaaaacatattcacaacttagggtgatactagggccaaatagcaactttcccctggggttcaagcacagaggctaactgggacagttataaactttatggaagtctaaaattctgattcgtatttctaccatggtcctcctttccaacttaaatccatctaatgatatcaatttaggaggaaaaggtatcaaaatttagcttatgttcatttcaaatacctcagattaactgtaattaggaggtaaaaataaaaatggcctgtctttaaataggtgtccattacatttttcacgtttagaactctgccatgagctcagaactatttattcaatgacatttcctttttccagttatatcttcattacttacatgatccaaataaaatagagaaaaaaaggcttcacgtggtggacactgtccttacagctcagctaattctaatggttttaaaagtctaaatatatttaataactagcctctacacctgagattatcagcagaatacttttttagatgttaaaagacagtagccaaagaaaagaaggaaagaaaacgtgagtagggatattaggagagcatctttatcagcaaaaaagctggattgtccaatttcctcactggagcaatgaataacctagttcccagtaccaaccccaacactgaaaactgctgtgtaactgtaggcaagttatttaacttcaactggctcctacttcttaatctgtgatgcaagggtaatatagtttcaggcaccaactgcttcctgcatccctatactggctaggatcttttaaaaattatttcctggacaaaacctcacccacatgccatcagttattttccctcctttttcctgcctcctttgcctctgcagggaaataaaattagcagtcaaagttaaacatgcccagtgggcaagacagactttggtttaaggaaagggatggagtaagttgtgttaaagtgcttatttggccccaaatggttcattgttgggataccacctcccacaactagctccactggaatttttctcaggaaaatggagaactgttttaagatagacatgccctgtaagctggtctcaaatcaaaataaatttaggatattcaaaaaatgccctacaggatttttcctgtggagcctaaataaatcactgaccaaattttccaattcatgctctgctgctaaaggggacgttctacaaaatcatgttttaatttctacatctgaaaaaggagtataggtaaagttcttcactttgggttttcattcttctctcttctctgacagtattctaaaagaatgccatttgagaaaagaccactcttagagaagaaaattgaaatataaccccaaatttccaataaacttgtaagtctgctaaagacaagaccataaccctggttagagattttgtgggtcttcctttaaaaaaaatgaaccttttaatacatagagaggtgttaagaatatcccaaaagtgtacacatatctaaatttacaaaatcatgattattttcacaactaaaggatatattttagagctcttttaaattgtgactgcccttactgcattttactgcatatcaataatttgcatattattaaatatttaaaaaatataaaaattacatttttagctatccatacaggataagtgagaaattgtacaagtttgcatacatgtgctgtcattttatactatgaggcattgtttttttcagacaagaacatcaggaatgctcaagagtcagtttttagatgttatgaagcactgaggcattgatgctgttaacactttcattgaaatttaaatgcaaaccaaatattttaagaccaataacaatggatatgccatgaaattgttgtgtttcacagcgtgtcataataggtaaaattggaattttccttcaaataatctgtcccatccaagagttttaactctcaaatataaatataaacaaaagattattcacttcaactgatttccctagaggattatgcattatcaattccaaactttacaagatttaagaaattactggactgattaagtgtggcaaactggtttgttccctacaaaggaaacaaacttaaatcccacaaagtttaattagcatttagtggctcaacaaatggaggaacagcctgattctgaataactgcaaagcagagtcagaaattgtatatactactggttaactttgctgtgaaaattagagtgaaccagaattcaatcccagttctgccacttactagatctgcaatcttcggtaaaccacttaaccattctaaatctttctttcctcatctttaaatagggttaagaaatacttcatagcaaaggcatggtggttaagagatcccataggcgaagttccttaacaattcattaactataattatcactacaatttagaccccttctgaccattgagaacccatgaattctacatccagctaaaaaccattttgcaatagaaaaattttttcaaaactcaatttacatggtctaagcaacaattatgatagcatgtcaggggctaatgtggtgccaaaagttagacattatcatttaacacaatgggaacctggtaaagatttactgaatgaggaaaaaatataataggatgtaatagaaagaacagagactaaatcttggctttgactcttagcagctgtgtgaatttggcaattttttctgtaagcttcagttttttcatctaaaacataggcagaaaaccagtgtatgcaacaaagttgttgtatgcaaagattaaattaaacagtttgtgtgaaaggtgcttagcaatatctcgcttccttaattttagcattataggacaagagttctaatcggttttcaagcctaaacttttcttatatagcagtatcaactctggcctcctacataaagtaagattatgtttagttaaggaataatgtgagagatgaggataaattcaggtgtgacagtaaatatattttaacaatataccctagaaacaagagtaatgattctcaaaccttgcaatattactaggatctttggtgtagtttttgcaaaatatggaagcccaaataccagtctagagactccaattttagatatgtgggagtagaacctaggaatctgtgtattttaaaagcccttggctgattccgacatataataatcaactaaagtcgagttttctgaagtatgtgggccagctacaactcaggatgcctgagttccattccatacccattaataatggagctcagaaatttgaattttaacaaaaatccgaagaatatcttatgtaaactaaagtttgagaaccactggactagaatatagtaagataatattgaaaagaatttttttcatatttggttatttaaacttttttccctctatttttaaataaacattactgtcaaaatttatgaatgatgggtaaaaattttatctaaagaaaatattagttttagggtaagtattatcattattattacaggtttcaaaatcaaaatgggaaatagagataacattttaagtcatctacagagggtccaccagcacagaaaagtatatcacctaggaaacaccatgcgtttcactgtttcttaaatttgtgtgttttgctttgacttagttttttattatccattccttctttaattagagcagtaatgccaataaataatatttgtatactactttactatttataaaaaaacttcatatatattaacttaattaatccttacaataaccttgtgaggtagataggaaaggtaatatatattatcacatttctgccaataagaaaactcttaaaaagtttgtgcaatttgcccagtcataagtttgctggtatttatggtaatacgtggactgaaacctctagatgtaaatttcatgcaaaactgtgtgaaatttaaaacttaggattcatttttaagtgctatgaatcaaactcaaaatagcatgagagtctctgaactgcaagtagtccatagtcctctaccaacctgtgggttcatcttactatataagttcattgtactttatttattatatggttaaagaatagaaggagagtggagctcaattaaccaaaaacaaatgaacaaaaaagtgaaaaacaaataaaaaaatggaatattcatccattataatactatttactctgcctacttgcaattcattcccctataagcccctttgcctcagtttcctcttctaaaacatgaaatatcaaatagcactttcaaaggctagcaatttcattttcaactatgatggtactttaaaaagtacaactaaatatacagctagaataatactaacatttgcccaatccctacaaaaatcctgtcaaatcaactagtccagtccactcattttatacataggaagtagacctaaaaaaacttaagtatgttaccccaaataatagcaaatttgttgtaaagctagaattaaaaattatctttacatcaaagtcaattacaatacacacttgtgaataggcaatgccttgttttcataatcaaaaagagaaaatggtcattttaagataaaaggaagaaggtaatttataaagggatgtttaggcaggaagtggtatcagaagctgtttttccaaagtaaaaaggctccaaacttatttacaacaaagaaatgtgtattttatatatatatatataacacacacatatatataatacatacatatatatatatatatacacgagaatgttataaaccagctagacataatcatttgtttagacctcaaatatttgcatagctctgtgctgaatgccaatagaaggttctggaggatgaataagacacagacactatcctcaagaagctcaaggtttagttggaagatgtgcttacaaacaatggcaatacaatgtgagaggtgatattgccaagttatgcatataaaattgctgtgggaatgtgaaagaaggagcacctcaatgcctgaaatgaccgagcttaagtgagtatctctgacaatccctgtcttctccatttccaattctaaattaaatacttccctgtttatgcctagaattgttaaagaattttttatataccctgataggagaaaagtagtaaagtgcacacatcctaactttttcttgggtaataagaaatttcaaagactaaaacatattatagaattttggtacagctactacgaaatcagggcctgaaacaatttgccaattttttgcaaatgtcctgtttttttgttgttgtttgtttttttcactaactcatgcatcagttacttgcacagcaacagggacacaaggtggcactgtcgtgctgacattcatttcagggtcctttctaaatggacaaatttgtaagagacagaatagaccctattgtgacaactaacaccacagttgtaatactggccgactgggtctaccaacattaacactggcctaaagaggagtattttgcatttcatgaatattatatcatgcctatatagaaataggacatattctctgatgacttctccaaaatgtcatgtgtgtattcatagaaatgtccaaaggcatagagtgcagctttgccattaggaagtcagaagtgaactgcttgctattggcaaggcagtggacacggatcgcctctccatctagtggccagtggagaggagtggagccatagtaaccatgctgcacttcattccattaaaaacagcccttttaccaaatcacccataggcaattaagtcagtttgtctgacaaatgactatttttggtttatggcattcgttcaatcattaaacagactcaataatacattatgatatgtagttaagctaagaaaaatcatcacaaaattaaagtgcctgtgctctctcaagccacataaatgtccgttattcttcctttattacccaccctaacttttctccatttatttgtgacttttagatagaaaatgcaagcaagattatctacatatatagctacttaaaatcacagtctttaagatgaaaaaatattttaaaaagctttctcctcattttacaggaaggaaactgagggacagagagatcatgatgtactcaaagtcacaaagtcagaacaaaaaaccagacctccagatttaaccactttaaatcctttttgatattgattaatacctcctgattccccaggaaatgctttttgtatcacaccataaagtttctttcaacataccagaaaaataatttctaaaaatgttttttattcatatattttcagactaaggtgatataagtgaaactactgtgtataggccgtaccacatcttcatatccataggtatattttgaatgtgttataagaacacaattatttttatattaaggaattacattcatccaacatttagaaagcgaaaaagcaagtggggtagggaataggtggatgtgttggtcaaaattactatacaaaaaatggtttcagaaagccattatgtgaaacaacctgaattcattcagactgctagaaaagttctttttgttttgtttcatacaaattatttgactttgtttttaaaaaggaaacacacgcacacttatccagctaatcacttcatctattttaattcagcatgtgatgctgtttgggggcatgttttgggaatgtgttgttggtaaagcttcttatcaaaacaaatgaaatctgtccaccaactataaaaatctgctcacaactccgaacccaagaattaaagggcaaaaggtatgaaggaaacctggcagtggatgttctagaaatgtgagatgttttgactttttcttctatgatcttctttggtggtaccactggaatctgtcttggagtgcagagggaatttatatagatctgctttagagagatgcaaaaactaatgctgtacagataagtcaaatgctttttaacgggagttagggaagaagtctttttatttcattatacttctaagtttagaagcttcaaaagcaccaacccctcagctaccctcagctttacccctgtaccctcagctttatcccttcacattatctcaacttctctctacttgtttcttaatcatctctagtcgtctcccttctagaaatgaggtgaggggataaagatcactgttgatttggagaactagagaaagtaagggctaatataaaaagtaagttatttttgccttacctaaagctaaggtaataggtacaagtaaccaagaagtggagaaattagtaaatatggtcagaaccagagtatatttattgggccaagaagaattttaatgtgtccagtatttaagaagaaaaaaaaacaaaaaatttataaagtcaccattacaaagtatttgcctagtctatttaaataataaaagagaggaacattttctcactgtttaaatgtcttggtgcctaaataagatatttttgtttatttaaaatgaagccacatagttttcacatacacatatatatcaactagaaaaattacatagcctggaacatttctagttttctgctagtaatagcttttttttttttttaactaagttttaagttgctacctgaacaaactgacaacattaattttctctcaattacattccatttacaggaaagaagttcatactataaaaggaattgcaacaacaaatcacaatttaattacaacagtaattcacagaaaatttttgaaaaggtaaaaatggcaaatatctaagctaattcagtaaaaaacaaaaatgtaaagccttctaaaaattagagaaaattaaaatttaaataattttaaatgtttcattttaaaaagtttaaattaagaattttcccaataacaaaaatagtactactatgtataagattcgtaattattaccatttctacatttttagttacaaccaattgggcatctatctttttgatatcccataaccccaacctcataccataattttatatttgttgaatgtaaatccttacattagtaatgtaatataaaaactttcaaatagattgaccttttaaatgcataatatgaacattaaattcatcatatctcaagacacagaagtattcagtgacaaaattacttccaatatcaagaaggtaaacatattatgctgtaattaccacattttctatcagagtttcaaaggtaagactgaatattcagaattaataaaaaatatgttcttcttccctctggaaactagatgaatcaatgaactcatagtccttgttccttgtctcagtattctcacttgaaagtcagtagccagctttccccaagttaagacaattacaaaggttgcattggttaactgaactacaaaacaccaaggctagagtttcagctgagtgtcaaaagattccagaaaggcaagctccatgtcctcaagctgattactttcaaatgaactatagaattaccaaaaggcttgatcctggagtataagagaggttatgaagccaaagtcaagcataatttttccacagtttagtacagaaatagcatgccacttattcattattacagttgaacagctagagtggcaaaaacaaaaaacaaaacaaaaaaaagccctttttcttataagcccttgaatgctgtttctaacaccggctgtagtggttactacatacatgatagtaatcatagatagcatatttcttcccatagcctcatcagcttgcctatgctgaattagaactaggggagctcaaggatattttgatatattaaacataattgtcatcaacattatttgatgattaatgtataatatctatgtaataggaaaacatgaattcaggtattctctagaatatctaagatatgtatattgccttcaggcttttggtaaagaataaaattgatcttgctagtttatttgacattagctatagttcctggagattatgcaaaatgctagaatttatttaagcaatggaaatgtatgaaatgggtttttcaagaaaattacaagtttcaagttttgtaaaatacctacacacctatacatgacttgaaagcttggtgtaaagtatcaaatgtaaatgctgactgtattagcactgtaaataatccatagtaattgtataaaataacaaaaatgtcttacacagtatgaaacaaattattttaaagatttggtttctaatttaatgataactctggcaggtacacacctgtccgattgctagtgtttattgtccttgatggagggtaaactgtttctatgtaggtaatacctgatttctataatgtccctgaaatagttacacagccatgcaaatgaaaatatttagaggttcttttcagtgctttgtgacttctcatggtaacttagatcttcactggttaagaaagtgagggataaggatactattttacttatgttttacagtaaaacatgtctcccaccaaaaatgtagtttgttaaaatatatttataaagtgacctccaagataaaccagctttaatgtccattttcaacatttagacttcagaggccacccttgaggctgaagaacccaggagctagcagcattcaaagaatatcaacaccagtcattcttttgccagaaaagatcactagttagcaatattagccaggtgctgctgcttcaacataccttgccagatgttggggtaacacgtttgctcagggcctgaatttggcttcctatgtggcggcatgaccggccactgcttagagttgggcaagtccatgaacacatccactgataatttctatatttatagaaagccagaacatgtgtagataatcacacaattagatatttatgtagtgccagattttatgaatacgagaatttgttaattagcacaaggactaatcattaaaattcaaaaatagataaataaacaggaatgccatttatttgttaacatttcatggggaaagtatgcagctgctatccttttgatgaatataggcttctggagataaaaatgtgcagaataaaaagtatctgcaatttttgaaaccctaatgagtaaaatccaataaatcactatatagtctttatattaaaaataatcatagtgattctcctcttaagttaaaaaagaagaaaaagtttaaactggcatatgcttagcatttgaattatatggtctggcattccattttatttgattttatttatttatttgttttgagacgtagtctcgctctgtcaccaggctgcagtgcagtggcacgatctcggctcactacaacctccacctcccgggttcaagggattctcctgcctcagcctcccgagtagctgggactacaggcatgcaccaccacgcccaggtagtttttgtattttttttttagtagagatggggtttcaccatgttggccaggatagtctcgatctcccgacctcgtgatctgcccgcctcggcctcccaaagtgccctattttttttaaaaaaaatctactgtttggtccttttcaaagagccaaagctgatttttatcagcacacacacgttaaaaagcacacacacgtcactcagtaccaaattgttttagctacagggcatggcaaagcatgaagtaacttcttagagcacttcctcatgtgggtgtgttaggtaactgtctgctccaacattaaaatgaaacacactgtgacctgaccaagactttggggatctaaacaggcagatatcatgtgctgataggaagagcccactataaccaataaggctgattaatgaatttttctggcattctatagcgctcctgtaacgcaagcctttcagctttccaaatccctatacagcagagtacagtggtttgaagtttatttatgcacattttataatgtccttctgtatttagattgtgacagtccctcccagaaaaggccaagattatttttcatactaaaaatattttagatctactgaaggttaagaattataatgcaaaagaaaacatatacacattctaaaaattaaaccaaacataaaaatggctacattattacttgcttttattcttgctaaaaggttaaaggaaattttcatttttctcttgaaattctctccattttttgtttgcttgtggttaacataaacacacataaagtgaaatttttaaaaatattgtatctgaaaagaagctgtgatgtatttatccatacatgtatgacttcgtgtcatacatgcacatgtatgcacagatatcgccactgtatgtgtgtacagaaaaagagaatgactaatcaagacatagatgaaagatttctattgataaaaacagtagaattttagatggtcctcacaaggctaacacagaaaatgacaggtgcatgagacatgtacacttttgacatacagtatcagttttgaaacaaatttttgggtcaccgtcagaaatggcataaagtatatataaaattgtatatgaaaaacaaaattatcgtgtaccatattaacataaaatactctcctaaagttccccttagaccttacggaaaaaaatctccgacgggacctgattgagcgtacttagtatttgtactactcttggtcaaagccagcctatccagtttaaaaaaactgttcaggcaagataagcaaattgaaagtctcagaattaattttttaaaagaagaggtaaaaaagtctttcagcagcaaaagttcatcaccttcctgaaataatggatttttaataaacattttactaggtttgaaccttgagaatgtgtttgggaatctgctctagtgtcccaggtgggttaagaatattgctttatggacttctttgtgttgtcagagaagcctaatggaattaagggggaaaaaagtctgccacttctgttaaataaataatttattacaaaaagatgactgttattatcaaagatctctacagatcagcatccattttctaacattgctctgtatatgccgaaacatttgtgtatctatgtgacttaaattttatcaaatgaagagcagttttactttgacaaatctgaaataaaattccattaagaagtccatttcaaatggcccttattaaaataatcctttcaattttgaagaacactattctgggaaaactcttcaacaatgtctgctagtttgaaatgtaacttttcccactataaaaaagaaaaaaagaaataaaggaaaagaaagcaccacaaaactgaatttgaaataaaaattatattatttatgctccccaaaatgttaaatgaatacttacagttgttgtgcaagatggcctgatacacttcatagcttccactttgtaaaaagatggccagcccctcactccaccctccccaagcataaataaacagtaacatactaaaaggaaactgtcctaggataaaaactgcttgttaagaaagttcgcattcttactaaccaaagtgatattcctataaatgtaaaagcccatctgcaaaataaaagttagaaaacagaataccttatttgtttaaaaatacatcccccagatgcaatgtttctatgtgtgtgatgacaaaaataattactccattcttacccaccctcagcaactacccctcaccttatgtccaatggcattaaataaacatgctggcaaaaagtattcaacctgcttcaaggatttaaactgtaaatatggactttaaacttcaacataaaacaaagaacaagagtctcactttagtaatacccacactggcactgcagctaaaactcattggcaaataactaacaaaaccgagttagcaataaataaggacaacatgatatatagacagacagatggaattgcataaacagacaagaaaagcaaagagacaaacatacggaagggtctgttttaaaagagtgaaagattctgatttatttggtactttagtgagaaaaatagatttgtttgtaattatttttaaagtaacaaaactgaatcacaagggcacacccctaagtaagtaggaagaaaattagtaaagggtaggcctcctacagatgttctaaattttaagctagcactagctctgtcaaacttaaatctggaaattaaaattcaagcaggaaagaataaaggcattgggggctaaaggagatgacagagggggcattgaggaagcaggatttttttttttttaagaaagttgtctgccctaccttcttccccagcgctgagtttctcttcttataatcggtgtctccctggaagtacagtgtgagtggtaatgactgcctgcctccctaatgagtccattttcctgctcttgatgttgtgtatatacacacactgcaacctaccttacaaaccacagagacgggaagagagagagagagcaagagagaggagggaggggggaagagagggagagagagacagagacagagcaagcgagtaagagagagagaagaggagagagagagagagagaaagaaaaacagaaagaaacagagagaaaggcacagacaaagccctcctaccagacagcagacagctctccttcccctatccagcaaaatgcaactcgtctaatgcagcaacaggttcagtattgccagactaacagagtgaaaaaggtatattctctatatcattattgcttgcaaataaacagtttaagagcagctggctccaccttctttatttatgctccattatgaggaatgtattgtttcagttctggcagtacatgtaattatcataaatacattttttgcatataagcaggaaatagtgaaatgcatagcttatttgtgcaatcttttaaatttatttttaatgtgagaagaatgtgaacaaatcagctctgacaaaagcctagtaatgattttaaagtcagagcagtcttaaaggaggctctgtaagaaacagactccatacaataggaaaactgatctcagacaaaactgataactgcaaagaagaaatcattgctcagttaataaatcgagaccatatacaaaattgcagacttacaaaattacagaccaaaacagaattaagcttaattaagtaactaataggctaggaacctagaagaagggagattggcttctcatttaaagcatctagctgtacaaacatcacaatgcaatgtactctgtgtgaacaggtgcaatgcgtatagtacatagtggtacaacaacagaaataaatcccataagaagctaccatcacaatcaggatgatatttcatagaatatgggactgaaactacagcagttacccttaatcttttattaggagggaaaaataaaaataatcaatgcttctaaataaacttgccttaaaagagaaaaaaaacagtttttctttgtctgatacttctaaccagattttttctatattctagttccaaaattatgatgttattatactcctcaccccatcacatgcttcccacccactttccccactcctaggtgccctttctcctgtaagtgatatatttgcagctatagaattacaaacatcagaaaacagaaatagttttaagccactctcctcgtccccgaatttttaaaaactagactctgcttgacgagtcatatctccttctagcactattatctatctagacacccaccttccttaatatatttctatacagtttggctatgtgtcatttagatgggacttaagaacattataatagaggtaaaattttctaaaaaatatttacacacaaataaaaaatataagtgcatttgacttattcaaaccctgcgtttgggcaacaataatcctaagtatatgaattgtaaaaatcatcctttttatgtggttttgtgtattaacatgcttcaaaaattagaatatgtccctctgcataaacaaaactaccttgaaacaacagcttcaattcttttgtttaaaaaaaatcagttttcaattaaaaattaaataactttcaatatataacttatagatcaaccgattcttcaccttattcacaaaaatctttaagaatgtcaaataaattttgggtcatgtttagaatacagatcaatattgctttagctattttcagggtggctaacctacagcacagacattagaatgtaatatctacctatacattatacaagctatcctgggaaaatttctagtaagaaaccaagagtccagaccactctagtctcatcgtaatccaccaattcaacctctctagtgctgcagtagtatatcaccctcccaagggtggatgattaaaaggagacagacacacactaaaaatgatttaacagtctcctacttcaggtcacttgtctgtagagaaacttttccaaaatatatttagtgtgcccaaggtaccagcatgtatctcctcctcactatttggcctggcagctctgcttttctactattgccctattgtttctccgaagctttattaaaatgtattaagaaaaatgtcaattaaaaaaacacataaaacttagagtttgacagatggatttgaattagatatttgtattttctgaatttttaaaataaggttctaggtattttattttgtttcattttgtttttattcaaggagaagacgtatttggtttctaccagcaggaatcaaaaggaatataaaggaccatgaaggctcttttctaaaaaacaacctgagagctaaatttaaaaggaaaacaaatcttttggcttaagtgaaaaatgagaccgggcacagtggctcacaccgtaatcccagcactttgggaggccgaggcaggcagatcacaaggtcaggagttcgagaccagactggccaacatagggaaaccccctctactaaaaatacaaaaattagctgggggtggtggtgcatgcctctagtcccagctgctcaggaggctgaggcaggagaatcgcttgaacccaggaggtggaggctgcagtgaaccaagatcacaccactgcactctagccttggcaacagagcaagactccatctcaaattaaaaaaaaaaaaggtgaagaagaagaagaagaatgtacaacatctcaaaacttttcccatatctgtacattttactagattcaaagcacaataagtagtacattgttagtacttactggaattcaagatatactttccctagttgggactggagacaataaggtctgaagaaatcattgtaattgactaccatactatggaagttataaagttatttaattaaattgcttcatgtgttgatatgtcatggggcaatttggttctgtagaaagatcctaaagtggaagttaaaaactggttctgtcccaaattgatctatagattcaattcaatcccaatcaaaatcccagaaagttattttgtggatatgaactaaatgattctaaaatttatatggagaggcaaaagactgaaaataaccaacataatattgaaagagaagaacaaagttggacaaatgaaactaccagacttcaggacttactataaagctacagtaatcaagaatgcatgatgctggcaaagaatagacacagcagatcagtgcaacaaaatagacagcccaggagaaggcccacatatgtatagtcaactgatctttgacttaaaaggaaaagcaatacaatggagcaaagacagtatttccaacaagtggtgacggaacgactggacgtctacatgcaaaaaaataaatccagacgcagactttacactcttcacataaattaactcaaaatggatggatcataaacctaaatgtaaaatgcaaaattctaagactcctaaataggaaaaaatctggataattctgggtttcacaatgactattttagatacaacaccaaagacataatccatgaaagaaataattgataagctggatttaattcaaattaaaaagttctactctgcaaaagacactgtaaaggtaatgaaaagacaagccacagactggaagaaaatatttgcaaaagatgcatctcataaaggactgttatctaaaacatgcaaagaattcttaaaactcaacagtaagaaaatattataacctgattaaaaatgggcagaagactttaacagtgacctcaccaaagaagatatacagatggcaaataagcgtatgaaaggggctccatattatatgtcattggggaaatgcacattaaaaataacaatgacataccaccacacatgtaatagaatggcccaaactcacagcactgacaacaccaaatgatgatgcggatgtggagcaacaggaactctcattcattgttggtaggaatgaaaaatggtacagccactttggaagacagtttggcagtttcttacaaaactaaacacatatacaatccagcaattgcagtggttggtatttatgcaaaggaattgaaaacttatgcccacacaaaaacctacacacagatgtttacagtaattttattcataattgccaatatttggaagaaattaatatgcccattagtagatgaatggataaattatggtacatccaggcagtgaaatattatttagtgctaaaacgaaatgagatatcaagccatgaaaagacatgtaggaaacttaaatgcatattactaagcaaaagaagccaatctgaaaagattgccttctatccactgtacgtatctatacactgtatgattccaactatatgacattctgaaaaggcaaaaccatggagacagcaaaaactcattgtttgcaagagtttagggtagagagagggatgaacaggaagaacacaggattttcaaggcagtgaaactactttgtataatacaatagtgacagatagatgtcatacatttgttcagacccacagaaggcacaacaccaagagtgaaccttaatgtaaactatgggcctggagtaataataatatgtcaaagttggcttatcatatgtaacaaatatatgactctggtgggggatattgatgatggggaggctgtgcatgtgtgaaggcagggggtatatgagaaatctctgtacctccccatcgattttactatgaaactaaaattactcaaaaaaaagtctattaaacaataaattaaaagaaaattggttctggtcccagcattgccacaaatagcttgcgtaccctcgtcaagtcatgcaaccatcctgagtttcagtttcttcctatgctaaaaataacaaatttaaaaggacggaattgaacagcgtatcataataatagttattaaagccaatgcttaagtgcttactatgtgtcaagaactgttctaagtactttttatttcttaactctttaaagcctaacaattaccctataatgtaggaattatttttagtctcattttccagatgaagaaaaaagagagattaagtgacttgcctgagatcacatagcataataataatgataggatttgaacccagcctgtctagcttagagtttatgtgtttaatccctacactatactgttttacccaatacctaaagatagttaaggccccatccagccatgactctgtggttgtgagtcaaatctagtaagtcctgatgatttcttaccctatcttgcttactaacacagaatagtgaaaatttgctgtttaatacccatagctctcaatacgttcaatttaatggtacccagcaactccatctaaagtacatactctatcatgcattcttaaaggttgcatagttcaagattcaaatatctaatagtaatgcaaataattgtttaaagaactaaataataaacacaataaaatatttcctattttctatagcctgagaaaggaattaaaaaagcaagaattcaattgtaaaggatttgtgtattttgggggttttgtttgtttgtttgttttttgagacagctccgtcgcccaggctggagtgcagtggtgcaatctcggctcactgcaatcttcgcctccccagttcaagcgattctcctgcctcagcctcctgactagctgggattacaggcgcgtgccaccatgcctgtctaatttttgtatttttagtagagacaggatttcaccatgttggtcaggctggtctcaaattcccgaccttgtgatccgcccacctcagcctcccaaagtgctgggattacaggcgtgagccaccgtgcccagacaagaaaagtctgggattagtgggtcaaaatgagtaattgctacgctaagtaaatgactttgccattgaggacaccaccataaagttaattgtaagtggcgtaattacacaataattctttttttttttttttttttgagacagagtctcactctgtcgcccaggctgtagtgcagtggcccgatcttagctcactgcaagctctgcctcccgggttcacaccactctcctgcctcagcctcccgagtagctgggactacaggtgcccgccaccacgcccagctaattttttgtatttttagcagaaacggggtttcaccatgttagccaggatggtctcgatctcctgaccttgtgttccgcctgcctcagcctcccaaagtaatggaattacaagcatgagccactgtgcccggccaattaggcaataattcttaaccctagtcatctattttaaaattgtatcccatcgggcccaaggacaatagtaggccaggagtaccatccttaaatgggaagagttgcacatctaatttaaattctaatcaacaaatgtttaaatttaaaactaaaataaagtattacatgtaaactaagtcattggaagtacatttattatggccagaggattttatatgcctctctccctacaagactaagagactccctccccaccatcgccaccttcttcccctctgccccccagagcagagaccctacttattaagctttgttggtctagcatctggcagtacacctgtaatatatctgaagctcaaaaaagttttcctgaaagaatgaatgactaaacaaacaacagtacatagggtttataaaccttggttaattaaaaacttaaataaatttgagatataaggatgatataaacaagtaaatagcatttcaaaaaatgtattgtcacatattaaacacatccttatcttaagatcttgtgacaaacaaaaatagaaaaagtaatcttcaactttgctgtatgtttgaaagaatttcacaataaaaagttggataaggctgcatgcagtggctcatgcctgtaatctcagcactttgggaggccaaggtaggagggtcacttgaatctaggagttagagaccagcctggacaatatactgagaccgcatgtctataaaaaaatcagccttgtatgatggcatgcacctgtagtcctagctacttgggaggctgaggtgagaggatttcttgagcccaggaggtcaaagcagcagtgagctatggttgcaccactgcactgcaacctgggtgacagagtgagactgtgtcaaaaaaaaaaaaaaaagtttgttaaaaaaagtattcatatctcacaccagtcagaatggggattattaaaaagtcaagaaacaacagatgctggcgaggctgcaaagaaatatgaacgcttttacaccattggtgggaatgttcaaccattgtggaagacagtgtggcgattcctcaaggatctagaaccagaaatgccatctgaccccacaatcccattactgggtatatacccaaaggaatataaatcattctactataaagatacatgcacaggtatgtttactgtagcactatttacaatagcagacatggaaccaaccaaaatgcccatcaataatagactgggtaaagaaaatgttgtacatatacaccatggaatactatgcagccataaaaaggaatgagatcatgtcctttgcatggacatagatgaatctggaagacataatcctcagcaaactaacacaggaatagaaaacactgcatgttctcactcatatgtgggagctgaacaatgagaacacatggacacagggagaggaacgacacacaccagggcctgtcggcgggtggggggtgagaggagggagagcatcaggacaaatagctaatgcatgtggggcttaaaacctagatgacgggttgatagatgcagcaaaccatgatggcacacgtatacctatgtaacaaatgtagaggttctgtgcatgtatcctggaacttaaaaaaaaaaaaagatattcccatacaactatcagaatttcaataaacatcatttctgaaaagaaaattcagcttgccttcacatttcatttatctattatttctttcaaatctataacataagtgtttgtaaaaggctgaagttggcttcagagtacttcatgggaatggaattgtcctctttgaggaaaacatcttgataagctgctggagtcagagagtgaggcatgaatatttcttgtggggttaaactgtactacataaaaaatgagtaacaatttgaagttaggggagcacagagatgagagggaggaagaagaggagtagtgggaatttcccaatgtaaacgtggccagattttttaaagtaatgcctaataataaattctatgaagtttatgttttgtgatgcaaatattctccttctctccaaactttcaggaaaggataatgtatattctacagtcttatatagtagtagaacgaagaatcaaataatgaaaaaatgaagttattgcctcacattcacccatatactgtagcctttataatcacggcagtttcctaataagacagaaaatattaccggagttcctcggagtgaccagtggtagagtgaacagtggccagtgaatagtaaatagcaaagagtagaaaatcaaaagtatctttaatatagaatgactcatatctatatatgagtcattttccacaattgtaaaggagaaatatgaccatggggaaaagtggcacggagtttagtatctgaatgataagattattatgctattatagctgttgttactactcctataagctgatcttaaatgatatgattatctttagaaatttagaagagggtacttttgtgacacaatcaataaatgctaaatcaatggattacaaaatataaaaatgttatttgtaatatctccctggctccagaacaacgtattagacacatatactatatgaactcttctgctgcctggtcaatcctctctactaaacaatctacaacaatgccagcaactatcttaaaagtttccacatctacataatttacttatatgtacagtttatatttaatacaaaaggaaaggaaagagaaactacagagtgcattctataggaaaaataaaagtcacagagaagatataaaaggtacatcttaattgccatagatgtttgtcaagcaggttggtgagatccttactgtttgacctggtgcggctatactcaaaaactcaatagtcttcatatctttccaaaatacaaaagttgctactattaataagaatgctttattaaaagttatctctactacatgtgtcagaaacagcccaacatacactttctcatttaatcccccaacagcattaaaagaaatctcattttcagattatacataaacaaaaagaggcccaaagacacagacctaataagtagtaaacgtcgggcctaacatctatccaaatagaatgtgtaaggaatagaaggaggggctttataaaattactccaaaaattatctagaataacagactggtgatattaggtagaaaaagaagactaatgatggggaacagatttgaaaggatatatgttccctagataatttcagaacttaaaattttatatttgtttgaggaaaagtatattaagtatctcaaagtaaaatttaaagaaaggataatggaaaagactagtatattaaaaaatagctttcaaaagcgatgaaagaaacataccatgaaccagtttgattaaagagttggaaacattaggcggggcactgtggctcacgcctgtaatcccagcactttgggaggccgaggtgggcagatcacctgaggtcaagagttcgcaaccagcctggccaacatggcgaaactccgtctctactaaaaatacaaaaaaattagctgggcatagtggcacatacctgtaatcccagctactcgggaggctgaggcaagagaatcacttgaacccgggaggcggaggttgcagtgagcagagatcacgccactgcactccagcctgggcgatagggactctgtcttagaaaaaaaaaaaaaaagagttggaaatattaatagcaatctgtccagcaattttgaagcgagttattaataacggagtcagcatgatagcagcctgctaagccctctgaggcaacaggccatagggatgattcaaaataggtagaaatggtatcttttatttttaagaaaaatcacttagccccaataagctgtaggcttatagccataactttttaaaaaatgtataaggtcagatcaaaagtttttataacataatctacataaaatatctatcttcttcatttgtattaaatacaaaaaattactttacagtatatacattcagaatgtatgtccgatatgtttggtaggattcttgaaaaataaaaatttgaaatgaattacattaaattttattttacacttatattgggtatttcaaaattgtcatttacttaattttgactagtttatcagtttatatctcaatgaagagaattgtatataaaacaaatccggccaggtgtggtggctcacgcctgtaatcccagcactttgggaggccaaggcaggtggatcacctaaggttgggagtgtgagaccagcctggccaacatggtaaaatgccatctctactaaaaatacaaaaattatccgggctaggtggcatgtgcctgtaatcccacctacccaagaggctgagacaggaaaaattacttgaacctgggaggcagaggctgcagtgagccgagcttgcgccactacactccagcttcggcaacagagtgagactccatctcaaaaaaataaaaataaaaataaataaataaataaataaataaataaataaataaataaaaataaaacaaatcctccttcatgttaaatgtccacacatttgaatggattgaatttacttatcactaaatatgatgtactactctatttcaaaccgatggcactttaccactgaaaatgtaataactggatcttccataacacaaataatactcccaacatcacttaaacctatgtgaaatttgaatatcaaacagtatctcaccagttgagaaaattttattagtaatcaacaaaagaacactgcccataatgaaatctgtattaattacaaaaagagttatgaaagaaataaatcattattatgaattttattttaaaaattaaatggtttgggactccaatacatacctcttatgatgttttatctgaaggtcacaaacggaaataaactgcaaaccactgtaagctaatatcttaataaaattcatgtaacttttgtctaaagtaattaaaattctctccctagtatttttccaccaataaatgcacttaatacccactcaataattaatttgcactttagcagtttaatcagatgtttaaaaatacatatttacaataaaacaatagatattatagaatatttgataacataaaataattcaataattaaattctgaagttttccaggcactacatttttactattactattattttaagttaccttaataagtgtatagaaataaataataaattagagaagttttaggtagtgctcagtggcagtcaaaatatttatagctcataaggaatgggcacagaagaaatgttaccatgactaatcaaaacagatgctggctgtaaatacagtgtgtattccctgaatatcaaccctagctttaggtgtcaaatcaaaatccatctcttaaagctaatcaagaaaagtgaagtaatatgtagttttaccactgagttccttcccctactctcaagaaattgattctccgattattaaaaagtgtatgctccctcagtaaaaacatttaaaactttgcacagatcactgttagttctcaactccattcctatctaaattttagattattactaaaattttaaggctcttccatgtttgggtgtgtattttctattacatttttgtgcttagatttaccttttattttttaaatgacataaagtatttatacatatttatggggtatatgtgatattttgttacatgcataaaatgtgtaatgacaaagtcagggtatttaggttatccatcaccctgagtatttataatttctatgtggttttctttttttttgagtactctcttctagctattttgcaatatagaatatttttattaactacagtcaccctactctgctattgaacattagaacttcttttgtctgacgtttgtacccattaaccaacctctcttcatcctctcccaacccactcaatcctcccagcctctattatctatcattctactttctgcctccatgagatcaacattttagctcccacatgagtgagaacacgagatatctgtatttctgtgcttggcttatttcacttaacataatgacctccagctccattcacattgctgcaaatgacattccttctgtcttacggccaaatagtatttcattgtgtgtatatatgccacatttttttatccatttgtccactgatggacacttaggtttaatttcatatctttgctactatgaatagtgctgcaataaacatgggagtgcgggtgttcctttgatatactgatttctttttgagggggatactcaatagagagattgcaatagagagatctgtttttcattttatgaaaaatgtccatactgtttttcataggggctgtacttatatacattcccatcaacagtgtataagagttcccttttctctacatccttaccagcatctgttattttctgtctttttaataatagccattctgaccagtgtaagatgttatctcattgtgggttttgatttgcatttctctgatgattagtgatgttgagcatttttcctatacctattggccatttgtacgtcttcttttgagaaatgtctactcatgtcctttgcccactttttaatgcaattaattgtttttactgttgagttgtttgagttccttatatattctggttattagtcccttgtcagatgaatagtttgcaagtattttctgctgtgtttaaaaggtttaattttaaaaaacagtaacaatgacatcctacagcagttatgtgtctcttgacttcgatttattcactaaaatagtttgcatataattgatgggtgaattcctcttccaggcactctttctatggtagaagttaaaaactacaattcttagatggctttgccagaatatgaagcattggtataagatcaaaggcaaagacagacttcttcctgcctcctgcttttggcactgaaaatctcagcaatggtgctccaacagggtctgcagcacagaagtcttggtatctaggctctggactgctgattgcaacactggttatgcaagtgcagaacaatgcaagtgcagaacaacagcagccaccacaagtgactggaagctccagcagctgttacaagcacaacagaattcaagaaattacatattatcctggattcttgaagtgtccataggagtgcggacacctggcttcctacagtgcagtgagattggtgattccaacagccacagcaaaatgtggaagcagcagcagcagcggcagcataatacttataggctctggataacaaaactttcccttgctttctgaaggaatttgttactaaataatattgccaccttctatttgctcaaccagactttccaacacttttgtaatcaattccctggattgaagttcctcttttctgagtcatttctgtttgtcttggcattgattaatataagcccatactccaatatatgcataattatttataatatacatacattactacaatacatacattacagaacatgcagcaatagatattttaaaagactgaggtaaacaagaagtaaacattctaaatttggggctctgtttatcaacaattttaaaacattttgctcttactgaagagcaaactgctcttgatgctcttactgaaaaacattaaaacaaaaatttgagtaaatatgtgtcattctctacgtcttggcttggttttacactttgtaaaacagtcatctgaaaatacagtactattttcaggttacttagatataatggttgtcatgggtgcagaggaggggtggtggtaagttgagggagaaagcctcacaaaatagtaaattcaaatggaagaagagtatcaatggctgtgcttactacatcaaaataatcaattttcaatattaatggccaattatgtaaaatactttgttgaaatttagctagtaaatttccatcttcagatgaataagtcattcctataaactaagaggtgtagcgttttattttttaacaaaaggattttaaaatcaatttaaagattacatttgaaagatcttaaagtaagttataacattatgttccaagttttacaaaatatgccaatatatttttgtacaattttcaatgtatatagaaactagttttacaaatacattggtttttggcaagaaaatcacattgtaatgaaaagaattacaaacattcaatatgaaatgttttctccataaccacaggtccttcaaaaagcagttaccttctcactcattattagtactactactttaaaaagacagatcgaatatgttatttttcaaaaatatacattagagcgcatagtatggacagtcacctgtcataacagaaaaggtgagtaaaattagaaccttgtcattctgtaaaagaaaaatgcataactgccataaatttcttattacttctcaatactctaccactggataaccagtgaacctcaagtggtgcaaatgatattcatggcccattctccatcttattacaaagtatcataaagattccactaaaattttaagattctttcacatttggtaacatatttttgactacattttaaagctttaacttaaaaaacgaaaacaaagtgaccacatcaatgatgtcctacagcacttgtgtgtacttgtgacttcaatttatttgttaaaatagcttgtctgtaaaagactgaagggatttcatgtgtagaagtagttctgtaacctgcctcggcaagcttttttctattccattcaaatcgaccactccaatattctaaaactatgtaactatagataacatagattttcaagaacacactgttttactgtagggcagtattttgctgtttagccacaatcttctccagtgattattttggtgatttataacaacatagttcttcgaattatttcaattgagcctagcaaatatcattggatgaaatgttagaaatattggtactttcatttaactatatagtaaacattccacactgcataatttgttcaatacttgtttttgcaaatcttcagcaatgttttctatacatattctagcagtatttgctgacaaatgtgatagtttgttgccatattatttttcacacattatttcagccattattgctcttgaagaacagtgtttccaatggtaaatatgtttgtattttaatattgttttttaaatccccaaaagtcttctaaatattaatttaatgattttgtaaagtctgtactgagtctcacgtgacattaaacactgcttgattcatgatctaggtagttagattttaatgccttaccaatgaaatggtcttccaccatcgcacaccatacactgagggtgacattctttttcaatgacagtgaatataaatcatttcaaatagacttcttgattattatttttgatcaatgttcaaatattgctaaatcatcattgttcttactttataatgtagtttacaaagtgttcataatatgtttcagggatgttctttttcaaatgggcttggattattagtatcatcttttctatgctttttttcagtcagttgtctgttttgtaagagttagttttagttaaactaatctgtcactaatctgtgactccacataacaaggcacagataacatttagtagctccaactctttaacaaactccactctctcccatcaggatgttctgtttaagtagcaatgcatgtaaataatgctctgatattgcccagctctatctgggcatattaactgctggtaactttaacttcttagattttttaaataaaaaacacaaataacaatttttatttcctctcaaaccctaacgcatcatcttgcatatttcttggaatgcatggactttatttttgaggccactattctacagtatgggctttggactcagattttaaaaatatttattggatatgtatattgaagcaggttacttatccatgagtctcatatagcttatctataaaataagaataactatatcacagaactgtttgataactacattagattgataataagagataacatttttgtgaacatacaaagtgcaaggctctagtcaaagcacacaaaatttattaattcttgagtatggcgtctacacacaatgagcatttgataaatattagttttcttccccaggaaagagagaaagagaaagaaagagagagacagagacagagagaaagaaaaagagagcaagagaaagagattaactgttcaaaataagcaatatttattagggcaaataaagttggttgtttacatgcctatctcttccacaaaaactcaaggctcctaatcatgctgtagtcatcatgtatctgtattcaaagtacaaagatctgaatatgttatgtgctcaacaattaaataaatattgttaagtgaatatacatagggtgacaccatagcttgctgtttattatctgtaaaaattacagcaaatccagcattgacaggatgttcaattaactgcacaaccattgcaaaacatgctattgtttttgccaaattctattatactgttgcagaaagtgcagaaagggtaacactctccagagcttttgaaaatacagtactctttgattatttatactaacagatgggacataaggtatggataatccaaaaataatttgtttggattttgaaatgtgtttttatatttatatctaagcattggcatacctaatattctataagaatgaatgtactttgaacaacaaaactagagtatgaaaagctgacttagaaaaaagtttaattttaacacaaattagtttctcttatctttttccttaacacttctgtgtaacctataccactttgattactccagctacatagaactcaccttttcccagaccttatcagattatctaaatgttggtttctacaggaatattttctgtataaagcagggaattctcatcaataaatctgaaatcaagtttgcctaggtattattaaaaaacaatcaacagaaatataaaatatgtcatctgcttcaaaattaggaatttttatttttaataaattattttattcctttgtgtattacaatccattaacgttctccacaactcttttttttttcagttaagaaaccagaggtagagaaaaactagcttgtgatatacaatatttagttatgtaatccatctgatatctcacaagttttcctgtcaaattcatagtgctcttatttttttaaaagataaataaattattgtgaaatgtttaaatatagtaaaaggaggaataataaatgcaaggcatcactgtgtctcaatgagaaactgaaagattagcttttcatcttactcttaattattcatgggccatacactctatctctaggtgtatgggaagcagagtgcttcggtagaaagaacgtggcttttaaagtcaaagcctggatttgaaagaagcttccacattcactacctgtgaccttaaacaagttactatttttccagaatttcagtttcctcatagcaaagagaaggcaaaagtattaaatgagaacatatataaagtgtttaacccttaggaaatattcattacatagtaatccaatttctacctttcttcccaaaccagaaattctcaaattttgttgtattgtagatctcttttttaatttttattttttagagatggagtctcactctgttgcccaggctagagtgcagttgtgtggtaataacttaactgcagactcaaactcctgtgctcaagcaatcctcccacctcagcctctgcagagtggctggaactacatgtgtgtgctactgttcctggtttgtattatagatctcttctaactactaatgattcacatcaataattgatacttctctatcacataagttataaaatttcttcacataaactgttgaattaaatcctcactgtcactctgtaatcatactttaacctaggtcaaccagcgcacttaacattccatcaagcctgctcccctattttaaaaaaaaagtcctcaccagaactaaccgttttacactaagaaagtgacatctaatgataataaatattattaaactatttggctaggtctaaataagagcatattcacataaatatcactagtggttctaggacctaaaactttacctggtacaaatttttttttttttttttttttttttttttttgagacggagtctcgctctgtcgcccaggctggatggagtgcagtggcgcgatctccactcactgcaagctccgcctcccgggctcacgccaagtacaaatgtttttgtaacactttcctacaaaacagcttatgaaacaaattaaagaaaatatgctcacatgaaaacttttaatagctattatgattattttagaaagagaatgaccctcaaataaaatttagtatattttctattctttagtaacacattaaatttcctcagtataatttatttctttgaaaacgatattgaaaaaatagataatgtctaaaatactgggtggtccatcaaaacaagatccccacttaacctaaccaactctgagagaatagttggttaatcacttagattatcctagggccacctctcaagaccacaatttaaaaatcatttattgatcctttaccttctcttgaatatgtttcttactaattagaaagaaacagagtataaaagttaaaggtatgtgggttctgattcagattgcttaagttcaaatcttggctttacttttaaatgaattccttaacattattaacccttttgtactcatcactaaaatgagggaaataaaaggacctatattatagagtttttctgatgattaaataagataattcaagtactggtaataaaagttgctaaaatttatcaggcattttaccatattcagacactgtgctaaatattttatacatattatctcatctaatattcacaaaaccctgtataatatatcttatagatgagaaatgtgagatccaaggtgccacaactcatacaccagaaccatgattaaagcacactaatcctacagtacaaacacttagtgctaggtacatgggaagctcaatgcctggcacatagaaagcattcaataaattttagcttgtgtttatttctattttatctaaataccaatttatttgaaagttctaaattgaataaagtagttctcaaatattcaatttcacgattccgattccttgcttttaccgtatccaaccccactgttctaaaacagagagagagaaagcacacaagcaagagtgtaatactgtgaattacttatatgacacttagctaataaaagtcaatagatggaggagtctttaatgcatattactaaatgaaagaagccaatctaaaaggctacatactgtatgattacaacaatatgatattctggaaaaggcaaaactatggagacagcttaaaaaaaaaatcagtggttgccaggggctgggggagagagggatgaataggtggtggacagataatttttaaggcagagaaattactctgtatgagtcttataatggtgggtacataatattatgcatttattcaaacccataaaatgtataacgccaaaagtgaatcctaacataaactatgactctgggtgacaaagatgtagaaacgtagttcatcaattgtaacaaatgtaccgctatgctggaaaacgttactaatggtggaggctatgtatgtggcggtaagatgtgtttagaaaatctccgtatcttatgctcaaatttgctgtgaacctacaattgctctaaaaaaaaatcaagtctattaaaaaatttatcatgtagtagatcttgtataaagtctcaacaaatatcaaagaattaacatcatacaaactctctaagcacaagcaacttaagtaaaaaattaacagaaaaaaattttttgagtcaataggagttattttgggaacaaaacacaaagtaaagacttgaggggattgaaaccatcaggatgaatgtaagccagacgggggcaaattgcagaatgtcaattgccttaacctaggaaaggtaaatttctaaaaatgataccaaatggttaaaaatcactaaatgaggaattgaagagaatttcaggttagaaggttgtaaaaagtgaaataattgtccaaagtcaccaaactagttcacgagaaagctggaactagaaactcatgcctctcaatccagtgttctttccactgtaacagattggcaccatagaacatgtttgactcaaggcagtaaattaagtacactgaagaaaaagataagaaaaaagtgataaaatgtaaagtctttgattcagacccaagtattacagctgctatggcaaaaaatagccacaatttctaagtgactttaaccaggaaaaaaagaaagagatgagatttgaaaaggaattaaatttcaagaatcaacaggaagtgatgacagccttccctatttggtagtttcaggcctgaacttttgtcattaaggtaataattcaaagtgctttaatgcctggactgaccacactaaataacaaaattataacccgttgagctacggtcagttttataaactgtgcctaaaatttcctgagttcaaatctgattataaatgggcaataaattcatctgttcattgggctgatttactttattttctgggtgcatttaaaatcttttttattgtggaaactttcaaacatacaaaaagagtacataataaatgattcccttgtacccatcattcaatttcaataagtcacattttgcctttcaaattttacctattgccactaacatcctttttttttctggagtagctgaactgatttaagatgaaggaggaaaaataaaggatgaaaggaatattttcaatctgttattcattgatactctagccaaaaagattccagattatgaggcaaaaagaaaaaaaagacaagagtcaagaagtcaagaataatgaagttgaagtctactagtgagatggtctagatgcattacttcaaaataaatggaactattgtctatgggggaggagattttaacaaactattttccaataatttaagtttgaccaaagaaaaatggcagagaatgttgtaaagctttattgatattatagtttatagagatgggcttatcttcaaggaacataatgattaatcacatcatgtttaaattcatataatcgctaacttaccatattccagtaagcacctataggaagaaaagtttgcactattcataaaatttcaatataaccaagtcttagtttattcttaaagctcaaagttcatttttatttcccttgaagtctgtgtttttctgtacttgagaaagatctcctcatttttaaatttggaaattttaaattagaatttaaagtgactttggtcaagttcagtggtcttttttaagtaatattaataaaattacatatttctggacctcgaaggattcttctgagcatttagaatcatactgcagtttccagactaaacactttagccagagactatgagaagcaggcaatgaggcaaatacaagcatatcgaaattatcttgatcgaaaagaaaatgtggataatgttatgctgaaccgtcttaatttctgtcatgaaacaaaggggaaaacttggcaagtaaagatgagagatgaatttctaatgggggaagaggagttaaaactgaaataactagtgaggcccaactaaggttttaaagcatgaatctaaataccaagatttttttttcatatttggttcctccctattgacttttgattgcaagaccaatggacagcgaccgtctaattctcttctcttatcttccttagcaaaatgttagcatatagctgtctcttgcttcccattctcccttaaatgtaaaaaagttcctcaaccaaaaaattacttcctacatttcatataaatcaagtcaaattatgtctccatacaatcctatatctctgaggagatccttggttctccatggattttaattcagtcaaaatgtgtcacagtccctcagtgcctttatttgtcctgcctctccataaaatctaagctctgccttcccattgaacatttgtctatgaagactttctatatattaatcctattcttcatctttctgaccatacattcctaaaatggctacacatcctgattaatacatttctatgcattatagattacccattttaagaacctcagtgtccaccaatcttcatcacctactggcaatcacctttccacaagcctacattgacatagctatatcatttaccaactactgctcactcctccaagttctgccttgtctacagactaattttcagagtcaaacacccattcttgaggcaaacacgtattaatcaaaaggtcagaacccagtaaattacctggaaactccaatcactgtgaaaaacatgcatgatttttcataaaggtctaattattgctctttttttcaaatgatctgtcacaggctagttctgtgtgccatgctacaatacacttctttctatggcatccacttgagctcagtgaagattcttctattttctcaaatttacattcccctaagatatttggtcagcaaagatgagaaatattaggactctcattaaacattagcactttgccattatctcttaatatttttgtgggcacctattttcattccatcccagaaaaacttctttccctataccattttcccttcacataatttaacaatatctagaatagcacattaatagttgaagatgttctaatgtatgaattattactaaaacaattatttacctatctgatcatataatttattttagaaatcaaaatagacacagagaatagaaaacaaaagaagtaagcattctagaaacacaaaagaattaagaatggaggcagattaaactgtcaaaaagtgtttctttactagaaacactaagcagaatgcttgtcaattctctgacaaatataccactttataagctctggacacctgagaagagaaaatggcaatgactgagggaagttcctccagccaaagctaaatatgacctaagacctgacatatgtcacatacacaatcaacttactgctcaaaaccagtaaacacacatccaatccatcatttctaaggcacttgtacatatttctcaacggttatgtaccttatattctttattccaagactggctttgatgctaatgtttgacttcattctcctgaataaaaatacgtggcactagtacaggactgaggagaggctggggtttctaaactatcaaaaagttagttctgtttaaggataactcagtaaagatttcacaaggcagcattccttagcactacccgaataaaccccacataaacaagctaccaagccacctgaccactcttggcctttgtttcctcatcaataaaattaggataataatgttaactacctcatagtgttgaaaagaaccaatgagttaaaatatgttaagcacttaaatgttgtctggcatgtagcgatattaaagagctaaaaatggtattaataatacctgaatggatgttatttcattgagtaatttagatttatacaaagttgctaaaaagtaatgtaagtgaatagtatatgttttatgctttgttaaattaagaaattatgatatcaacttagagtcttaaatatactgaacttgtagtagtattccaattgaattagtttgaatattataaggttgccattacattttgttggggcttttttcctttttatcccacaggttgacatcatcaacaaatgtaagccaaacaaagcagttactgtaagaaatgctttaaataaacctaaagacattttaaaaaatacatatgcattgataactaggttgtatatataaaaaatgaagcatgttctttctaaattaaaatttagcttggggaggagtgtccgacctttaagaaaaagataaaactcaagaaacaaattgtaggatacttgcccaaccacatataaggacttactgtaaagctgtactaattagtaaaatgtgttactggtatagagatagtccaatcaaccaagaaacagaaaacagagcctataaacaggcccttgcagatacagacccctgacagacaagagctggcacggcaaatcactgaggaaacacaagaacatacagtaaacataactggaaaacatgtttctctatagaaaataatttaaacttttatgtctaaataatatacaaaaatcaactcaagtgaatgatttaagaaaattaaaaagcatgaaccattaaagaaaatctgtatgagaacataaaaattaagatttttatgtttattagaataccctaataaacataggtaaacacgagtttacctataaacaaaccctgtgacacgagtttacctataaacaaacctgcacatgtacccctgaacttaaagttttttttaaaaaaaaaaggaaaatgtgatatacaggccaggcatgctggcttatgcctctaatcccagcactttggaaaaccaaggcagaaggactgcttgaggtaagagtctgagaccagcgtgggcaacacagtaagaccccacctctccaaaaaaattaaaaaattaactgagcatggtggcatgcgcctgtagtcccagctacgcaggaggttgagacaggatgatcccctgagcccaggaggtcaagacaggagtgaaccatgattgtgtcactgcactgcagcctgggcaacagagcaagaccctgcctcaaataaaaaaaaaaaaaagaaaatgtgacatacatacacaatggaatactattctgcattaaaaagaagaaaattctgtcattgtgacatcaatgaacctgaaagacactataccaagtgaaataatccaggcacggaaagacaaatacagcatgttctcactcatgtgggagctaaaacaatgaaactcatagaagcagagagaatggtgactaccaggagatggtgggtggggagatgggagagatgttggtttaaggatataaaatttcagttatacagaatgaataagttcaagagatgtacagtatggtgactatagttaataacaatgtattgtttgcttgaaaattgctaagagaatagattttaagtgttttcatcacaaaaatgtaaggtaattgcatgttaataaacttgatttagccatttcataatgtaaatgtattctaaaataatgttgtacattaatgcacataattgttgtcaattaaaaataagttaaatttttacatgtagaaaataaagctaataatcattttttaaaataatacacacatacatacaaaaagaatgccctaaaagaagtgaaaagacaagctacaagggagaagagatagaattagtatctataatataaagaactcatgcaaacaatagaaaaagaatcatacaaatttttaaaaagaagaaaaataggtataagaaccaccatttcacagaaggaaaagacacatgtaggaaaacacacatatacatgttcacagccttgtttcttgagaagcaagaaagttcacatcaagactactgtaaggtattttttatttactcaggtggcaaaaattaagaagtctgacaataccatatgttaaagagaatatgggtcaacagggatattttatacaatgctggtgggagtgtaaatggctaatatcattttaggaaaacaatttgacaatctcctgcaaagtagaccatttatacatcttatgacacagcgattccaatctcagaatatacctaaaagaatgtcctccaaatgtcaccaagaaacatgtgcaagaatgtttattctagcaccattcacagccacaataaaagggaaacaactcaaatgtccattggtagaagaaaggatagattatactgtggtatagtcacaaatattatatagaagtgaaaaggaacctgtaagttacaattacacacaacatgggtgaatcttaatatcttaatgttgaaaaaaaagcaaattctagcagataaatacagcaggctattaatgagttattgagctacagctaataagttaataattggtattatttgtgaccatctgcaggagtaatattaaaagtttataagtggtaaagctgtattatttatgaaaaaatggaacaataagcacaaagtttaagatagtggttacttctggttaagggaatataggtgtaaggaaatgtgagttttgatgttctaatactttggttaggtcttggactcacaggttatttcttttgatttaaaataacaaacgaatgaatgaatgaaagaaaaaaggagaacacatggaaaaatgactatgaactatgttatgattcaccaattctgtgtgcttaaagtccaattcttttaaatgacaaatgatttagtagtacttctcacactttctgtacatatgaatgacttggagtcttgttaaaatgaatataattattctttaggtctgaagtggagtttgagattctgcattttaagcttgtaggtggtatgaatgctgccagtccaaaaaaatctatgttatctatctagtcatttccaaatatgaggtgctggggaagctaaaaagattgattgagactattcaaggcaacaataaacgtcaagccttgttaatgcaaaagtttaaacaagtaagcatttttattcagacaacttaaatcttagtctttaaaaaaaggaacagttcaggtgtggtagctcacatttgtaatcccagcactttgggaggctaaggcaggcagatcacttgaggttaagagttcaagaacatcctgaccaacatgacgaaaccatgtctgtactaaaaatacacaaattagccaggcacgatggcatacacctataatccatcccagctactggggaggctgaggcacaaaaatcacttgaacctggaaggtggggattgcagtaagctgagatcatgccatgcactccagcctgggcaataaatcaaaactctgtctcaaaaaataagaaaataaaaataaataaattttaaaaaggaaaagaaaaaagcaaaaccacctccattgttttaagactgagcatcagtgattcaagaaattcagagacttgaaggagaaatcaaataaactcaactgaccgctgaataagataacaggtgtcatattttggaatgtttattacaatgctaagaaataattatttgatttctgtctattccaaagagaagcaggtcttgatagaagacaccagaattcagagtttatgttgaaatgaaagacacttctttcctaaattataagaaactgaaataataagaattaagagaagatcgctttggtttcttgaggattaaaataaacagatcgctttaatttcccatttccttggtgttctctacaaaactgcaactagcaattgggacagtgatcactggtggttagaaattttcttgaatagagaaagaaaaaaacaaaattaagagatgactggcaatgacatatgcatccaagaatgcacgcaacatatattaataggtcctactactcgagtaacattagtattattgagaaacagtgaagaaatatatttaaaaatatgtctatctcaattgctattaatttcacatttaataaagataatcaatacacaagtagaaggtgaaaacgggtttgatttattacaatggattcattacgtgaaagatataatatcaaagagaatcagttgaggtagttgtttctactagccttgcctaaagtccatttacagaaatgaaaagcaaagattgcctgcatgtagtgactcacacctgtaatcccaacactttgggaggctgaagcaggtggatcttctgaggtcaggagttcaagatcagcctggccaacatggtgaaagctcgtctctactaaaaacacaaaaattagctgggtgtggcggcacatgcctgtaatcctagctactcgggaggctgaagcatgagaatcgcttgaacccaggaggcggaggttgcagtgaaccaagatgacgccactgcactccatcctgggcaacagtgcaagattctgactcaaaaaaaaaagaaaagaaaagaaaagggaagggaaggggagggcagtggaggggaggggagggcagtggaggggagggaaggggaggggaggggagggaagggatgggaagggagaaagagcaaagactgttgttccttttaagatctacctttggcagggcacggtggctcacgcctgtaatcccagcactttgggaagcccaggcaggcagatcacgaggtcaggagatcgagaccatcctggctaacacagtgaaaccccgtctctactaaaaatacaaaaaattagtctggcgtggtgtcgggcgcctgtagtcccagctatttgggaggctgaggcaggagaatggcgtgaacccgggaggcagagcttgcagtgagccgagattgcaccactgcactccagcctgggcgacaaagcgagactccgtctcaaaaaaaaaaagatctctcttttcagctttcttataacatcatgtctactactggaagaatagagaatctgaagaagattaaactagttaaacatattttttaagaatatttatgaaaaaagtaaaagtcaaatgattagggaaagaaaattttaaaatggagacatactttggaaaaagagtccggtataatatatttagacttagacacattcatccattcaattttctccaaaccagaatctaggtatctttaatagtaccatacggtacagactatagtgtattaagatgatacttacgtttcttattataaaagaacgtctaagtttttagacttttatagtggtgttatcaaccaactaatgtaggtatttcctaatactctcacaaccaaaaaaatggccaatggcaaattaggtgtctggtaactgaaagatcataaagattttactatttcaaagcatttatgctagagtcacttttaagtacagctataaattacaaggagataatttccaatgaaatataaaacagattacaaagctgtatttagctgtctgtggccatttaataagtcaaaacataatgcagcattatcattacgtcaagatgtgacaaaggcccagacttcccacaaaatattcctgtctctatactagaataagacatcatcagaagtacctgaataaaatctcccctcaatgaccagaaaaataaacgaagaaattttagagacctatcttagactttcagcgattaaatgtactcacaccttccatgcattccactcttctatctgttggaggtttatatagcttcatcagtaatatgttctattgctgacatatcaaaaggcttaatatcacacacacagcttcaaatatatatataaatgtccattaagtgtaaaaaatgccttcagattttcattatcatcactgtatccacatcatgctttttcaagcacttcaacattattttacttgactctcacaaagattgtgtaactgaggaaaatatctctattttaaagataaagatcctgagatacaaaagtcaagtgatttgcctataatcatattctatgctgacttctagggtttttttcatctaatatctttaaattctttcatttctgcattctgttactttgttgaaatcattattgtacctgtaatctattaggtcaaatcagcaaatatttatcaatcaacttctatgtgcaaggactcaattaatgtgtaattggcataattaacttatttgtgacatcaacagggataatattaaaattatttaacaactgacacaaaaggtaccaactaaagaaactgaacactgaacaaagtgaaacatacgctctaagttttatcaagggatatcaactgcatgtcagctctgatgtgggcatgaccaatagagtctgatttaatcacaaactacaaatcatttgtagatgtttatttggcctgaaatgctagaagaacatctgaagatttaagagaacatgtagaaaattctggtagcacgtggtccaaaattaacttaaagaaaatgcaaatataaaggaaaaaaacaatctgcttgggtgccaagattcagaaatatgaactcattactaccaaaactagccataatattttaaattattttaatttctttttttgtttgttttttgagatggagtttcgctcttgttgcccaggctggagtgcaatggcaccatctcggctcaccacaacctgcacctcccaggttcaagtgattctactgcctcagcctcccaagtagctgggattacaggcatgcaccaccatgcccagataattttgaatttttagtagagacagggtttctccatgttgctcaggctggtcttgaactcccgacctcaggtgatccagctgcctcggcctcccaaagttctgggattacaggagtgagacaccgtgcccggccaattatttttatttatgcatttatattcaaatatacctaattttaataaaatacataagtggggttttgaacatgtttttagcacaacttttcttttcctttatttcttgggtatctgctcctctcctttcatatttcctctcataaatagttatccatttttataacttagtatgcatcctgctacattcttcttcctttaaaaataaccctactataaggtagatatatacatatgcagatattacttataaatatacatattcaaggatctttgtaattattttttaaaggctgaatattatacacacttttctataccttgctcttctcactcataagaaactcctggaaattctttcagaagatctgagatagctttatttcacatcatttaatgacagcataatagcccatggttgagtttccattatttactagcattaccttgttaatgggattactattttctgcagttttaccactacaataaagttacaacaacctggaaaccaaaaaatacacatgttcttaaatattgctacctatatttctatggaatatattcccaaaaatgagactgccaggttaaagtatttgcaaatcatatgcaaattataattttaataggtttttggtagtcttacaagactgcattttataacaggtagaatatatcacatttccaccagtaacaaatactgttaaggtgcaaaatgggaatatactttcatttttttacatggagatcatcagttatgccagtcccattaatttaaaaaatccatcattttccaactaagttgtcatctttttcagaatttgccaatcatttccactgatctattatgtatgcctaggccatgaccatgttgtttagatgagctgactttgtaatatgttctggtatgtgtaatacaagtccctcctcattgctttttcatatttgcttgcctttcgttaccatttaatcttccaagtagttttaaaataacactgttgacttcaaaaaagaaaaaaaaatctcccaagattctaattggaattgcattatataatttattaactttgaaataatatttttattgttttcccatcctaaaccagtttgtccttctcttaatcagatcctgttttatgcattttaatatctttgttttcatatagttcctgtacctttcttgaaaaacttattaataggcattttgtaatttgtgtttctatggaaaatggaataatattttcccattgggaaaaaaagtctcatagatgcccaaattcctccagagcagagttgttttcatcttatcttttatccaactaccttatcaatttttcttactcatttttctagattttaaaattcaagtttctataatttttagaccatatatcatcagcaagagacacctgacattcttctctacaaatgttaatgttatatcatttaccaactgtatatgataaagcctctaaaataatgttaaataattgtgatggttccttgtttagtttctgttgttaattaaaatgtttttaggatttaacaatttaggccatgtgcagtggctcacgcctgtaatcccagcactttgggtggaggctgaggtggcaggatcacttgaacccaggaggttgaggctgcagtgatccctgatcatgccactgcactccagcctgggtgacaaagtgagatcctgtctcaaaataaaagacaaaaaaaaacccccaaaatttagaataccttttgccatttattgagataaacatgatttttctcctttaatttgatgatgtaataaattaaattggtatatttcctattattgaatcatgcttacattcccacttaaaaatatattttaaaatagctactagtgagttattattttgattcactgttaatattttctaacattttccttagaattttttaatatacttcgtaagtgaaattatacattttttactatataatctttaacagaattagatattaaattatggaatattttgatatttttccatggcctagaatgatttaaattacatcaaaattatgtattccttacgtttaagtgacaacatctggtcaaatttctaatcttttctatgctaagtagcatctgctttctacttcttcttaggtcaatttttatcatttgtatttgactaaaagtccttttatttctcaagggttttaaatttgtcacacagctacattcttatttaacattcttttcatcttccagttttttcttctttttcatttctaattgtgtacttttgtcattctttttcctaaagctttattagtgaattaaaattcatataacataaactcaccattttaactgtattaaagtatataattcagtgacattcgcaaggttgtataaatatcaccaactacctccagaacattctcatcactccaaaaggaaaccctatacccattaagcagtcactccccatttttccttctcccagcccctggcaaccactaatctcctttctgtttccacctatatgcctactctggacacttcatataaatgaaatcacacagtatgtagccttttgagtgtggcctctttcactgagtatgttttcaaggttcatccatgttatagtatgtatcagtacttcattattttttatggctattatattgtatagatatatcatagatgaataatttttattccttcattcagcagttgatggatatgagttgcttccactttttggctactatgaataatgctgccatgaatatttgagtataaattttatgtgaacatatgctatcacttctcttgagtatatacctcagagtggaattgacaggctcattttcttttttgctttatcatcttcacaaggagtttatgtatcacattgatctttccaaagaaccagcctttagatttatttcgggttttactatatggtttttctatttcattactttcatctttctaacaatctcctcatcttctatcttgtattattctttatactaacttcttaacattaggttatctttatcttccctcttccttaataacaaaggcctttaaggccatcaattttcctctgacaactattttagctaattttcattggcttttacaaaaaatatttccttttcattgctttctaggtgatttcctcttcatccaaaagatatctgggaatgttttaatttctatgtagatttttttaaccttttagaaaaactgttaaaatttgatatatgttagcttacagtcagagaaagtgcctgcaaaatctctgctctctaaaactcagttttcttagcagccaagtgcagagatgctcaaaaatatttaaagaatgtcccactgtaattcctattattcacgttttgatttctagatctatcctccaaatctcatcttttttttttcaatatttcatcatgggtttttttatatgcttggatacatttcttgcatttggtcttttcattcactaattcatatttcgacagtgactatgctctcccacaaatcctgagttgttcaaatgagatatatttaatatctgaaattattttctgttctttgaatttccttaagtgctcccaatttttgttttcaaattcagttttcatgttttcgccagtagtcctagttacctggagtgtgtactctgattttcctctctcacttgctatgggtctccttaaatgaattgctatttttcgctaactcactggagctcaggtctggttgccagattatcctaaatggcagaaatatcacaggtggtgaaaagcaaaggtaaacagcctgtcagttccctgcaaaggcacatggacaaagagctctgttgtcctatctctatttctttttagcctccaaagacagagaggactccaccaggacattcagctactttagctttttagcagctagcgacacttcggtacttaaaatggataaatattgatctcctcctacaggagttcacaaacctctaaagcccaagctcttcgtcccaatgtctattgctttctcatatttacccatggactccagcaccattctccagttgcttgcccaacagaaggcagaagtttcaaagcagtgtttctctgcccaaggtgtcatgacagttgtttataggtcacagcagccatttgcttcagaaagccaggcagcttggaattggaagtgaagaagataaccatatatagctactttgttttcaaagtctttaattttaaaaaagcctggggtggagtggggtatgtgggtgtgaggtatgtctggacttcattatacttattcctaagaatcaatagtttcctcagaaagcatattcctgaatatataaaatgacaatatgttcttctgcatgctctttagattgaaatcgtgaaatacactccagctattaatcactttaagtaagctttaatgcaatcccagttttaattattccaggacttaattatcttttgttttgaaaacaacttcaaatcaatttgctgtagtttcagttagaaagacaaattatgactttagccaatcaagtctgccaatgtctaacaagttttataaatatgaaaaagtatgtcagctatttatataggaattacatgtgtcccacatgtggtttacacgatgttaccctctatattgttcacaacccaactaccttttttgctttctagaagagctaagtaattatattatattatcactaatattacagtgtttaactggataagacttctaaaaactcagataattaggtaaaataattaaacctattttttaattgtgtgaaattttatgaacattccttaagaattagaaagctcatataaaaagttcaaaatctcaattgcaatctatgaattacaaagcatagtgtgctttgtttgtccctctatccagataggaatcatataggatatgaaatatgggtttcatccttaaatcagcagataatataattctgtgtactctattcaacacaatatcctgaattgattgtagtagatttgctttaccactgatgggagatacctgacacatttcttttctgaatcatggtaaatgtaattttattggaatttttgccatgatagaatttcattaagtacctaaaaggatagaaaactgtgagcatgtacaaacacgttgggtcttggaaaagtacagggaaagtctataataggtaataattttaacaatgctaaatttgaactccaataagtaaacggatagcctagtaaggaaaaataattttcccaggataagtacaaaaaagcctgatcaacattgaattcctcctgtgtgccagatattaggctaaggactaaagctataaagataaataaagcatggtacctgttgttaaggaactgcagttaagtgtactataattctaaatgttacctttcctaagtgatgaatgtcaaagaatttaagttataagttaaactgcatataaaacatcacactgaatcaaactcactttacaccagatgcacccatttgtgcattataaaactcatcattacacatataagacagaaacagagtaatgcataccccaaatgacagaaacaaccatttatttttggctcttatacactttggtaattcgcttaacaacaaatgttgagactgtaatgtagaatatttgaatcagaagaacctagaattttgttcatttttcccatactgcttttcagctcaaatgacccctttaacacagtattgccttgctctcaatccctttctaaaacaagaaagattattaaaaacatgagtgttcaaaggtatttctctgagggtcagatgtataaaggacagtgagatacaaacaacatagctgttaagaacactaggtcccacaggctatcaaaattacaagaacaacagagtaccaccgatgatgaacttgaggagaaaggtgccatgcactaactgaatgttgataatttttctaactttaaaatacatttttcagtgatgtatccatttgaattatataaaatgattattatactatacttcttaatgcattaaaaataagagaataaagaaaatatcagatattctcataaggaacagtaaagacacataagggatggtatagcaatttcattattctttgactgcattcagatgatacagcttatatttgtaatatagcttaacagtaaacattatcttttgaaaactttttaagtttttagtaccttgtatacaaagggtatatgagtatgtatgtatacatgacagaagtacttggttggaggtcatttaaattatctgcaataaaaattcactttaaaggttactataattccttttaattcatgcatgctgactatactaaatataatccaaagtcatgtacactgactttacctgaactgatttgagactactactctgatagaaatgcatttacactatcagataaaattaaatctttctttcagtatagtgacaaatcaaggaaaagttaaagtacataataaaagtctagactgtattccactcaaagcatagtagaggctgttttaaaattccatgaatatgggaaggaggagacaaaagctaaattccataataaataaaacaaaattaaggtatataatattttacccctcatatccatcacatcctcaagaaagttaacagatgttttcctgtttttgaaaattggacagcaaacaacaatgtagattataaatgttcctagaacagtgatttccaaattgggtggcacacagtaggcattcaataaatggcttaccacacagattgtgctacattgcatatctttgtcatgcacttaaacttactgcctaactctaggttaggactgatgatcatgtttttgtgccaaaagcatagcagtctttgttttcgaaactctcagtgacccatatttaagccagctattggtttctgaaacaaatgttaagggcacaaagaacaaacaaacacaaaagccttccaaagtcataggatttgctaccctttgaatatactgtttctagtctccctcacccctatttctgcatgatacctggttcttggttattcagtcgggtttgatttagttttcctttttgacctctaccttcccagaactttcagtaatacttcctttgtcctgctcctacccatgatttccaaggcctgctttaacatggtacccagctccactgttgcaaatagaactaaatcaggcagcagttagagtctattcattgtacaacctttagacaaattctctatcatcatttttaattctagactgaagagttatattttaaaaagattctatcacagcaaccattgttcctacttacaactctttcaccttgtacccttctctagaaccttctccaaatctatgcctttctgaaataaaattgccattattaatctgggcaagcactgagttaaaatcgtcccagaatagtggtctgatggggtggtgattaagagcttaggttctccagagctgtacttgagtttaatttcccatgtgttttatacttagctgtgtgactttgaacaagatacttaccctttctgagccttcgcatatctttaaaattgggataataaaggtacctgtctcacgggattgtggaattaactgaaaaaatgcagatataaccaatgactgcaacaaagtaagatctcagtaaatgttggctactattggtgttggtggtgtgattagtattcctgtttaatacaaggatagaatgcatttacttttcactgtgcttcccactaataattttgctagtctttttggtactcatggctttagaagagttacagtgattcttcaatatgtatactgggtttcagttaacactaaaaccagcttcccttaagcacatttagaatatcttttccattatttgcatgcattgaagcattcataccaccttttgggtccaacaattgatctaaaattattcttacaatttctcctgattagctagatgtttggtaagctaaaatagcttaccatcatctaacagacagtatattttggctacgaggtgatttataaaatattatatgatcagtaccaggaacatctggagctgtgggtggatgtgaggaaatgagaggattcaggatagtatagcttcctgcagattgctgtttccatctaaggtaatgttagatagctttaagcctttcactaccattcatactagcaaaaaggatgagtcaattaaacagaaactgagagtaaaattttaaattagaactttgaggttatcattaaagatatatcaagtaggtatatagaaattgtatatagttgtttctttcaatatataacaggacaatatttgcaaagtcttttctaacagattctttcctagtcagatttctttgcctaccttatcttccttcctatgtaaatctatctgtgcatggatataatataagatcaaaaactaaatgcagtagttaaaaattaccaattttataagatctgcatggaggtggttcctgattactcaatgtatacctatgttttgcttagagaagagaatcacaaaaccaaatttatcttttatctttgaataaatgtatctatctatagattttatagaaatagaaaaatgtgagttgattcattctgttgttacctgcatcctcaattttaacaactttatgctgcatgaaatgcagagtcaagtttacaaattctattagcaatacaccttcctgagttaagatgagttggcaaagtatttatgtaaactaatagatttattatacttacccactatgaaagattataagtacttaatatcatatatctatactttactagtgtgctatgttagaaagcatgtatcattaaaattaaacttttataaaagactaaaagtggaaagcaaagtcaagtattttacatatactgtttctaggtgtcctaagcatcagtttcagtaacactaccagaagctaaaataacaattcaattgttgaaggaaacaaactcagatgattagaactgaaaatgaccctaaaaatgaaaaatctaaggtgctaaggtggagatccgcatagattatgcaacatgccatagatcatgtaactaattaatggccgcagtagaactagaacaacctctactaacttcacatctgagatttttgacaatgtataacaaagagttgaatttaatatatgagagattgaaaaggtagatattgtccccaagttaaaaatctttggatgtaattacttctacttacttaattttatattcctaagacgacacatttaaaatagcataaaactgtaaaaactcgttagaagtaatgaaaactacaaacaaaatttatgctttatcttaaatcaaaaccatggaaaaggccattttcttttgtctaaaggaagcctgagatttactgaaaatgtgtgtgagtgcgagagagtgtgtatgtgtgtgtggtggtggtaggggtctttgttttgttttgttttgtaaattgttagagattgttctattaatagtttccttttgtaatggtaatctgtgctccaaaatgagggcacactaaaatgaatttctgataatttataaagcagtgaaatacaaatacatttctagaaacttactaatgacagtaagaaaatgggtaccaagagtttcaaaattaaaaatcaaaatctttttaatattatgttgaattagaacatctttttaaaagccaaaagtaattgaaaagagattaaattggtacactcaactctctaaactgtgtgtatatttttcttaaagtgcatatctgtgagctgacagtaaagacaggctggctgctttgtttgactatagttctgtttacctcatactgtcaagaatggattttgacacagtattaatattgctatttttattgatataattagcactgctataaataatttcttgtgctgccatatgtaagtatatcattacaatcagcagtatttagtgcttttcttatatgacaccttgaaaacagactgttggcccaaagaacaaaagtgacctcatgatatgggaatcactgaaaaaaacattgccctgtcaatagagactactgttttgtgtatgacttcactaaacaaactagtttatatttgtttgaaactaaagtttctcaccaatctgctgtttcaatttcacatcacaccatattgtacctaaaacaggcaatctggattcctgttgctactttttcttcccccaaacagctcaggaatgggtttgaaatacaaggcttgaatacataaagcaaaataattaagacacccaaaattcagaatgggtgggtgaaaacaagtacacttgaaaccatttgtgtaactactagtgggtggcccactgtgagtttttgattatatgaaagcaaaatcaaaacatattttatcttgcctctagatcacatcagctgtgacaataacctcatctggaccttgaatagtttgttcataaaacaaagtagggtgactgacccagtgcatattcaacacagagtatgaaggccaaaagaaaatgacaataccattcaaaacaagtttgtggaaattttagactagtatattaaaacctttctttgtctctatcacttgacagatggttagccttcacacagcctagtatctctggcaaagaaatgactgtgtctagccaataacaccccaaattttgacttaaaatgcactgtacacatgcttagacttaccttacaaatatgaatattaataaacttagtcatgcttactttattactataaaaacttgatagatgtcaagatttcatcttctgccgttaaaaataccttcttgaaactcaactatcttaggtggatataaggttccatgaactctgcacttcagatttcattcatttcacaggttggctggtaatcatgcttaaaaaaatacttccaaaataacacttcatcccaaaaatataaaatttatagaaatttaattagcttgtgtttctatgctatccataggaaagttttggtaacaaagtggcttaaacaaaatcaccagggaaccctgaatacactccatgtcaaggaccacaggcaggactggaattatttatccagtattgatatgtctttattcaaaaactgctcatttataaatatatactcacacacacatgcaaacacacatcgatcaaccatccttaccagaaaacaggaaatggtcttactttttaacattcaattagccattcttccattttgctctttaaaaaaaattcaactgaggctgggcacggtggctcacacctgtaatcctagctctttgggaggccaaggcaggcagatcacgaggtcaggagatcaagaccatcgtggccaacatggtgaaaccctgtctctactaaaaataacaaaaaaattagtaggacgtggctgtgcgcgcctgtagtcccagctactcaggagactgaggcaggagaattgcttgaatctgggaggggaggctgcagcgggccaagattgtgccactacactccagcctggcgacagagcaagactccatcaaaaaaaaaaaaaaaaaattcaactgaaacaatgtattccattagttataaagtctgtttcctcctaaatcttcctatttatagttttcagatgctggcaagtccgtatacaaatagccagaggcaatcacaaactgctctaaagtgcattaatatgtacccttcctggaagaggctgattatgttccaaattagcataaatagagatctaatgtaggtataagcgtgacaaaccctccacggcacaggatgggagggctggaggagggaggattgtattaaaaaaagttattccacttaagaactaaacttgtatttggctaacaaagtaagactcaccatgacagatgggaaaaaaaattaaaaaggaaaaactgttatttgagaactatgaactaggttttggaaaggtgagacacccactacttgaagtcacaatctcagcattaaatcatatactcatttaaccaggtaccaactttccttctattagaaacccaggatttttacacctacagactaaatgattaaagtattgctaaaatcttctgtaatgttcctcttgcattacaaataagtctattaaagcagaaaagtgccaatcaaatgcttttgaaaaaatggtttaaataacaaagcattttttgcaggtctctcctctttaatgtcgcctataaactaattacaataaattttcaccttctcttgataaaatcacaactgaaactaggcatggtggcatgcaccttagtcccagctactaggaggctgaggcaggagggcggatcacttgagcccaggagttaaagtacagcctgggcaataaaaggagattcccatctcaaaaaacgaaaaagaaacccagaactgaaaaagatttaggtacttgatttttcagatatgttcctaaaaacaaatcccaaccaaaaattaacagatattctagcttttgttttaccatactttgctaacgggataatactatgtaggaattttatagtaactttcaagacacaagatttttttaatataaagcaacgttttattaatttcaaagacattattaaaatcatgaaaaaaatccctatctgttaaaattaccaactgaaatatatggagaaagtttcatgacaataacaaaaggtacaaataagaaataaactaagatctttctttcctatcactgccaactggtaaacaccttcctccttctcaaacttctgtaggctctttcaaactgtagttcctaagacaagaaagcagctaggttttaaagtttcattaaaaaatctcctcccctaacaatctaaaatgcacaaagtgtgtgtgacattagaatgtaagctccacaagggcaggcaattttctctcttgttcattattacactccaagtgtctagaacaatatgataaatttaaccatccatttcagaaaaatatgattatttcagagactaaagcaaagcccatcaatctctacttccgtattccaaatgtttttgaagaagtctctgcttgccactgattctgtgaagttattcaaaataatatgtaattattttataaattatagatcgcaggaacttagctgtagcttttattgcccttctaaaacaacctaattattcagactggcctttttttctagaaagtccaatttacctaattattcagactagcctttttactagaaagtccaatttgtctaaaaagtcttctgaaaactttcactaatgcaacaaaaatgattcgcttaaaatattttttccttagattttcttcctataccaagtagtcaaattcttattaacaggacaacaagaggaattagatgtttgcgggcctcaaaaactttctgatccaattatagaagaaactggcatcacatcaactggtagttctaaacacccccttccccaattatagccctcacatgaaagtttctctttcctctagtattccatttaatctcgtattttcttttagtagctagtcaatgtacacatgacctatatgtgcattttcttggttttgtagtaatcttaaaacacgggcctagatgggtaagcataaagacttcttcctggaaatggataaaatttgacaatttttaacctgatactttctttagcttgttaaaattaggacctcaccgtgaaagggcatattgctgtggaggctggtaggcagcaaacttgtcacctgatcttcatatgcacaaggcctgtattccactggtctataaaatctgaaatcataaaaccaaaaatatccaattgcccaactcactgagcagctaatatagttctagaaatctcacttttcttcttctcacctgtttacttcaacaccatgtgtccccaaacctaaggccctccaaaattgagctccataaaaatcaaaaccccaatcttgaaaattaagccttgagtactgaacagttacatcagcaattcctcaagggcaatttcaaaagctttcctgggagactactggaaagatggcacagggatatcaccatgcactatgtgtgcaacaactttgatatattctaagaatcacaaagaacaaaggcatgaaaatcaatgtaattttttttctttcactagaaaaatacagattcttcattttaaagcaaaaaagcaaaaagtagccacatcttgactggacaaacttacagttgaccctcagtatccatgggagattggttctgggacctctctaggaaaccaaaatccacagatgctcaagtcccttacataaaatagtgtagtatttgcatttaacctaatcacattctcccacatactttaaatcatctctaggttacttataacacctaatacaagtaaatgccatgtattaataaatcgttgttacactgtattgtttagggaattgtggcaagaaaaaaactatatatattctattccatctattcccccacacccaaaatatttttgatctgcagctggttaaatccacagatgcagaacccaggcacaggaagggctgactgtatgtgaccgggagtggagggggatctatataaatatttccacaaaatagcaaagggtacttgggattgggagcatgaacagaaatgaaaacaaaccattataaatttaaagatgactggttatcacttaaatttagtgtctacagctatttatttataaaatggtaattgtgttttaaaactttcaatggcaacaagttacaacagtaacttcagaatagcgttcacttgaaaacattgggtgaatggcctctataatttttttagctgaaatgtatacaccgccacgcagtgaggaaacttgactttagcacccttttggtatttttaatagaaaaaacagtggagaagattttcacatgtctagaaaggtaacatgttcaacttaggtttggccaatgctgattctgaggacagtactacacccgcaagcttccaaactacttcctgattcattcagattttcattggagagctgtcatcctgctactgacctcattcaacccagttcggagtgagagatcagcggattaccgcgctaggtaccgtagctgtacgccatattgtgtttttcgctaatgtttagtttgtgtgtgtgcctagcatatgtttgtgcaagtgtgtttatcaatagaacttttagaaaatccctgcctcctgcctcttcagcatccttaaaaaggataacagctgggggcggggggtggggggaggacccaaaagccacacagacaggaatacattaaacagtgtacgagagacggcatttgttttaaactttcaagaaccttccaaccatttttatatcaggaatcaaaaagtgttaacatgttttaatgtttccgaagtggcccaaagaagagaaagaaggaaaggtgtgtcttcccttcccaagccccctcctctctagtcgtagaagcgaagcaggcgggggccgggagctccggcgtctggagagacatccagcggctgtggggccaggacacctcctgccccccagttctctgaagacgctccagagaccgcgagagccacggcaagcgggggagggcgaggagggagggggcagaagacaagcgggcgcctctagcagctcctgagccccggctagtccccctcagctcctcttcttggaagcagcggctccaggcgcagggagtagagagaagaaggcagaagacacgtttccagctgcgggacgtcccgcccgccccgccacccttcgaccctcccgcgcctccctcccacctccccgccgggtcgggcgaggcagccgccgggcgctaagaagggcgccgggggagggggcgcgggcggggcggggcggggcggggcgcgggggcgcgcgcgctcatccagctcagggcccgctggctcgccgctctgtaactcgctcccccaaccccaccccgctcccctccttcccagtcccgccgccccccactccaggcgcctcgcagacgcctcatccccctcggcacgcacacactcctccctctctcccgcccgtcccacaacaaattagagtttgtggcattacctcctcgcgctctttaatcttctttcctcaactcctaaacttccccccgcccctacttcttc

SEQ ID NO: 126 - DNA, 95662 bp, Homo sapiens
cgggtccggcccaggaggcttgggcgcgcgcagccatcccgggcctcgccggggacctagggacgcaggcaacgcctgcgcccgctcaccatggtcgagggacgcgtctccgagttcctgaagaaactcggcttctcgggcgggggccgccagtaccaggcgctggagaaggacgaagaggaagccttggtgagtccccgcgactccgcgccgggcgtgcgacccgaccccccatcccctccgtcgtaaccgtccccggcccgagaccccgcgttcgcgctgcgatccgcgaactcgccctcctcccctggctctggaaagaagctgtcctcacagcaaccgcgctctcatctgcgctctggcgcggggagctcagcatggaaccctcacgtgaacccattttgtggttgagaaactgaggccgagagtggttaagtatattccctaaggggcacggagctaggaagtgacctggctgggaacttaacctaggtttctctgactccagagaattaaaattcctgggtctccagacttgggctgctttatggatttttaaaacttaaattggaaaataaaattagagggatgcaaaaaacaaaagattgctgaaatgttgtagcaataatagaaagcaaagttggagctgagggacctcccagcctcacttcctacagtcaggtacttttagaaagtcactcagagctgtatgcctgctttgcaaccttcagggaccctctgggataaagcagcagggtgccagggcagggcggttcatgagggaacgaagtggcaaagctgtcaaataaagcccctcctgttccttggattcttggaagccaggggtgaagccaggcttgagggtgacccaacacccttctttttagcttcgcaaacagaactcgttgcatgctttaaggtcaggggggcactgaatttctgcagaagcgtttctctgcacgccagagggtcgttgcacttttttttttttcatttacgcttaagcagtcgttcaaaagtaacatttctgaacgagtcccctgggttgctaattagaaatatgacttggcgatggccttttgaccagtgaaaggaaacttcaaaggtaaacttaccttttaattaaaaaaagaaattagctgaaaaaatatttgacttaaaattttatttttttctcccaaagaatactaatggtcaaaacattttgtttgtgagattaagtattcgtgcttttttaaaaatagtgttttgtgcttttttaaaaatagtgttttatacatccctgttgatgtaagaattctggtcttagggtggtaggccacaggaccacgtaactagcagtttttgagcaatctcgatttttctgaagtggcatgttaatattgataggatatagagttcaattaattggctgtgatccatttctctgcttctgcgatacattctgctaaaggagtttgaagtttatttgccatcacaggttgcctttcctatgttgccattcctgttttttcctttccatcttttgattcttgcatcaggccaggtatttttcaaactctcctggtgtgtagttggttaccatcaggtttcacaggatgtccaggaatgcaggtgcatggatgatgtaacctcaagggagatgctgggagagtttgatctctgtgccaggtggactcgtccctccaaagctttgcaggagagttctcagaggtctgacaggtgttcagccggtctgtcagtgtgctctcccacctggctgtggaccggggtgctctcagcagcatcctgaggccctgggtgcgtgatgatgggcagtgtgcagcgccaggaggcgggtgataccagcactgacaccaaaggccagctgagaaagaagccatgctgtctccagaggcagccttgtgcaaacccaggaaatgtgcaaacccaggaaatggcaatgaagatcgatgggaagtgtgaggagggagggaggtggggaggccgggtggctgggcgaggcactcacttcctgccaggttggctcagacctgaacacctcctttgctgtcatactcatgtcctctcgttggaactcctttctcccagggtttggaaaggaggcgatgtgtgttgaggtgatcacttctacaatagttggaattgtctttttttttttttgcgttatttcatactagtttatttaggggttccattttcactcctcaatagaaccgtcttttatgagcactaattacatgccacatccaggatgcctgtaggaggcctctaagccctcccctcccccagccactttgaccagttaccccagttctaatagtgattgttactgagaacttgctgtgtcttctcttgggcctcttacctccaaggtaaattttactctcgtcatgtgatcaatgaggatgtgaggctcctagtggggccacgtttgtttgctcagtgagcatttcctgacagccagttttgctaggcgctgaggatacagatgtgtacaaaacaaagttcataaaggaggccaatggtcagctgagaaactgggagatgctttatttgagacccagtggtctcaggtgcactggagaatcaaagagtagaggaccagacagaggactggtggttgagaggggaactggagacgaccccatgttagaagcactggagactggatttcagcatttccaggaatggaaagaaaggtgtttgagccgggcgcagtggctcatgcctgtcatccccacactttggaagactgaggcaggagggtcacttgaaccccagagttcaagatcagcctgggcaacatagccagatgccatctctgcaaaaaattaggcgtggtggtgtgcacctgtggtcctagctactcaccaagctgaagcaggaggattgcttgcacctgggaggtcaaggctgcagtgagttgtgatcatgccactgtgctccagcctgggcaacagagtgagaccctgtctcaaaacaaaacaacaacaaaaaggtctttgagaggcctccttaatttagttactagaaaaagcttctcactgctgacctgaacattagggtaaggaagagattggagcagaaattcctgcttcccaggtgactcagcgccaactccgggggaagctgtctctgcccctcagggctcccatctcttaagtgaggcaggtatagccccagcccactgccttcctggctggtgagcagatgcatccttctgggctctccagggtgaggcttggatcccaacagacgaatgtagtgaccacccatccattcaacctagattcacggagggggctccctctgtgtgtcaagtgagtgctaccagctggagttggggctgataaggatgcacagttctctaccctcaggtatcccaaccaggaggcagagacaggcacccagcaactggtcacagttcactgtttaatgccaacgtgtcagagctgggagaaagacgtgatgtttaagatgaataggagtggcaaagggtgagctggatgaagggcagggattgacagcgagttctagacagaagaggtagaggcgttggggttggtaggatgaggctgcagaggagggtcgtacggagccttgtcagagtgtgggctttatccctggagcagtgggggatcgttgaagggttttaagtcaggacatgatagtcactcatttattcccagatgggccaaacattagaactgtgataaaacaggcacagtcagatttgtgtttttaagagattacactcagttactggaaaagagtatgtgtgtgggaattctgaggctcatgcacacacaactttaacccaaggcttgcccaaactcacagatcattagtgtttctcagaattcagcaacatgtgggcatcttcttaaagaaatgtactgcaaccccacagtgttttttctttcgagacagtgtctcgccctgtcacccaggctggagtgcaatggcatggtcttggctcactgcaacctctgcctcccagattctcctgcctcagcttcccgagtagctgggattacaggcacccgccaccacacccagctaatttttgtacttttagtagagatgggggtttcaccatgttggccaggctggtctcgaactcctgacctcatgatccgcctgcctcagcctcccaaagtgctgggattacaggcgtgagccaccgcacctggccagtgttgtcttaaatgatttgtacaaaagtgtgatatcaagtaagtataagcataaaacttgtaataaacataactgtttgcttataactcaactataaaatcaggttcaatttaggcctgttgcggtgactcactcctgttttcccagcactttgggaggctgaggcgtgcagatcacttgagttcaggagttcaagaccaacctggccaatatggtgaaacccctctctactaaaaatacaaaaattagccaggcgaggtggcaggcacctgtaatcccagctactgcggaggctgaggcaggaaaatcctttgaacccaggaggcggaggttgcagagagctgagatcacgaaactgcactccagcctggaagacagagcgagactccctctcaaaaaaaaaaaaaaaagtcaaatttataataaaattataaagtacaaatagaacagccttattttgatatattggtgatgtctattaaaactcaatcaggctgggcatggtggcttacgcctgtaatcccagcactttggaaagccgaggcaggcggatcacctgaggttacgagttcgagaccagcctggccaacatggcaaaaccccatctctactaaaaatacaaaaattagctgggtgtggtggtgggtgcctgtaaccccggctactcagaaggctgaggcagaagaaacgcttgaatgcaggaggtggaagttgcagtgagccaagattgcgccactacactccagcctgggtgacagagcgagactccatctcaaaacaacaacaacaaaaaaagagactggaaaccaaagccttttttgaatctcattttgaaatgaggtctcataacttctgccatattctattcgtttgatgcaagtctaggtccagtctacactcaaagggaaggggttacacaggccatgggtactgggagggagtgatggctggggactgccttaaaggctgcccattggaatagtagaaagaaatatttccttcaatgacgtcattcacgttaaaaaaaatcctagaaccacatctgacatgtcatctgctcactacttatctagttttgttagtgttttcattcatcgtaagttctgttctttaaactcttttgaacttttgattttgaaaatactgatgctaagaatgtctgctaatgtgtgtatgtacaaaatgacatttacatttgtcaggactttgtttgctagtttaggataatcagactcaaactcaagtccaactgccagcaagcagcctacgaatgccaattttaaggctgtcatctgataaccgtagaactggctcgttcacttgaagataatgttagtgttgggcgttgttgaaagaatatttcttcatttggtatctatttgtatgtactactacacttagtgctcattgacggtgccagctgctacgtacaaagactggattcatgtaaggcacctgcttgtgacgtgactacacttctcaatatttaggtatcttaggcttttctcaccgaatccacaattgtgcgctgtgtgatgactcaattcttctgctaacctttctctctgagccattgaagctttcagtgtgtgtcagccttcactgggatgctacagtgtgtgctgtgatggttgtcatggatgcaaatatgcacactggtgttatgtcacagtcctgagttgtaagttgccccccaccccgaaaggtctgtgttgatcagacagtcattgaaacacattcaaggttaataagttctcagaaaacttgaaggctcctgagaatacgtctgaagatggcatcccggaaaccctgcccccaatccaaatgtcacaagcttttttttaataagggtaaagaatcccagagtcccaactagaaggaacttccagtgtgttaaatggttgctgcttggtggccatcatattaggggtgggactgggagctgatggggggtcctttggttttcatttgtgtgcacacaaattgtttgtagatttggtatttctcctaaagcagaggccatctggatgagaacacaggcagctgctatatcttcaagggttgacattcagctgctatttctctttcggggacaaagaaatacagttatgaaagacccgagagtttgggttttattgccaccccacctaataatctatcaaaaaggagagaaagggaattagcagaaagcttattcagggacttcaaaaatcatatagagtatttagatgaacctgtccaagtcagatgttgagaaggatggtattcggatggttgtttgagggttaatatagacacctggtaagaaggacttgtctcatatcagatacaatgaaaacaaatactttaaaacatgaaatgagatattcaaaatattaaaaaatggccatgagtagaggtttgtttacagatattctgggatatctagatagcagaattctcacagacactgaaacagatgctgtagaagcatatgtaatgacacagtggacggctatgattctaatgtttttaacatgaaaaacgtcaaacacggcccggcgcagtgggtcacgcctgtaatcccagcactttgggagtcccaggtgcgtggatcacttgaggtcaggagttcgagaccagcctgaccaacgtggtgaaacctcgtctctactaaaaatacaaaattggccgggtgtggtggcatgtgcctgtaatcccatctacttgggaggctgaggcagaagaatcacttgaatcggggaggcacatgttgcagtgagccaagatcatgtccctgcacttcagcctgggtgacagagcaagactctgtctcaaaaaaaaaaaaaaaagaaagaaagaaaaatgtcaaacatacagaaaaacagaaggactagacagctgtctgctcacccacgtggattccacgattcttttgccatctttgcccctcatgatgtatcattcagtggaaacaggtggtcgtaatttcttttggaaaaaaacatacttttacaatgtgcagagaatacaatctggagaaagatcattttgagcagtatttttatcttgggatgacaaattttcttctttgtaatcttgtgcattttccaaatttccagccacaaatatggtttaattttgtagacagaaaaaaaggagatgtgaaaaataaagaggaagtctgaacaaaagaaggggagagaaaggattgtgggtttttaggtctgtgttgcctttctgggctcggtgggggtagctgggtgggtgtagctgggtgggagtggtactgtaaacagcattattaggcaagaatccagatccccaggggtggcggtgtatgagcggtgccagcccagagctttgggcgccagtgggagaaagaggtggatgggacaggggtctgtacgtgaccatttgggggctcctgcgaccccttgcggcttcccaacacagagataagtagtttgggtcagcacatttgaaacttccacaggggagtttggaatgaccaagggcagggaggaaaggtctctggttcaaggaaggcaggtgaggcgatgaggttgccatgagggcaggactggctacagaattcgtggggcagactgccaatagcaggaagacacttgcttctgtcttctgtgatctctccctcgagtgtcctggtgagttccacttgatatagattattggtctccaccacacaagggattactactgggtgagtgtagaccaagtgtgttcaacctgcagcccaagatagctttgaatgcagcccaacacaaatttgtcaactttcttaacacattatgagattttttttggcaatttttttttttttttagctcatcagctatcattggtattagtgtattttatgtgtggcccaagacaattcttcttccaatgtggcccagggaagccaaaagattggacaccccttgtgtagaccctgccaggtatcccccatcggggaggacagtcatggccgctgggtggaggaggggagatgccaagccccgggcacacatcatcccatggggctaaatttccacatacacattcagatccaatgattacgcattccaagatggcagctgtggagcatgaagcctcaaggccaacacctgtcctgcacggggatctctgtgcaattgcactggcctcatgccagtgaggctggccctgctgaagggttcttgtcggagaggaaacatccaatcgatacctcccctgtggactgtcagtgattcttctgaattgtcatggggttaatctggatctgtggacgcttcagaggctaataatcccagtacctctggtctctaaggcatctcacatgatggtgataagaacatgggaaatttagtagtggaagtcgtgtgctaagactgagtgagtagtggaagccgtgtgctaagtctcagcgagtagtggaagccgtgtgctaagtcttagtagtggaagccgtgtgctaagtcttagtagtggaagttgtgtgctaagtcctagtagtagtggaagtcatgtgctaagtcttagcaagtagtggaaatcatatggtaagcgggagctggtgggagctttcaatccaatcacctgtcttccctctccctgcctggaaggtggagtgggccggacaggcatctttgttgtcaatgaatatgaatcccaaaggtgtccagccagctgcccttgctggagactccacttcctcacagctcatttattgtctcagttctggaggccagaactccaagagcaaagtgccagcagggttggttcctccggaggcctctctgcttggtttgcacatggctgccttccctgtgtcttcatacggttgtcctctgtgcatggctgtgtcctaatctcctccttttacttggacaccagtcgtattggattaaggccccaccaatgacatcatttagctgtaatgacctctttaaaggccccagctttaaatatagtcactttctgaggatatggggtgtggggtttagggctttagcctgggaatggtgggggggttggacaactcagtccaacaccatgttctgtgtagaaattgacttgaaaggtatttttttctttgaggagctgtgggccaccaggagaaaatttgtaattgtgtcttgaggctgcagcccctctggaaatgtttatcacctctgccgtctgccccaagtcctcaggagaagcgggcatggtgccccactagctgggccatattcctatgaccttccctaagacctccctgtggcctattggagagaagagagctcagcagaggatgtgttgtttggcccaccttgaaactcaagtgcaaacagagacagggaagagaggggcccaagatctgcgattccagagacccagagggaagagatgacaggcaggcactgcacctcactttcctaagccaaaccaaggacgccaactcccaggctaactagaactgcttatttcacccccatgcacttctcaggacgctccctgtctttgcctctccagctggaccgaatctgggggctctgggcgtaggggaaggagtgttggtctgagtggccactcttaaccaggagccattggtgtagggcagacagggcccctccgtcgccggccacatggatttaggcaggtgtaatctctccacattcatgtgtcctggtgtgaaagtggaggtgttgggtgcaagaatggagggcagcattggattccccttctgactgctagattcctcctctccctggctttttgtggaagctgtgttgggtaacagatctaagcattccacaaagttcccctcactacgcctccctcagtgaatgttagtaatcaaaaaagagtaagtgagggaaggtgtttaaaactctctgcacaatgccttgttcacaagatgatcttgtttttcagaatcaagccctgtcttgctttgaccttgggtcatgtgctaggcgctgtgtccatagaaagcgctcagtggtgggggcagggccgactacgtgattgtcaggctcactgcaaaacggccccctccttgaaaaatgactaagaatctcaagaaggcggcagcagagattgagcaaagtgcaggctgccgtggacacacgaagccatgaacgtggagccgggcctggtgggctcaccgtcgcgaggtccctggctggagacaccagcaagctcttgctgtttggggttctctttttcagcctctactccagccactcctctggccctcacctacttttttttttcaacttctattttaagtttcagggtgcagggtacacatgcaggatgtgcaggtttgttacataggtaaacatgtgccatggtgatctactgcacagatcatcccatcacccaggaattacgcccagcatccatttcactctcttcccctctcttcccctcctttcccctctcttcccctcctttcccctcccctctcctaccctcccctctcctgtcgtttcctttcctttcctgatagggtcttactctgccatccaggctggagtgcagtggcgcaatcatggctcactgcagtctcaatctttctgggctgaagtgatcctcccacctcccgaatagctgggaatacaagcacacaaccatgcttggctaatttttgaacagatggggttttgctaagttgcctaggctggtcttgaactcctgggctcaagagatctgtccaccgcggtctcccaaagtgttgggattacaggcgtgagccactgtgcctggctgatcctttcttttgatgacatgtcctccaagtgtgggctggggaccaacagtgtgagcatcacctgggagcttgccagaaatgcagaatctcaggttccaccctggaactacagaatcagaaactctgggcggggtcccagcaatctgagactcagcaagcctcgccggggggttctgaggctccctggagtttgagtactgctgctctgggtgattagcttctctgcgtgtctcagatccatcctcctgtttgccaggccctcttgcagatactagagacaaaagagtgagcaaagcgctgatcctactgggtggggctcatgttctggtagggaaggaagatgtctatcaaataattcctccagtgagtatataattacacactgagataaaccccaggaaggaaagcagagcctgtaagaaagaaggtaggtatggcctgggtgtgggggatgggtgggaatgctactgttaaagtccagtgccatctgggaagacttcctggaggaggtggcaggaactcagagaactaagccttgcatttgggctacacgtgctcctgcatttattattttcattttttatatcagccacatttggtacaccctggagcctacagcctgacctgcagtagatttcaggaaagataagctggcctccctcccctgtgatctgggaggtgcctgttccccagggaaagtctataaatagccagtctccttcagcaacacctatctcaccaggccttctcctccttctaccccctcccccagatatcagcatattgaaatttgagtgacagttttgccttcacttattattgaattctcctaatagtagttgctgtttatctactatcttgtgtgaaccgggaattgtatgttttttttcttctttccctttttccttccttcttttcctgtctaaacttgtcttaagtttttctcataaaccataaataaaaattggcacaatttaaagttcctccttcactcccccactttatggatcctattttcccccgtgacttggggttgggggaggcggagggaggaaggtcctgtttgtttctgatcagtttgcggtaatcaggtcactgtttgcttgggtgttcttggccccttttctgcgcaagtctagagaggctgcaggattgtggttaagagcacggaagtctacagcccaggctgcctggatgcaaattctagttctgccactcgccagctgtgagacctcgggcaaacttaacttttccctgcctctgtttgttcttctgtacaatggggtagtaactaagtgtacatacatcggggggtctgttgtggaatggagtcatttaatacacatcaagcatgtaaggtagcacctgatcatggtgatttttattagcaataattatttaattataagtaattattattatacaactacaggctgggcgtggtggctcacgcctgtaatcccagcactttgagaggccgaggcgggcggatcatgaggtcaggagtttgagatcagcccggccaacgtagtgaatttcatgcgcgtccgtgtgaagagaccaccaaacaggctttgtgtgagcaacatggctgtttatttcacctgggtgcaggcgggctgagtccgaaaagagagtcggcaaagggtggtggattatcattagttattataggtttggggataggcggtgaagttacgttttgcgtgcaggggtggatctttcagagtaccttcttaagggtgggggagattacaaagtacattgatcagttagagtgcggcagaaacaaatcacaatggtggagtgtcatcagttaaggctatttttacttcttttgtggatcttcagttacttcaggccatctggatgtatacgtgcaagtcacaggggatgtgatggcttggcttgggctcagaggcctgacagtgaaacctcatctctactaaaaatacaaaaattagctgcttgtggtgacatgagcctgtaatcccagctactcaggaggctgaggcaggagaattgcttgaacctgggaagcagaggttgcagtgagccgagatcatgccactgcactccagcctggacgacagagcaagactctgtcctgaaaaaaagaaaaaatatttaaaaaaaaattatacaactacataagtgtcttttccctcatagattcatgctgggcacactattctgcccactccatgcttccatattcctgcagtgtatgtgggtcaacacatcttcaatggcggtgtaggcattcgtatttaacccgtttcctgccgacagttagttggtttccttttttgatttttagaacaatgttataatgaacatctatggatataccacattgttttgaatccttacaaaaatccctgtagaaatctgaggcttagaaaatgaagtaacttgcccagggtcacacagctcttcatggaattgggcccagggcggcctgaattctaagctcgagtcccctggactccttgtcagtgttaggaatacctctgcttcaaatgctttctttttttcttaaagttctgggatacatgtgcagaacgtacaggtttgttacataggtatccacgtgccatggtggtttgctgcacccatcaacccatcatctacattagttatttctcctaatgctatccctcccctctccccacaccccctgacaggccccggtgtgtgatgttcccgtccctgtgtccatgcgttctcattgttcaactcccacttatgagtgagaacatacggtgtttggttttctgttcctgtgttagtttgctgagaatgatggtttccagcttcatccatgtccctgcaaaggacacgaactcatccttttttatggctgcgtagtattccatggtgtacatgtgctacattttctttatccagtctatcactgatgggcttcaaatacattcttcacagaaacctccccacccccttttaagaacagttgcattgacttgactcatgcctcccaatcccctgccttttgccatctctcagggtcagtcctggggcaggatgggcagccaggttcctcctggcatgggggctgatctgttcagctcaacaccattgcagccagggctcaaaggctgaccatagacatggccaagccatggccacatgtggtggctcacacctgtaatcctagcactttgggaggctaaggcgagaggatcacttgaggtcaaaagtttgagaccagcctggccaacgtggcaaaaccccgtctctactaaaaatgcaaaacatttagccaggcatggtggcgggtgcctgtaatcccagctacttgggaggctcaggcaccagaatcgcttgaacccaggaggcggaggttgcagtgagctgagatcttttcactgcattccagcgtgggcgacagagcaagactccatctaaaaaaaaaaaaaaaaaaaaaagtaaagaaagaaatggccaagccaggaggaagagctgcccctcttcctggaccatccaggcaaaagcagcctcagaagagacaggcaagagtctacagctggagacagaagtgtgcctcctctcccagggacatgctgggatccagcgctgggcctgccctggagcaaagctagtgggttcctgggagccactgtccttgtcatcttgggcacagctcagtggcctactgctttctgctactgaggccgcaagcaggtccactaggaaccagcctcactgtcccaaaactgagtgtgaatcagtgccagggaggcccagctgtgtgtctagaggcagacaggtgggctggcaggaaagcctgcatcaaaccctcactccacactcacctgccgtgaccttgggcaaagctctcaaatccagggccttggtttgcccatccaacaaaatgggcacagcgcctgccaacttgaacttttggtgagatagaggagtgaaggtgcgcgtgatgataagcagccatgtctggtccgtagtatgtgctcagccaatgcgggttgaacctgaatataggaatgaacctgtttcttcccagccataccgttattctggaatcatttcttcatttattgtctggaaataatttcaaatggacagaaaagttgtaagaagatgatagcacaaacactatagcacatccttcctccagggtctctcagcatcgtcagtacatttcgacactggctgcattgtcctcagcctcaccgcccccatttagacataaattgcagacatgatgctgtattatttctgaatacatctgtgtgtgtgtgtgtatgtgtgtgttgggggtgggggtgttggttttgttggtttttttttttttttttttttgagacagcgtcttactcttttcacccggctgagagcagtagcgcaatctcggctcactgcagcatccaactctcaggctcaagcgatcctccaacctcagcctccccagtagctgggactacaggcatgtgccaccacgcccagctaatttttgtattgttgtagagactgggtttcacgctgttgtccaggctggtctcaaactcctgagctcaagcaatcctcccacctcagcctcccaaagtgctgggattataggtgtcagccactgtgcccagcctattttctttaagtgacagtcttcattaatcacaacagagtccaaaaatcaggaaatgaacatctacacaacatgaccatccagtccacaagttcccatcagcgttgtcctggtaacagggaaaggatgtggctcttagttgccacgtccctctgtttctccttctgtgtggaatactcctgtggattttccttgtcttctgtattctcgacctttttagagattccgggctcagattccaggctcggggacgtcataggatgtctcttgatttgagtttgtctaatgtttcctcgggatttggctcaggttacgcgcttctggagaaagccctgtggcacgatactgtgtcctccttagtacatggtattgggaggcccacccagctgtttgtctcgttactggtgggagtaacttttgccccttggttaagacagcgtctgccaggtttcccttaattaaagctattactttctcccttgtaatgattaagtattttaccgagagacatgttgagactgtgtcagtatctgattctcgttttattttcgctcattaagttcggcatgcatggacgatgcttggctgaatggattactatcacaacgtttgctgaatggtgattttctaattccatctacattagtcccttctcacactgctataaagaaatacctgaagccgggcatggtggctcatgcctgtaatcccagcactttggaaggccaaggtgggtggatcacttcaggtcagaagttcaagagcagcctggccaacatggtgaaacctggtctctaataaaaatacaaaattagccgggcttggtgatgcatgcctgtaatcccagctacctaggaggctgaggcaggagtatagtttgaacccaggaggcggaggttgcagtgagctaagattgtagcactgcactccagcctaggtgacagagtgagactctgtctcaaaaaacacacacataaaaagaagaaatacctgagactgtgtgatttatagggaaaagaggtttgatgggctcacggttctgcaggctgtacaggaagcacagtggcttcttctgggaagacctcaggaggtttccaatcatggtggaaggcaaaggaggagtgaagtgtcttacatggtgggaacaggagcaagagagagagcaggggacggtgtcccatgcttttaaatgacgagatctcacgagaactcacattcgcgaggacagtactaaggggatagtgctcaactattcatgagatatccttccccatgatgcagtcacctcccaccaggcccacctccaacattagagaatagaattggacatgagatttgggggtgaacacagatccaaaccatatcaccatcatcatcattctctctcatttaacgtctcctgtaaggaagagctttctcttctccctgttaacttggtcgtttattcattgatatcagtaggaatgcaaggactctgtattagtccactctcatgctgctatgaagaaatatctgagactgagtaatttacaaagaaaagaggtttcattgactcacagttccgcatgtctggggaggcctcaggaaacttacagtcatggcggaaggcacctcttcacagagcggcaggagagagaatgaatgctgagcaaagggggaagccccatatgaaaccatcagatcttgtgagaactcactcactatcatgagcatgggggaaccactcccgccatctaatcacctcccatgaggtcccttccccaacatgcggggattacacttcagattacaattccaaatgagatttgggtggggacacagagccaggccatatcagagtcctagttgattaaatatgctatgatttgttactatcaatatttattttgatgcttcattgtcttaatttggccaacgggaaccctttcaaggtgactgccatgccctcttgacattttttacgttatcctttgagcacttccctttctggcataatgagaaacttcagcttcattttgtactttctgtaccttggccctggaaaaagccatttctcccagtatccttggctgtttttaccggaagaattatatttagaaagcaagatctggtagtatgtgttcattgttactgggtgccatggctcctgggccctctcagtggagggggtgtaagtgtgcatatgctgcgagatctatatttagttttatatctgtctctctctgtatctccatatattccagtccaataaataccacagggtttgtgccagttctttgtatatttttaactcttttcaccaacagtaagaacactggctaccattaccattagcatatttccttactgcacaatttccctgtatgtaacccatctcctcaccttgccaacaattgcactggccaccactctgcctagccgtctcctcttggcccgaatgcactggccacccttgagcaaggttcatgctccaagtatctcactttgtcctgttgctagctccttgctcgctggtgtcacactcccactgcgtatgcacacacagacgcacacaggtactacctagaaaggacttcaggggctggaaaacatctctgaagcccctcttgacctgaggctgaaatttcagaagcccttcctcacatcaatgctaggtgcgaggtatcatcattcccattttaaagaggaggaaactgtgactcagaaaagtcaagcggcttgctgagggtcacacagcgtaggtgggggtagctagaccaggccgagtctgggcctggtgatgcctcctctaccctgttggctgcatttagggtttttgtttgtttgtttgtttgttttggtccctaacattaaaaaatattcaggcaggcccttctgagttcttttgcaatgttcttccccattttcccacactgtcttaagcttgattgtcgccactcacctgtgggcagtggggttgggggtgcagatctgagggaaaaactgtttggcagtgacgactatcactgaacaagcatgccgcgctctgagaacctgagactgcgataaccccagactgagttccacttctgagcacatttgggcactcgtatctcctggagggcttgcatgtgaatggtcacagcagtgtcctatataaaagcccaaactgggccaggtgcggtggctcgtgcctgtaatcccagcgcgttgggaggcccaggcgagtggatcacctaaactcaggaattcaagaccagcctgaccaacatggtgaaacccgtctctacaaaaattagccaggcatgatggcaggtgcctgtaatcccagccactcaggaggctgaggcaggagaatcacttgaaccagggaggcggaggttgcagtgagccgagattgcgccattgcactccagcctgggcgacagagtgagactctgtctcaaaaaaaacaagaaagatcaaactggacacaaaatgccagccatgtgcacgtacttaaataaactgtggcatagccatgaagcagcgtacttagaatactatagagcaacaaaagagaatgagtggcagttattcatggaaatgcaccagtgaagctcacagcctattcacttctccaaggttgcggcccctcaagaataagactttgctgggttggcccttgagtgcgtctcccaagacagcccttctcagacagctctgggtacattttagaatattagaatcgcctgggggactgggtgtggtggctgatgcctgtaatcccagcactttgggaagctgaggtggtaggattgcttgagcccaggagtccaaggccagccagcctgggtgacatagtgagatcccatgcctatttttttttttttaatagaagcacctgggggcttgtggagccctgatggcctcactcatctgctggtctcgggtgagcccacagcaggtgtgtttttgtaagaaccagcagcaacttttggccaggcaggtgcagtggctcacgcctgtcatcccagcactttgggaggccgaggtgggtagatcacctgaggtcaggagaccagcctggccaaatggtgaaatcctgtctctactaaaaatacaaaaattagctgggcatggtggcaggtacctgtaactctagctactcgggagactgaggcaagagaatggcttgaacccgggaggcagaggttgcagtgagccgagatcacgccactgcactgcagcctgggtgaaagagcgagactctgtctcaaaaaaaaaagaaagaaaaactagtatcaacctttgaacacatcagtcagagtcctctacagaacttgctggaacacagactgtctgcccacccctagggcttctgaggtagtaggcccagggtagggcctgagtttctgcatttctaacaatttccaggtgatgctggcctgaggcccatactctgagaatcctggaataagataaaactagagaatacccagatctgtgccttgggagagaaggatagagaagccttggaaagaaggaagcatctgcctgagtgtggcttatttgggtgtgtgtctccaatgtcacccttgtcaggaagcccactcgattgttttgttcttgtgtcattctgactcttgcattgattctctccaaaggcatcgatcccaataattacgtgccctatattgtgaaattctttttttgttttgttttatttctgtttttgttttttgagatggagtctcgctctgttgccaggctagagtgcagtggtgcaatcttggctcactgctacctccgcctcctgggttcaagcgattctcctgcctcagcctcctgagtagctggggctacaggtgggcgccaccatgctcggctaatttttgtatttttagtagagatggggtttcaccatgttacccaggatggtctcaatctcttgacctcgtgatccacccaaagtgctgggattacaggcatgagccaccgcgcccggcctatattgtgaaattcttgaaggattggggctggaggattcactaggcccagggttctttctctgcctcttctctttctctgaaacccccaggggccaagtgctttccacaacctaaggcatttgggattcccacatgagccgttttcttgttcttctcagcaccttcatgcctgttcttccctcagcccagaaggcccctcattccagtacctctctcaactgctttctcacaattcctgggtgcctttctagattccccgcgatctgcactggggcccgcccatctccttcgttgttagctgcaccccaggagggcgtgaccaccacgcgagttttgagcatctctcggcttgttcatgcctctggtgtcgtcagatttacacatgacacacagtcatggttgaatttcaaacaataagtgcacgcttgtcccatgcggtactcgtgtatactggaaaatcatctggtgtttatctggagtgcaaaggtaactggcatctgtattttcgtttcttaaacgcggcagccctcttcgggccccttggtgtcctctaaggacgaggactcctgctgtccccacctctggtcaccgctgtcaccctaaggccctcagtgctccctggtgctgggctctgtgctgggaacttcactctcactgtttccttttttttttttttttttgagatggagtttagctctgtcacccaggctggagtacggtggcgctatctccgctcacttcaacctctgcctcctgggtccaagcagttctcctgcctcagcctcccgagtagctgggactacaggcatgtgctatcacgtttggctaacttttttgtatttttagtagagacagggtttcaccatgttggccaggctgctttcgaactcctgacctctaatgatccacccacctcagtctcccaaagtgctgggattacaggcctgagccaccatgtccagtctcactttcctttatcccacggcagccctgtggaccccggctgttatacccttagccccccacattccaggggaggaaactgaggcacgggctaggctttggtcaaatatgttgaagcaatgcatgtctgcataagccctctaacagggaagatcattagggtctaacgcagtccaagttcgcaatgaaccgaatcccggggctggacgggagggcgccacagcggggctggactgagggaggctgttcgcccggaggtgccgctggctcccttgctctggagtgagctcacagctccaactcacctttcagcaagggccatacgtgcacttcgtggtcccctcgggagcctctggtaggttaaacgtcagtcctgagctgcgcttgttgggtgcagcttctcttggaaacctttctcttctaggccgtttccttggggctagggaggctgcgctcaccgtcgcccgcgtgggtctatctgcagcaggcaaataacatcttgggggttccaaaggaggcacagacacagaagatggatgtgaagtaggcgggaccgtgacgtccatagagacaggaagcagatgagtcgttccggaggctggaaagggcgtggggagtgcctgcttcctgggcacaggattttcctctggcgggcggtgaaagtgtttggggatgagctccacgtggtgcctgcacaacattgcaaaggtactagatgcactgaactgcatgctctaaaacagttaattttttgttatgtggatttcatcttataaaaagctttaaaaagggaaacacaaaagaaaagggggccgggcgcggtggctcacgcctgtaatcccagtactttgggaggccgaggtgggcggatcacctgaggtcaggagtttgagaccagcccggccaacatgttcaaaccccgtctctactaaaaatacaaaaattagcccggcgtggtggtgggcacctgtaatcccagctactcgagtgggtgaggcaggagaatggcttgagccctgggggcagaggttgcagtgagccgagatcacactgctgcactccagcctgggtgacagagtgagactcagactcaaaaaaaaaaaaaaaaaaaaagaagaagaagaagggaaggtttggttctgcctaaatcacctgtgatggagagggagaattagggacactctctgacctttaccaggatgcgccactctcattacaaaaggaacacttgcgattcacagtggactgatgtctacaaagtaacaagaagctacagcctcggacccttcagccccacagccccggggcagctactgccatctctcgcatcttctgtggacgcacatacatgctgttatggtcaaggcgtgtcctcccaaaaacatgttgaagccctaacccctggtacctgtgaatgcaaccttatttgcaaatagggtctttatccatgcagtcaaattaaaatgaggtcacactggagttgtgtgggccctaacccaatgactggggtctttataagaaaagcagacagagacgcttgggaatatagccatgtgctggcagaggcagagactgctgtgatacgtacacatgccaagaacgcggaagattgtcagccaccgccagaaactgggagaggaagaaaagatcttgcctgcagggttcaatgggaacgtggccctgccagcatcttggtttcagagttttagcttccagaactgagagaacaaatttcggttgttttaagccaccgagtttgtgttggttgtttgttacagccgtggagaccaagcagccatgggaaactcacacacaaagttgaattgaaactgtttccaagttcttttatgtgactcccgttccctcccctcccttcatctttccttccttcctctttttttttttaaaacaaaactaggattatattacgacgattgttctgcaaaaggttttttttttaatttgatgacatatcagtgacgtctccttaggtcaaatcatataacacctcttttctctttaattttatactatttaattttgtattttgtattggagaattccaatcatatgcagaaatagacagaataatggaatgagcccacatgactctgttacccagtgccaatgaggggagccaatcttgactcctgtctaccccagattgttttgacacaaatctcaggcttcctagcatttcatctataaatatttctgcatatctatggctaaagagaagaactctttaaaatatcacaattaccattatcatatcataaaatattaacaattagagaaaatcaaatattggccaatattgaggttcccttgggctcctaaacactgcttcacgctggtttattcaaatcaggactcaagtgaggtcccagcctgcacttggctggggtctctgatggttctctgcgtctgcacgtttcatccttgtgtttttcgttttgagatggaattctgctcttgttgcccaggctggagtgcagtggcgtgatctcagctcactgcaacctctgcctcctgagttcaagtgattctcctaccttagcctcctgagtagctgggattacaggtgcccgccaccacgcccggctaattcttatatttttagtagagatgggctttcaccatgttgacaaggctggtctcgaactgctgacttcaggtgatctgcctgccttggcctctcaaagtgctgggattacgggcgtgagccactgcgcccggcccattcttgtgtttttgttgtagtttacatgctggggaggccgggctgtgtgtcctacagttcccacagtctagtgatcatgtccccatggtgtcattcaacgtgtctattatctccagtatttcctgtcaactggtgggtgggcctagaatggaggcttggtgcaactcaggagatgtgtttggctgcctgacagcgtaggtgcatcatggctgatcaaccttcctcacgatttaccctgagtttgtttccagtttttgagtgcctcagcttcaaggtgggccattctgggtcatggcaatgtcctgatcagcagcgggcacgggcccacttggagagaagaagtgagtgtgtgtttggggttgggtagagggatgggggccgtaccagagtctgtagtttctggaaacagagtggacaatcctgttttcaacaaaggatacattaagtgccatttagattatggagctgtgtgattggaatcaacccggggcagattaggcccccgggcccctatgcattcttaaggagatgaggggggtgcccaggtaagcatcccaggtaggagtctcccaaatgcagggcgaggagtggcagcgtccacgagctcagtcaccaacccagggactctgtttcctgactgtcacgagactggactgaggcagagcaagccctcacttacaatgtattgggtccagggctatgtcccggtggccttgaaacaccgaaatgacctggagatctggctgaagtcggttgagaagtggataggaaatgaaaagatagagacagcaagtatagacactccttctaaaagctcgatgttggcaaatgaggaaggagcaggtgtatttccaatgcaaggcccagaaaagaggttatgtttaaagtggaaacccatgctgagatgtttatgggaggagccagcaaagaggggaggaggatagaggatgggaggccagtggatgggaggctatgggtgtggggggagtgggggtggagggggctgtgaccgacacaggtgggacccaggagagagtcaggaggacggtttctaagtggtggacggagttcctgcctgtagcttgtaaatggctttaaaaaaacaaaaaggctaggcatggtggctcacacctgtaatcttagcactgtagggggccgaggcaggtggatcacttgagtccaggggttcaagaccagcctgggcaacatggcaaaaccttgtctcaattaaaaataccaaaaaaaataaaaaaataaaaaataaaaaggcctggtgtgatgacacacacctgtagtcctagcttctcaggaggctgaggtgggagaatcaaattgcttgagcctgggaggcggaggttgcagtgcaccaagatcacaccactgcactccagcctgagcaacagagcaagactctgcctcaaaaacgaaaaacaaaattcttattttattgaggtgaaattcacataacaaaatcaaccatctcacagtaaacattgtaatgggatctagtacactcacaatgtcgtgtgaccaccacttctattcagttctgaaacatttgaaagaaaccctgtacccattagcagtttctccccattcccccttccccagtcccagtctgctttctgctcctacgaatttgcctgtcccgggcctttcctatgagtggactcacataccgtgtggccttttgtgtctggcttcttccgcttagtgtgatgtcttccaggttcatctgtgttgtagcaagtgtgtttcccagggctatggtcaccgagtaccaaaaatgtggtggcttaaatttaaatgtattgtctcacagttctagaagccagaagtcaaaactcaaggagtcaggagggctgtgctctctctggaggctccaggggaggatctgttccacgcttctcttcaagcttccatcatggccagcaatccccagcattcattgaccgatggacacgtcactccagcctctgcctccatcatcacagggttttctcctgtgtctccacatggacttccctgtgtgcatgtttatctctgcaaaattctcctttttgcaagaacatcgctcatatttgacctcatctgaccttgatcatttctgtaaagatgccctccagataaagtcacattctggtgtaccaggtgttaggctttcaaagaatggttttgcagaggccacagtttaacaacattcacgtgcgtcagtattgcattcctgtttgaggctgagttgatgctccactgtctggatggaccacattttgcttctccataatccgtggatgggcatcgggcagtgtctgacttttgggtctcgtgaactgtgctgctgtgagcagagtccctgtttccagtacccttggttacagagctgggagtgtgtaggtggcttttactcacagagggaagtcggaggctgggtcctctctcctttgggctctggactctgcccctgcagtcacaaaacacaggggagtgagggaggtctctgcatccaaccccctctcccctccagtgtcactgcagcatggcaccctgtcaccccatgacttcctcaatccacctagctcattccccagggacatgtgggtggacagccctgggccttcagatgtccagagcacgtgacaaaggttgggggcacatgctagtcctgccctcaaaggcaggggaattggtgcctttgatcttttttttttttttgagacagagtctcactctgttgcccaggctggagtgcagtggcatgatcttggctcattgcaacctccgccttccaggttcaagcaattctccctgactctggctcattgcaacctccgccttccaggttcaagcaattctccctgactcagcctccagagtcgctgagattacagatgcctgccaccatgcctggctaatttttgtatttttacaaaataccatgttggccaggctggtctcgaactcctgactttagatgatctgcctgcctcagcttcccaaagtgctgggattataggtatgagccactgtgtctggcccttttcttctggatttttattgtggtaaaatatacataacataaaattcaccattttaaccatttttaagggtatggctctctggcattaagtatattcccattgttatgcaaccatcaccaatatttgcctccaaaactctcatctttcccaaagagactctgtagtcattaaacactaactccccagcccggttacctctgctctcctttctgtctctgtgagtttgactattttagggacctcctgtaactggagtcctataggatttgtcctttcgggtctggcttatttcaccaggcataacatcttcaaggttcatccatgttgtagcatgtgtgggttttgggcagtcacattgaaggtaattgggctcttatcctgagagcactggaatctctgcaagtgttttcaagcatcgggcgtgtgtgtgtgtgtgtgtgagatgggatttatgtgtttcgagccaggtgcagtggctcacgcctgtaatctcagcacttttggaggctgaggcaggcagatcacctgaggtcagaaatttgagaccagcctggccaacctggtgaaaacccgtctctactaaaaatacaaaaacaaattagtgaggcgtggcggtgcgtgcctgtagtcccagctactggggagggtgaggcaggagactcgcttgaacccgggaggaggaggttgtagtgagccgaggtcgcaccactgcactccagcctgggtgacagagtgaggctctatctcaaaaaaaaaaaaaaaaaaaaaaaggaaaagtgaattcggtgtagtgagtcacaaatggcaaggctgagggcagctgagtgagtgtgggggatggggggagtgcccagcctgcctccacctgtggtgtgcgcaagaatcaagcactttatttggtacgacgggagcagatcttgagaatggggggaaaagtcttgtgcaatccacatttttctttgaagtaactctacaaagaatgcaatgttgacttaaggagggctcccaatggatggctaagcctgcttaaagatctgcgtaatcgctgctgtgctcctgggcactgggcatgagtgagaagcagccgcatgaaaccgaggtgggtagcacagcttttctaagcaaataggcatttgggaggagatggtttggggttggggagggcggctgtcaagaaggaagagtgggatttgcaatctctattacagctaaaggaggaagttactcaatacctctcctgcttcctttttcccagtttccagtaacctggtggaaaaggaaaagatgattatcacatcctgggtatcaggatgctaggaatggttttgcaaaaatacctcacacttttccgcttctgaggtctcctttgtattagcaaagcctcccgaagcctccaggtgtttcacgtggcttctttccaggcccgcaggtctcaacacagagtgctgggacttccagaacttggttgtgtttcccctccccttttctttggttatttaaaatgtcccatagaaccaggctgtgataccacctatcatcagtaggaggcactctctgcaatatggtgcatacttgatggagaatcctggaagttcgaggttcaggattctacatatgtatattgttgccctactctgtccacttacaagtttcaattctgtaaaataagttcgctcagcctgggcaacatagggagaccctgtccctacaaaatattaaaaaattagccaggcacaatagcatgcacctgtggtcctgctattcaggaggctgaagcaggaggatcacctgagcctgggaggttgaggctgcagtgagctatgattgcaccactgcactccagcctgggtgacaaaaaaaaaaaaaaaaaacttgcttaaaaatagatgcatcagtattagccaacaactaacaactggaacccagatattcatcaacaggagaacaaatacaatgtgatctactcatacagtggaatactaagctgctgtgaaaattagcgtactgttgctacatgcattctcacttgtataaatctcactaacaatgttgagtgaaagaaatcagacaagaaagcatgtatgagtgtatactgcatggcaccatttccataaagttcaaaccctggccaacctaatctatgaggattgaaaccatgacagcagttacccctcaggtaggtaggttggccaagggagcatcaggggaccagtcatatctgtttcttaatttgggggctggttataagggttagtttgtgagctgtacacatatgcacactgtgtgtgtgtgttttatgctttaaaaaaaacacatgtggccgggcgcagtggctccacctttaatcccagcactttgggaggccgaggcaagcggatcacctgaggtcaggagtttgagaccaacctggccaacatggtgaaacctcgtctctactaaaaataccaaaaaaatttagtggggtgtggtgatgcgtacctgtaatcccagctactcgggaggctgagacagaagaatctcttgaacccggtaagtggaggttgtggtgagctgagatcatgacactgcactccagcctgggtgacagagtgagactccatctcaaaaaaataaactaataaaaataaaaaataaatttaaaaattaatcagtacaaaagttcaatccgctaaacagcaaccctgctcttttcacagattgatgaacagagtgagctgaaagccatcgagaaagagaagaaggtgacagccctgccccccaaggaagcgtgcaaatgccagaaagaggatttggccagagcgttttgtgtaagaattgaatttgcatctggagctaattgtgataaggttttatgtttaaaagaaagcaacacaaagccctgaacagtgctttgaaattctgtgttattatcaattttatcatcaaggttggaaaatattgttgatgttgaatggttcagattccacaggtagaatatcagtacttgtcagtagagctcgtcttcaccaggcccttaccggaagacggcgtcctttgagacactctgtgtacgctgcttctcttcagcctcacatttcttggcaaaaacataaagggatggaagatgaagttgagacacagaaagtagcacagtccagtgttagaggtagcacagcccagcgtggagtccagctgtttcacatgaaagcccaaactcttggtcatccggtattcccaccgtcgtcttttataatccgtggagttgccaggtactaaaaccaaattctcccaagtttctcaagtgagtttgaattaattcctggccagtgcaagacaaacatttgcattgcacacaagtgtgtgtgtgtgcacacgtgcgtgcacgtgcatactcagaaccactacattttgggaaagcaaataaaaagcccccaggaaaagggcacatactacaatttcaggaagttggaagctagtgtcttttcttgagaataactcaagtctgtttcaattcaagtcctgtgtattagtatttggagagggggaggaagtatttcttctctgcctgcatattatccctagctagaaaatgagctagattttctttcactattcaaaagaatctagaaatcaattctgttctccccgtttcctctaccagcaagtacagttttcttgttattggctttttaaaaacaaggacacttttgttgcgaccagaacaacaaagtttccttccattatgactgactcataaattagctgtatttaacgaatttgtttacagaaagagcttgaatggagttgggcacaatataattgttttagctactgtttcttttttatttttaatttttgtgggtacatagtaggtgcatatttatgggttccagagatactttgatacaggcatacgctataataatcacatcagggcaaacggggtctccattacctcaagcatttatcctttgtgttacaagtcatccacttacactctttgagttattttaaaatgtacaattaaattatttttgacaacagtcgccctgtcatgccagcaaatactaggtcttatttattctttctgactatattttttgtacccatagccctctccactttctcccaactaccctttccaggccctggtaaccatcctactatctccatgagttcagttattttaatttttagcttccactaatcagcgagaacctgcaaagtttgcctttctgtgtctggaggtcactatgttatttgacttaatataatgacctccagttccatccatgttgttgcaaatgacaggatctcattcttttttatgggtgcatagtactccattgtgtatatgtaccacattttctttattcatttgtctgttgatggatacttaggctccttccaaaccttggctattgtgaatactcctgcgataaacatgggagtgcagatatctcttcaatattctgatttcctttcttttggttatgtatctaggagtgggactggggatcatataatagttgtatttttagttttttgttgttttttttttttgagatggagtctcactctgtcacccaagctggagtgcggtggcgcgatctctgctcactgcaagctccgcctcctgggttcacgccattcttctgtctcagcctcctgagtagctgggactacaggcgcctgccaccatgcctggctaatttttttgtatttttagtagagacggggtttcaccgtgttagccaggatggtctcgatctcctgacctcatgatctgcctgcctcagcctcccaaagtgctgggattacaggcatgagccaccgcgcccagcgtatttttagttttttgaggaaccctccaaactgttcaccagtcatactaatttacattcctaccaacagtgtacaagggttcccttttcttcatatccaggatttgttattgcctgacttttggataaaagccattttaactgtgatgagatgatacctcattgtagttttgatttgcatttctctgatcacagatggtgagcaccttttcatgtacctgtttgccattcatatgtcttcttttgaggaatgtctatccagatctttggcccattttaaaaacagattattaggttttctcctatagagttgtttgagctctttatacattctggttattaatcccgtgtcagatgggtagtttgcaaatattttcttccattctgtgggttgtctcttcactttgttgatgatttcctttgctgtgcagaagccttttaacttgatgtgattccatttatccatttttgctttggttgcctgtgcttgtagtatattactcaagaaatctttgcccagttcaatgtcctggagagtttccccgatgttctcttgatagtttcatagtctgtgatcttagattgaagtctttaatctttttttttttttttttttgagacagggtctcactctgttgcccaggctggagtgcggtggcgctatctcagctcactgcaacctctgcctcctgggttcaagcaattctcctgcctcagcctcctgtagtagctgggattacaggcatgcacaaccacatccagctaatttttgtattcttggtagagctggggttttgccatgttgaccaggctgatctcgaactcctgacctcaggtaatctgtccacctcatctttaattcatttttatttgatttttattgataatgagagatggggtgaaatttcactctcctgcatatggagattttgttttcctggtaccatttattaaagagattgccctttccccagtggatgttcttgacatctttgtcgaaaacgagttcactgtagatgtatggatttatatctgggttctctattctgtttcactgatctctgtgtctgtttttatgacagtaccatgctgttttggttactaaagctctgcagtataatttaaagtcaggtaatatgattcctccagtgttgttctttttccttaagatagctttggctattctgggtcttttgtggttccatataaatttttaaattgttttttctatttctgttaagaatgtcattgttattttaatagggattcgattaaatctatagattgctttgggtagtatggacattttaacaatattgatttttccaacccatgaacatggaatatctttccatttttctgtgtcttcttcagtttcttgcatcaatgttttatagttttcattgtagagatcttttacttctttaagttaattcctagatatttaatttgcagctgtggtaaatgggattacttaattgatttcttttgcagattgctttctcttagcatatagcaatgctactgatctttatcatttgagtttgtatcctctaactttactgattttgtttatgagttctaatagctttaggtggagtctttaggttttttcagatataagatcatatcatctgcaaacaagaataatttgacttcttcctttccaatttggatgccctttattttttactcttgtctgattgctctagctagaacttacagtattctgttgaatagtagtggtaaaagtgggtatcctacgggaaaagctttcagtttttcatcattcaatatgacactagccctgggtctgtcatatatggcttttattacattgagacatgttccttctatacctagtttttttagggtttttattatgaagagatgttgaattctgtcacgttttttcagcattaattgaaatgatcatatggtttttgtctttcattctgttgatgtgtcacattaatttgtgtatggtgaaccatccttgcacccttgggataaattccttttggtcatgatgaattttcattttaatgtgttattgcattcaatttgcttgtattttgctgaggatttttgcatcaatagtcatcagtgatattggccagtagttttcttttttaaatgtgtctttgtctggttttggtatcagggtaatactggcctcgtagaatgaaagtattccctactcatctgttttttggaattatttagtaggattggtatcgcttcttcgagtgtttggtagaattcagcagtgaagccactgggtcctgggcttttcctaaccggaagactttttattatggctttgatcttattacttgttattggtctattcagcttttggatttcttcatggttccatcttggtaggttctgtgtgtctaggaatttatccatttcttctatattttccaatttattggcatatagttgctcctggtagccactaatggccctttgactttctgtgatataatttgtgaagtttcctttttcatttctgtttgtatttatttggttcttctctctttttttcttagcctggctaaaggtttgtcagttttgtttacctttaaaaaaaaatactcttgtttcttaagacaggcctatttaaaaaaatgtctgatatgtggtaaatacacaacataaaatttaccatcttaaccttgttattttttccaagacatggtctcattctgttgcccaggctcgagtccagtgctgcaatcaagggccagtgcagcctccacctcctgggcttaagcaatcgtcctgcctcagcctcctgagtagctgagactacaggagtctgccaccacaatgggctaatttttaaaatttttttgtagagccaagatcatgctatattgcccagactagccttgaactcctgggttcaagcaatctccccacctcaacctcctgaagttttgggattacaggtatgagtcactgtgcctggccttaaccattttgaagtgtacattgtagttgcattaagtatagtcacactgttgcacaaccatcgccattctctatctccagaattctttttttttttcttgagatggagtttccttcttgttgcccaggctggagtgcaatggcgcgatctcagctcactgcaacctccgcctcccagcttcaagcgattctcctgcctcagcctcctgagtggctgggattacaggcacatgccaccacgcccggctaattcttgtatttttagtagagacgggcttttgccatgttgacaaggctgctctcgaactcccgacctcaggtgatctgcctgccttggcctcccaaagcgctgggattacaagcctgagccaccaagccctaccagtttattataaaggcaaaggataccgatgaagagacgcatagggcaggtaatgggggaaggggcgcagggcttccatgcccaatgctgctatgaacatggttgttcaaacatctccctggatgccactctccaggaatatccccacgttcaggtacgtgaaaactcactgaatcctatctttgggtttttagggaagcttcatgacatcattccttcccccagattatagggtgggaccctctcatgggagggtcttaagacccacagtcagcaaagcgggttacattagcatctccagtattcttttcatcttgtaaaactgaatctgtctccattaaacactcactccccattccctctccctccagcctctgacacccaccattctactttctgtctctatgaatttgactagtctatgtaattcatatgtggaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcgtcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcaggtaggaccagaggtgtcattctttgcattaacatgcataagccagcgagggtggggcagccattccatctttcaatgttgatggaaggcatccttggacagctcccgcccctttcacgctgccccagccagcctgagcatcagtcatgagcaaatcaccaactcccaggcaaccgcgatcaggaaaaacagtgatcactttcgtagacagttgagcaggccccgggccccacgctatatgagtaagtgaataagtaagcatgcgcttactaatcctcctcctaatcccgcctttgcacatgaggaaggagaagtgcagaggttgaaagatttccccagagttgccaggtttagcaaataacaatataggatgccctgttaaatttcaatttcaggctgggcgtggtggctcgtgcctgtaatccaagcactttgggcggctgaagcgggtggatcacttgagcccaggagttcaagaccagcccggccaacatggcgaaaccccgtctcttctaaaaatataaaaattagccggatgtggtagtggatgcctgtaatcccagctactgaggaggctgaggtgggaggattgttggaacccaggaggtggaggctgcagtgaactgagattgtgccactgtgctccagcctggacaacagagtgagaccttgtctccacaacaacaacaaaaccaaagtgaatttcagatagataaacaagaagcaatttctagtataagtgtgtcccaatacagtggacgtgcttatactaaaaacaaaaagttccttgtttttctgaaatttagattttactgggtgtcctactgtaacctgagcccaaagtcacatagctgtgaggagcagtgcagagcagtgcagccagggagctgcacccagagccccttcccttgctagctgctgccatcggtgctggcgcggtgctgaatgaatggcacacaatcaaatgcctggaagccactaagaaggggaaagaaaaaactgcaattgacatggctccaagttccattctagaagtcggcagtccctgccacctttgcaggaccagttcagaaaggctcagtgaacaggcagaattttccaggtgcctgagggcatttagatggccttagatccccttttccagccttttgcatgctcttggccccatccctgacatccccttcttcattctctggcccctgggctgccccaggcttcaaccgccttcctattggctctgtgtttacagcttcctccattggtcgattccggaaccaatcacagtcccctgggcagcatcctctgtctccactctccttgaggtcccctccctgatcaaggctcagttctcagtgttctgggaatgttattcatcgatgcgttttggcagcaaaataggcttctgggtatgtaggtggttctggctagcccagaagcttcctaaaactgcagggctgagaagaggcagtggaggctcccggaagttggggttcagggaaggaggccgagacatgggctgtgagggaggagctcccctctgcggctggagatctctttgctctgccctggcaccccttccactaggacccgctcccccacttcccctggttatcctccttcctcgttcccctctgctctgtcgaaacccaccgtgaacatcttccttctcaccaaggatcctcctccagcctccagccagggtgttccccaaaatgaaatctcttaaatttcttgagagcagaggacctgctcattcatcttatagcttgtcggttcagcaatgcatctgtgggaatccttgtaggactggacgggagctcctgacggctgggttttcctgcccttgcgtatacgggttctgtctgctctcccttattaattccttacatgtgttgagttcctcctgcatgccaagtgttgtgattctcctatctttcccccagtgacagggaactcatcacctcacaaggcagccctgttcctctgtctcaggagtctcaccattaggaattctaccttagcacggcgtaaggctctggacgggatggcagggaggcactaggctggtgctctgaggaggtggcatctgggcagagatctgagtgaaatgagacggaaagccatgtgaggatgtggatggagggcgtcgctggagggcagggtgcagagtccctgaggggacaggagcctggcagcctgggaatcaaggtgcccagaccaggtgcattattattattgttatattctgggatagggtttctctggtgtccaagcaggagtgcagcggcataaacacggctgactgcagcctcaacttcccaggccccagtgatcctcctgccttagccttctgagtagttgggaccacaggtgcacctcaccatgcccagctcattttttcatttttttgtaaagatgggattttgctgtgtttcccaggctggactgaaactcctgggctcaagcagtcctcccatttctgcctcccaaagggctgggattacagtgtgagcctctgcacccagcccttgttgatattgtaactctcttccttatcctgatctttggtctgccttctgaatccggttttatgtgtttgcatttcttttcaatcctctgtaacatgagctaccatgagatgtctctgaaatgaaagggcagatatataaaataaagtaaaaatcttctcaggaagttttgggaacggctgttttagagagggacatcattggagtccctagaggctgttacaggagcaggctgttactgagtttggtgactgggatgtgcaggatttggggagctggtgtggtgagagaggatccttggccgtcctgagccaggactggcatcttgccgaaagtcccggcctggagcgtcatggagatgtggagaggcgagaccaagaactcaaaggcagggctgaggccggtgtcttcagggggtcagtactgggacctgggagggtcaattgggtggagttccaggcagaggaggaccactgcatgggggtggtctccccagccctcggtcaccatggtgttgacctggaagcctggccctgaactgagacccctgtcacacaaacttctgcacagtaagaaacccattctggtccctgagactaaagaacgtgccccaccctgttatttcctcttcagtttaagaaccccctgatcctgctgctgctgggctctgccctggtgagtgtcctcaccaaggagtatgaggacgccgtcagcatcgccacggtgagttccctgacagcgctcggctcccgggcgggcagccacaggtctgctgagtctctgcttgttattgtatataaagaaaaaaaagagtttgctgtaggggggaaaaaggagcatacagaagaaagaaaggaaagcaaatccacatccttctttaccctaatatcaaggtgccctggtttattcggccactgcttgcttgctggacacacaggtgcttctgggtctttgctagagcagtgttgcagggaattcctttcccgtgaccctgggatgaggggaatagagcctgggctgtgcacatttgccttccgaagaacaacacctttgatccattaccgagaggtaaccactgagcactcattttttttttatttagatgaaattcacataataaaatattgactatttcacagtgaacaattcagtgaaattgagtacattcatgatatggtgccaccaccacctctgcctagttccaaaacattttcatcacccagaaggaaaccctgtgctcaccagacagtcacttcctgtccccgctcctaccagcccttggcaaccaccaatctttttctatctctgtgggttgaatgacctattctggatatgtcactgaaatggattcagacggatgagttcatgtcctttgcagggacatggatgaagctggaaaccatcattctaagcaaactatcacaaggacagaaaactaaacactgcatgatctcactcataggtgggagttgaacaatgagaacacatggacacagggtggggaacatcacacactcgggcctttcatagggtcagggggctgggggagggatagcattaggagaaatacctaatgtaaatgacgagttgatgggtgcagcaaaccagcgtggcatatgtatacctatgtaacaaacctgcacgttgtgcacatgtaccctagaacttaaagtataacaagaaaaaaaaatggattcagacaatacatgaccttttgtatctggcttctcctgagcacatttttttttctttttttgagacagagtcttgctgtgtcgtccaggctggacagcagtgccgtgatctcagctcagtacaacctctgcttctcctgcctcagccttctgagcagctgggattacaggtgcccgccaccactcctggttaatttttgctaatttttatatttttagtagagatgaggtttccctgtgttggccaggctgatgtcgacctcttgacctcaggtgatccgcctcccttggtctcccaaatagctgggattgtaggcgtgagccactgtgcctggcctgagcaccttttgatggctgtcattccccacttctttccgtttgttccagccggtattttaaaatacaaacacagactcattccacacgatggaatttcctacttccaattaaaaggctggagtaggccgggtgcggtggctcatgcctgtaatcccagcactttgggaggcctggggggtggatcacgaggtcaggagatcgagaccatcctggcccacatggtgaaagcccgtctctacaaaaaatacaaaaaaattagcagggcatggtggcatgtgcctgtggtcccagctacttgggaggccgaggcaggagaatcgcttgaaaccgggaggcggaggttgcagtgagccaagatcacaccactgcactccagcctggtggcagagcaagattccatttcagaagaaaaaaggctggggtaagttccacatctgctatggagaagggtgtttgcagcatgttcagtgaaaatggcagtttataaaagaatatgtccagattataagatgcggtgccttaagtgtgtctacgcagaaaaatctagatgggtactctgaaatgtgcacgtctgggtggtaaaagatagtgtcaattttttcctgctcttttggctagtatattttctaaatttctgtactgtgcacatgttttgcaagaagaaaggaaatcaatcattaaagacaagcccctagcctgccacgccctgtcccccctcccactgagcctctggtactgacaccctcctccgtttgctgtctaggcagtgcttgtcgtggtcactgtcgccttcatccaggtgagtatttcctgaggtcccagtcagggtaagctgggcgggacaggagcttcatggagtccccacctttaaacagcacatctgatgtgcttcctgccaggagtacaggtcggagaaatctctggaagagctgaccaagatggttcctccagaatgtaactggtaagtcagagcctccctgggactttttggttcactggaggagccagggagctggagagtttggcaaatgtttgctgaaagttgtatccttggtagtgtcggacaagagaaccacatctcactgggagttctaaggcctggtctccgcctgccaataggtcgctgtgtgtcctcgggcatgtcactcaacctctctgggcctcagctccatcatcagtgtctaaatcagggtgcctagcctgaggaccacaggtagcaggagtgactctgggaagagggtagcccacaaagcctgtgaaataatgtgcagaactgtgtgcattttttctagggagagggtctggaggtttatttgaattctcaatgaatggtctcaggagagtgagatccaggtctttaacaagcagagccatcagaacattggctgcagcatagggtataggaagagtgaacttgagtaactactcagcagctgcaacagcctctttcctgcccacagttttccattggttactgcacggctcttaccaaagatgtttaacaaggaaagagacaagactaaaatgtctgccagtaccacatggccctttctgcttagcgtagccctgtgtgatagaacttgcaggaaatgttctattaatatcatctgccctgtccaatatggcatctgacaattctttttttgttgttttttaagatagagtcttgctctgtcgcccaggctggagtgcagtggcacaatctcagttcgctgcaacctccgcctcctgggttcaagcagttctcctgcctcagcctcccaaatagctgggactacaggcatgcaccactacacctggctaatttttatatttttagtagaggtggggtttcgccacgttggctaggctcgtctcgacctcctgacctcagatgatctgcctgcctcagcctcctaaagtagtgggattacaggtgtgagccaccgtgcccggccgacaaactaaattcttaatgttatttaattttaatttttatttaaatatgcacatggacctagtggctaccatattgggcagctcagcttagaacatctgcgggggcccttctaggaacagctgccattggtggaggaagctgacaggcccaggagggaaaacagctttttcctttttcttttctttctttcctttcttttcttttctttcttttctttctttcctttctcttctttcttttcctttcttcctttctttctttttctttttgttgttgttgttgttgagacagggtctggctctgttgcctaggctagagtgcagtggcaggatctcggctcactgcaacctgtgcctgcctccagggctcaagtgatcctcctgccttactttcccaagtagctgggaatacaggtgcatgccatgccaccacacctgactacttttttgtatcagctgctacaaaagttactgcattttttgcatttttattttttaaacctgattgtgtatgtgtgtgtatgtatgtgtgtacgtgtgtgcacgtatgtgtgtgtgtgagcatgtctgcacgtgtgtgtgcgtgtgtgtctgtatgcgtgtgtctgcgtgcgtgtgtgcatgtgtgtgtgcgtgtgtgtatatgtgtctgtgtgtgtctgtgcatgtgtctgtgtatgtgtgtgcgtgtgtgtatgcatgtgtgtgtctgtgtctccgtgtgtgtgtctgtgcatgtgtatgtgtgcatgtgtgtatatgtgtctgtgtgtgtctgtgtgtgcatgtgtctgtgtgtgtatgcgtgtgtgtgtgtgtgtgtgtgtatgtgtgtgtgtggagatggggtttcactatgttgctcagtctgggaaaacagctcattctaagcttaacttttagcatagcagtggtccataagctcgttctcctagtagaaaatgaaatgatttcaaaaaaggccaaagtcttctccccacccctgctaacattggttgaggtcctgtcaggctgatctgtctttcccgaacatacctggctgctcaaagtgatagaaggtatcctgtgatcagccgggcgcggtggctcacacctgtaatcccagcactttgggaggccgaggtaggcagctcacctgaggtcaggagttcaagaccagcctggccaacatggtgaaactctgtctctactaaaaattaaaaaaaaattagctgggcatggtggtgggtgtctgtaatcccagctacttgggaggctgaggcaggagaattgcctgaacccagagatggaggttgcagtgagccaagagtgctccattgtactccagcctgtgcgataagagcgaaactctgtctcaaaaaaaaaaaaaaaaagtatctcatggtctggggtgtctgggaacaactcagcccaccctctgagtctccaagacccatttccaacatttggcaaacatacggcaactccgtattttctgaaggataattttcagggagagctttagtatatatcccaggcacatgttgtgcaactgagccatggggctagggtagaaagccgtagtgagatacggtcccgcgtctcaaagagtcagcattcaaggggcgtgtgtgtataatacaaggcggagaatgacgaaggaccaaatagggacaagaagaggatgatacagaattgacccacatcacagagggtgagtcaattgtagaagggccgcgggagcagtagaaatgtctgggctcgctggtcggatgaacagtgctgtcagaaatccagacatgtgacatcattaactgagcaaacggaagcataaatgatttatgtgatttgatgatccgatcttaagcttaaatatcgagtcttggcctttcaggtgaatagcgtgcattattgatgtctcccgggaggtcacttctaaaagacggttttatgtacaaaagcagcggtgtcgggcagcccagtagagttgaaagagcgctgaagaggtgaagcccaccctttgagtctctgagacccatttccaactcaggggaaaccctgctgtgcgggaccccctccctgtgttactccatccctggtgcaggcatcaaatatttattgagcacctactgtatgcctggagaaagggcactgaggttatacaagtggaagaaatggggaggcctcggcctttggggacctcacattcctaccaagggagtacataataagccagtgaagaacaagatgaccttggaattgtccaggtacacaaaagccaaaaaatactggaggccaccaaaacaaataaaaaaccccactgagatgtaatagtgactggtagaagggtgaggacaaccctaaatagctgtcgatcaggctgacatttagagaggaggtgacatttaagctgaggcctgaggaagaggagcctgccatgggaggagctgagggagcaacaggtatatctctggcaggtgctcttggctacaaggaacagaaagtccagttgcacaaacgccaagaaaagtatattgtctcatagccagggatctgaggtgggagccgtggggttagttaattcaggagagcacccagggcgtggttctttcacctccttaccctgccaccttgtgcccactggggttgcattggttcttggctggctctcctcatgatcccagatggctgccacagctccttgcatcacagccaaacacgcaaaggccctatagaagaagggtgtgtgtgtgtgcgtgcacgcgcgtgtacagtaaggaaatcttttcccacaagcccccagcaaacatccactcatgtctctcgggccagtgttgcatgatgtgctgatacctaagccaatcaagggcaggggtcttagccaggcatgacccactccccagagcacgtggctgtggggagagggtggatacctcaacaagatcaaattccattaacaaggaagaggggaatttctgctcctgcatttgaggtctgcaaagcccctgaggccagaaggagcctgtgcgtttaagggggctggatggaatgagatgggagctgcaggaggctggctggccgtggaggagatctttgagtttggtaccagggtcatgggaaagccatcggagggtttggagcaggagggggttgggatctggtttggggttctaagagcgctccagctgccatatgcaggatgggttgaaggggccaggtcggaggtcagagtcagctgggacgggcaagcggcggtggtgtgggggattccatttggagcctgtacggaagcatatccgtagtctgagggcagctggtcatggccctgcgggaatggaggtcctgggcttcctcccagctgtgataaggctctgccatccctgacttcctgagacagaccctgcaccctgagtgctgtgtgctctgaggacaaaactctgccggctgcatttggaggctttagaactgctgaccttggccccaggagcctccctggggcatgtggcccacgtggtttccaggcagggtaaacagcaatggcctcatctttcagatgtggcccagggatgcccagaaaccacatactttctctaaagtcttataggatatgttaatttcaaaataataacaccccaaaggcacagggttggtgtatattaaaagagaaaagtgtgtttctattctccttgttcaaatgtatcaaggtgcataaaaacaaatgtcagcatggatgcttttgctttttaccatgtcaaatgcagcctaagagaaggaaaactccagcacctgcttgctcgagaactggttcctggtgatgtcgtatctctctcgatcggagaccggatccctgcagacatccgactcactgaggtgagtggttccaaacccttgtcaatggggtatttgatggagctggtcaaggagcagacacttagctaattgtaggcatgtatagtctctctcatacacacatgctcaaacatacatgcacatgcatacacacaagacaggaagttagcagacaagcgtgttctacgcatagagcccctcaaaccatatttcataaattgtcatcctcactttaagcctgacaacctttggctatacgattttccagtttaaagcaggctgcaataacaaattaaaccaaggtgggcttggggaatgatgtgagagttgcctctcaaaacagacacacaagtgttagaaagaagtgatattagaggcgggtggatcacttaaggtcaggagttcaagaccaccctggccaacatggtgaaactctctactaaaaatacaataattagctaggcatggtggcatgtgcctgtagtcccagctactcaggaggctgaggcaggaaaatcacttgaacccgggaggcggaggttgcagtgagccgagaccacgccactgcactctagcctgggcaacagagcgagaagcacacgcttttagagtagtgaggtttggggacattggctgtggggcaagcttcgtgggtctctgggtgtcacagcttcacagagccatgcctgaggcactctgctgagattatcctgggttcccaagaggttacatcaagttcaccatgatttgttgatgggagtaatctatttcaagaatctttccaagaatgtgtaaggactgttcaaagctttgcatgatgaagaattagacacagattatctgcctgatttatttactgatgggatgcattctcaggaactgtaggatcaaggacccgctattaagagggcagcatcagggaagcggatggagaagagcacaaagggttggaagctaccccctgggacctgggtttacaacattcctagcctgtctgtgaaataggaggcaggggccagggcttatgtgtggccactcggacattgatcctctctgccgtgaccttcagatttccaggcagggcagggataagggtgggagatgttcagttaccaaagtgagggagggttcgccctcgggctcaggctggtgccctctgtagcaccagatacagatcctctgtggcccccgcctctccccgtgttcagctccagcagtcagcgtctgaccccaagtctggggtgcatggatccggtcagaggaacggctgtctgtggccaatccccgcctacaaggaggactggggaagctgggctcacattttccacgttttccttctcccgagaaggggggtcctaacaggggatgctccagatgccaggcagcttgtgagaaggacacaggtccgccacaagggctggtgcagaggcagagagaggccgtatgagaggtggccaatgacctggggttgggcattagcctgggcttgagccctgggaccatcattcaaagccttgtgaaccttgagcaagttagttaacctctctgtgcctcagttttctcatctgcaaaatggggggtggtgatgcccatagggtacttgggaggattacagatcttcagagatgccaaaagtgctcagaacggtgcctggcacaggtgagtgagaggcaggtgtgggggctgccgtactgcagtgtgtgttggaagtcagagaaccccaggccccatagctcctagggcgtgactcggggaaggaattcacctctctgagcttcgatctcctcatctctaaaaggggctgatgttggtttccatttcacagggttattgtgaagatgaaacaagctatgacccatgctgtgcttagcacatgccttttgtggggtaaacagtcaccagatacttgtgattgcttttattttttatcattatcgttctatacaacggttctttgaaacaactttttagaccccaggtaacttccttactgcttcagctggctttctctctgccctgcttatgttaaattaaactgtggctgggcacagtggctcatacctgtcatcccaatactttgggcagccaaggcgagtggattgcttgagcccaggagttcaagaccagcctgggcaacatagtgacactccatctgtacaaaaactattgtacctgtgtattgataccacgaaggttattttaaggctactggctgtgaacactctatggattttcctggtggtattctgcaattccattaaacaatcaatagctttgcctattcagtggaaaatgcttatcagctattaagctctgagatccaggagtacttcaagtgtacattttaaaaccattttggtctagcaggttcagcaggaagcagcaagttcaagaaagctcttaaagtaatagacctttttgcacagtatatgggggtcccagaacattattttccctttcctggagttaaaacagaggaagccctcagtcagaggctgagctggtacagccagcaagcctgggtcacactttctcccctaccatgtctaaaagaaaaagggaattgggtcggaggtgatgggactccaagtgacgcttcgtcttggaggtgggggcaccgggtgggcatgagccctgtgtgtgggagataggaggtgagcccgcgattgtgcctctgtcttcaggctcggcctgccgcctccttggtggctatgggttctgttcccccgactctattttcgcccctcacccctccttgccccttacctgagattgtgccctgggagcctgggaggtcaccagaagcccctcctgcccacctgctgaacccacacacaaccaccttcactccttcttggtccggaggtgccacctgatcttctacctgcctttatttttgtcatatgaagacaacgaatatttttcagtataacaggtctatgctaaccaccgtatgaaaattgtttcatttgttctcccaacacccttaagagaccagcactgttatttttcctctgcgttattttactacacggacacagcagcccgcagaggttgcgtggccctgcgcagtcacacggcagtgggcggtggagggggacatgaccccgggcctctagctccgcagcccatgtccttacccccaggacgttctctctctccctgtgagcagctgttcagactcttcctggcactgcctctccccctgagtttcctccatgtatccgttgcccatggctgctgtggcagatgaccgcttacttaggggcttaaaacaaggtgaagatatggtctgaccttctggaggtcaaaattgaaatcgttttcactgggtggaaatcaacagtgctaacagggtccaggcgcggtggctcactcctgtaatcccagcactttgggaggctgaggtgggtggatcacctgaggtcaggagttggagaccagcctggccaacatggcaaaaccctgtctctactaaaaataaaaaaattagccaggcgtggtggcgtgcacctgtagtcccagctactcaggagactgaggcaggagaattgcttgaacctgggaggtggggttttagtgagccgagattgcaccactgcactgtagcctgggtgacagagtgagaccccatctttaaaaaaaaaaaaaaaaaaaaaaaaaaaaaagtgctactggggccatgctcctgcagaggctccaggggagaagctgtttcctggcctttcccagcttctagaagccgcctgcattccttggctcatggctccatgttcccgcaccactgcttctgttacatctccctgacatcagacacatctccaaccctccgtcctcccctcccttatgaggaccctcgtgatctcacggggcccaccccggtcacgcagaccatattctccccacgccaaggtccttcagttagtcacgtctgcatagtctctgtcaccacatcagagaacacattcccaagttgaggattaggatgcggacatcatgggaaagctgggggcagggggacgttactcagcaggccacactgcagcccttttccaggtctcctccctcctcccttcccttggggcccccgaccccactccccatccacatcgctcattcattcaacaagtgtttcctgagcacctactacgtatgaggccctgggctgggtaccgaggacaccgtgcaggaagcagacctggtccctgtgctcgtgagtttatagcccagagtgacagactgacttaaatctactcgtgacaagtactgttccaggactgctaagggacccatgagtggaagtactgggaatcctggatttcccaaatgggagagacttgcctggcctggtgcactcagggagggcttcctggagatagcagcttttggcgcaaaacagccgttttaggcaaaggaggcccaagctacttgtctcatgctgaccaaaaagcctgataagttttcgctttcaactgccatgggggcacctaaaaccctcccccagcacatgtgacttaacctatctcatcccggaggtctctgctccctgtccctcctcccaggcctttccccagccacctcttctcaggggcctccctccctgctctgtacaccctggtgttggatccagtgcttgtttatcgtcatttcccccacctcctccatggagtatcatcttcctgaggcagaaattgtaccccattcactgcggtattcccagtgcccagaggagtctctggcctatcggaggatatggatggtcaggtttcccatcagtccaaacccacactcactccccaccccatgtgcctcctctcttccaaacgccttctcctccttcctccttctcttcgtagttttcttcccggggtgggggtcatctttgatctctccctttctttcttttttttttttttttaaaggacttcattgtttagaaatgttttagatttgtgggaaaattcagctcagggttcccatctacccctcacccgggatcccctcctgtttttaatgccttagcttacttgggtacatcggtcacaactaaggaacccatattgatgccttcttgttaccttgagtctgtgacactttcagatccccatagatttccctaatgtcctttttctgctccaggatcctacctgacatttagtggtcatgtctcctgaggttcttgttggctgtgacagtttctgatgttccttgtttttgaccttgaccttgacagtttcggttttgtttttgttttgagcagagtctctctctgtcacccaggctggagtgcagtggggcaatctcggctcactgcaacctccgcctcctgggttcaagagattctcctgcctcagcctcctgagtagctgggattacaggcgcctgcccccatacccggctaattcttgtatttttagtagagacagggtttcactgtgttggccaggctggtctcgaactcctgacttcaagtgatctgcctgcctcggcctcccaaagtgctgggattacaggtgttagccaccatgcccggccgtccttgacagttttgaggagccccagccaggtattttccagaatgttctttgagcctccttcaaagactttcctcagcatcgctcagtgacttcttatgcttcattgtccagagctggagccgcgggagccacagggaggtgggaatgtgactgcgcagccggaggcctcgcctccctgacgctgtggggtccactgggaaggaagtggggagacgggcattacctgggtgacaggcggccactgtcgttcttggggactgagatgctatggcagtgcacatatttttaaaagatgactactaaatttaaatagttttaaattatagagaagtcgcaggtccctgtttgagaatcattgatctagctgtggttctctggtggtttgtggaagatggcttctctctagcttggtgttacatgcttacatgaccaggtccctagggataggcccacccagccccgctttatgaactcagaggtgtctggcacggttctggccctgggagcctcacctcgggagtgagatgtgttaagtctggggtcaagttgcggttttgcaagatggttaagagtatcgtttctggaaccagagcttcggttcaaatctctgttttgccactaactagctacggaaacttgaacaaattacttaattcttccatgcttcagtttccccatatgcaaaatggggaagatagtagagtcttccattgggggtggtgagttctgagggctaagccttgtggggagctgcgcacagggcctggtgtgtagtcagtgttctgcaaatgtcagtatctcccttccctttgccagggtgtgtgagtgtctctgtgtccctgtctgtgtttctggtgttactgttgccttagattctgactgaataacctggctcggttattgtgtgggattgtgtgggaaccatacagattgtacaggcatctccaaggtaaagagtgggctgcgtatgtggggactcacacaggtgttttgaaaggtatatcctaaaatagccatcaccttcattttttttttagattgtatcaaaatttcgaacaacattaagcaaagatatgagacttttatgtttttaagagaggccgctcattcaaagcttttctgatcctggaggcctcagaggccgtcgttgtgacactcattctgtaggttcactgtgttcttgagttcatgtccatgaaggtgctggtaccattttgtgcttttaacaccaattctcggggtgacagagagattccacagccttttccccttgctctcctaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccaggtaagccctgggacaccgaggccttgggctcccgtaacccacaggctcccagcccttagatttcatacttctctctctcctggacacagggggtcgtgattggaacaggggaaagctctcagttcggagaagtgtttaagatgatgcaggctgaagaggtaaggggcaggagggggcttcgggacttttgtaagctggagtttgagattattataggcaaataataccagccttgcctactccttaggaatgagtggcatgtggttcatatgagtatactttttaaacatttaatttttttttttaatagagacagggtttcgccatgttgcccaggctggtctcaaactcctgagctcaagcaatctgtctgcctcagcctcccaaagtgccaggattacaggcataagccaccacacctggcctcttttcaaacacgtaagacatttgttagcattttgataaagatacagctttcagacagtaatacgcacaggtcttcagtgcaaaagtcaatgaatgttgacatatgtgtacccctgtgtaatcatcactgaagctgtaggatggcaaggtgaagacattttgaacaaaggcaggcagaagctaggatcttgtccaactaacccattgtgctcaccctttcagacacctaaaactcctttgcagaaaagcatggacaggctaggaaagcaactgacactcttctcctttggcataatcggtgagtgaagcagtttccatactgggtttgttctgcagatggaggggagccatcataggggggttgccatggccgtttctcaaatatcttgctactcagctgcataaggcttggggattgggatcagaggctctccacaagcaacaagagctttctgtatagttggaccaggctggctgctgtaacaagcagccactacattttcttggcttaacagagtaaacgcttgttccttgctcacaccgcagtccaaagtccgtgggtgtattcctggtccagtggctctcctggatagctcgcctacaaacagtgacttgggcccaggcccctgttacattgctgctctatcttcctctgggtccttggaggccatgtttctgttcagccagcagatggtgaaagaggaaacatggaggcttgtggaggacatttttaaggcatagaccaggaagtggaatcatcaatttgaccatcttttattggccagaatggagtcacatggcctacataactgcaaaggagactgggaaatgtagtttatctgtgcacccaaacatatttctatgcttctaagcaggctgttcctggactgggacttcctgacctttggtaacacaacaaacagcattgacatgatgctgcggttctgaatctagatcttaaggcttgacatccccatagtgctgccccagtcccttctggggcttcttcctgttctttccatatctggccttacttctgtgtcctttattccagcctttaggatcaacccatgcctggcccctaatagattctcagtaaatatttgttgagtaaaacatttaatcaaggaataaaccaacaagccactgcctatagcacatctagtgatgaggggggtgctggtgagtgtagccaaaactgcgaagccagagaacagtcttgagagaaacagcttatgtaagcccatgtttcttaagttaaattagaacttaaattgacatgtccacagcaagacccatgatatcattcagacattttttttgagggggcaggaatggagtctcactctgttgcccagactggagagcagtggcgtgatctcagctcactgcaccctctgcctcctgggttaaccaattctcctgcctcagcctcctgaatctctgggattacaggcatgcaccatcacgcccagctgatttttgtatttttggtagagacagggttttgtcatgttggccaggctggtctcaaactcctggtctcaagtgatctgcccgccttggcctcccaaagtgctaggattacaggcatgagccaccgcactgggctttttttttttttttttttttttaacattttgggaactgctctagcagatggagagttttgacactcagtcccatggaccccctagaaggcccaaggggcaggtgcagggaagcaacaccatgctggtcagcgcttctagaggaaagtagcatttgccaattcccatggtgcaaatactctcagtgtggccgttttcaagctactaatgtatagacacagaacatggatttcggaagagatgtacctagttgattcttgtgagctcctgtgaggagtctccagccttctactatgggaatgccacaagggtggagtgagtacctagtgggggtggctctaggctcactgcctcacccctatttccaatagagctccccttgctaatctatttcatttgagttcatttgggttctagctaagatttcagctgatgactgagtttagtagccaatagtagaatgcccaaaacaaaactaacagatactgtggcagctgcccccctcaatacatacacacacacaccccgctaccatccatcagaaaacatccctggccccctggcccctgcaaagcaaagctaacgttctttagcaagctctccaagggtgtcacctggcaacaccacccaccttcccagtccctactcacacctccgtgtctcgtacacctagtgcagtaactggtgtgcagtacgtatttggtaaattattaatgaaggaaaatggaaatggagtatatttaatcatgagtaccacagagtaaaataatttgaaaaaacagtgacctatctgcccatcacaggagcagttgcatttgccacaacaaacaccacatggggggatgttctggatacacgcagccgacggtaaactttgggaataagatgtaaatgcttgcgaacagtccaaaatagactgattgagccttttacttaaatttggcttggacctttcctaagaaagtaaaatcgggtttttgtaggtataaacgtatctcccttagaaaagagaagagacgggttgaaagtggttgaggttatcaggcgttcctctgtgcatgcattcctgtaaactctttaaggaagtgagtttgaatccctccaggcatcagcgtgtgtagtgcatatggagataaggatgtttttgtctcttccccaggtctcatcatgctcattggctggtcgcaagggaaacaactcctgagtatgttcacgatcggggtcaggtaagagtgctatggccgccccttgccttgccagggtggtcaatgggctctgagcccttccctgccgcaagagaaggtggggaggctgcagaataggaagggttgggaaggtgcagccccgtcacccaaactccagcctcccaatagcatgttctccgacaggtacagagtgcccggcgaatgcttgcaaaatgaatgacagcaaatgatccagggtgtcccttttgtattaggctgttcttgcattgctaaaaaaaaaaaaaatacctgaggcttggtaatttattaagaaaatagtttaattggcctatggttctacaggccgtacaggaagcatggtgtctgctcagcttctggggaggctccaggaagtttccaatcaaggcggaaggggaagggggagcaggcatgtcacatggcaagagcaggggcaggagagggaggaaggggagatgccacatgctttgaaacaattagatctctcaggaactcactccagcaagaacggctcgaaggagatggcgctaatccattcatgagggatccaccccatcgtccaatctcctcccacctccaacactggggcttatgtttcaacttgaggtttgagttgggacacacattcaaactgtatcagctttcttgtcactctttgcctgtgggtttgggtctttctggctaagagcaaggaccccagagccagcctgcctctgtttaaattctacgcttgccacaaaactggaggttctgtgacctccagcaagtttcttagctctctgtgccccagtttcctcctctgaaaaatgggaatgctcatataccctctcctagggcgactgtctggattaaaggagttagtctgtgcaagcacccacatgatacacagtgcagagtgagtgttggctcttaatactggtttacaactctatccaagcccttgtcttacagaggaggctatcagagcggcaatggatgtagagcccaaggccacacgcggacagcagggctgggagtcatcatcacttgatgatgctaagccgaggggacccgcccttcttctacgtagtgattcataagtcatcccaagcccctgggtcctggtggccgagacagggagaggcacgggcagcccagcatcgtgcagcggtttgactttgtcagtagttcttctgtggctatttgccaagagcaagggaagcagaggccggggattgtcactaactgggtatgtcccattggaagggagcctaggggctgtgccaggacacggaggaaccaacccatgtctaggctcatgtcaggcccattggttcccagacagtaacgcacacgcagctgctgtctgcaacgtgtttttaggtgatgtgtggaaaatcattctagtgtctgttcatatgtatatatatgtaattaatacatcaaacccatgatgtaaacaaacttagatgtccatcagctcattaaagaataaacaacttaggtacagtggaatatttttcagccacagaaaggaatgaagtactgattcatactgcaacatggattaatgttgaagccattttcctaggtgaaagaagccagttgcacatgttatatgattttatttatataaaatattcaaaaataggtcactcggccaggcgcggtggctcatacctgtaatcctagcgctttgggaggccaaggcagacgatcacctaaggtcaggagttctagaccagtctggccaacatggtgaaaccctgtctctactaaaaatacaaaaattaactgggtgtggtggcaggcacctaaaatcccagctactcgggaggctgaggcagaagaatcgcttgagcccgggaggtggagtttgcagtgagccgagattgcgccactgccctccagcctgggtgacagagcaagagactgtctgaaaaaagaaacaaaccaaaacataggtcacttcatagaaacagaaagtaggttagtgtttgccagggcctggggttggggagtgtgtagtgactcctaacagttatggggtttccttcgggggtgaagaaaatgttccaaaattgattgtgcggataggtgcacgactctgcatacactaaccaccattcaattatatatgttaaaggagtgaattttattatatacaaattatatatcaatagagaaaccagaaaggtatagaacaggcaactaagaatgctgttattgagagggtcctcggagcctttctaatttatatatgaagagtaaaccattattgcaaatgtgtgctgtaatgatcattacagtgaattacagcagacaaactcctggtggattgaggcatcccagtgtgtgctgggacacagaggtttgtcctgctggccagtgtgggcaagagaatcttgctttaagggttgagtgtactgggtctggtacatggtatcaggtacctagtatcaggtgtacatggctctggtgcatagtcaggcttgcctgtgtatacatgaatgtacacgattatctggtaattagtagtagaagagattccaaatgccttattttttcaacgacactgcatggtgtgcattaattgaggggcaggtggtaaaatcaacatgtgggcagctgtgtgtcctatgacaaaagcattcaataactgttttttgagttaatgggaattggaaatactgtgtctggctttggatactttgtcactcagtgtatttaacaaacaaaatcttagtaacaccaaatgctgagagcacacaaaaaaaacatggaaaagaggagctggaatattatgtgatgatgtgggcacacagatgtgataaaaatcctaaaagcaaaatacaaatgacagacacttggaaaaccccatcccagataaattctaagtcataataagttcatctcttcccttaaagaaaaaaaaatcctgtaatgagacacacaagacattcaaaccacatcagaatacccttaaatgatagttttcaataggaaaagaagaacaagaaaaaaagctgtactcatagataatagtctttaggttttagctttaaacaacctataaatgagcggagatgtatgccaggggttggactttccccctagacctgtttggaaccatgaaaatgatgcagtggtgctgtacaggtgtctttgctgggttgcagccctttttccctgaatatatgcccaggttctcggtttgttttactaatggccctgcgaaagggcatcttaggctctggataatgaaacccaagggggtctattgaatgtaggatggtcttgatctctagtgaattggggctttctggcttaatatcctgaacagaacgatcttcatggcgttgttttttttgtttgtttgtttgtttgttttcagacagagtttcactcttgtcgcccaggctggagtgcaatggcacgatcttggctcactgcaatctccatctcccaggttcatgcaattctcctgcctcagcctcccaagtagctgggattataggggcgcaccaccacacccagctaattttttaaattttaagtagagatgggatttcaccatgttggctaggctggtcttgaactcctgacctcaggtgatccacctgcctcagcctcccaaagtgctgggattacaggtgtgagccagtgcttccagccttcgtggagcttttgaggagcatttatccttcggtgttactgtgtatagcacgtgactgcgtgatctgttcgtatcactttcattgaatccctttcatgttcatgtagtgttgggattgggggaggttgtgaacaagacagtcatggttcccaccttcaaagattgtaggtctcagtggggatggagaatcgatgggaatcaagggctagaggaagagagctgggaagagaggcagaggcaggtgggagagggagcgtgaagctgagatctggaggagctgtggctgatgtgatgaggccttggaggagactgggtgtgcatattcctgtggctgtcaaaacaaagcaccacaggctgcagggctggaaacagaagcttattctcaccattctagaggccagaagtccgaggtccaggtgtggcaggagcatgctgttcttgaagaccctagggggagaatcagccaaatgcttctcagcttctggtgtcacaggcagtcctgagcacatagatatcttgcctctagtctctgtctgtcacatggtctcctcctctgtctctgcgtctcttctcttctttttataaggacgccagttgtattggactagggtggatactctaatgaccccatttttatttgatgatgtctgcaaaggccctgtttgcacataaggtcacattcacgtgtaccaggagttaggatgtgaacatattttattggagggacacaattcaaccccttagcagcaggcactgggctgccgggagaagggggtggatggacaacaagctcgttgaaggagatgaggacaaggaggcctgagccagggctgggaagacccgtctacgcgaacggcaaagttgccaagagcagcctgcaggtggacagagtaaagtcagttctgggccgggtgcggtggctcacgtctgtaatcccagcacttttggacactgaggcagacggatcacttgaggttaggagtttaagaccaggttggccaacatggtgaaaccccatctgtactaaaaatacaaaaatcagctaggcgtggtggcacgtgcctataatcccagctactggggggcagaggcaagagaattgcttgaacccgggaggcagaggttgtagtgagctgagatcacactactgccctccagcctgggcagcagagtgagacaccatctcaaaaaaaaaaaaaaaaaagtcagttctagaatcttcaaggaattgaagagggagggaccagggtcttttggtgctggagaaggagcaggagtagaacatgtgatcccagttcacccttacacagcccatggggtaagtctggcctcctttttacagattgggaaacaggcttacactagcacaacttatgggatcagggcatggaagagacagacttcaaaccactgaagcctgatccaaagccgggctccttgtcagcaacccaacccccccacctcagcaggatggggactctgctgccagccactgcccctcactccctatccttggcggccattggcaatgggctcgagtttgtttgccccatgaatatgtattgggcatctgttgactctctgtttacatcaaaagtgctgatccagctggatcaggtagatctctgccctcctggagttttctggctggggaaaaaagtgaatgttaacaatttaagcacacattaataaaaataattacaacttatgagtgctacaaaggaataactgccgagaaagagattaaaagggaggtagaaaccagctgggcatggtggctcacacctgtaatcacagcactttgggactctgaggtgggcagatcacttgagatcaggagttcaagaacagcctggccaatgtggtgttgcatctctaccaaaaatacaaaattagccgggcatggtggtgtgtacctgtaatcccagctactcagggaggctgaggcaggagaatcgcttgaacttgggaggcagaggttgcagtgagccgacatctcaccactgcaccccaacctgggcaacagagcaaaactctgtctcaagacgaaaaaaagggaggtagaaggggatggactggaagaggtggccagggagggttatgggtagagagttgaggagtcaggagatgagcaggaagggtgttcaggcagggggaacagcacaggcaaaggtttgggggtgggaacatatccgagggtcacttgggggggaccacagctgagctctgtgagcagaatgagatgatggagttgcttagatcatggggaaactcatggccccttctcctattcctaacctcatcatcagagcctttcccaatacgccacgccaggctgtctctgtgacactttggaagcagagagatgaaaagtgttggccacccttgatttagaggccgaaggaagtgggaggtgggagccccagcttattacagaagcgggggctgggaggaagggggcactggagcaggacgccgagctgtgctggggacagtggggtttggggcattggaagagcacctgcagaggcaggcactggagagctgaggtctcccgccgagctgaagaacgggagggtccctgagagagatggcaaacctggatggccgctcccccaactcggggctgggtggggcccgagactcacatttctttctttctttttattatttcagtaggcttttcgggaacaggtggtgtttcgttacgtgaataagctatttagtggtgatttctgagattttcatgcacccatcacctgagcagtgtacactgtacccaatgtgttgagactcacatttcttttgtttgcttttttatttttaaatttttctttaagttctaggatacatgtgcagaatgtgcaggtttgttacataggtatacacgtgccatggtggtttgctgcacctaccaacccgtcatctaggttttaagccccacatgcattaggcatttggcctaatgctctcccccgaaccccccgacaggcctgggtgtggatgtccccctccctgtgtccatgtattctcattgttcaactcccacttaggagtgagaacatgccgtgtttgcttgcttgtttttgagatggagtcttgctctgtccaggctggagtgcagtggcgtgatcttggcccactgccacctccatctcctgggttcaaactattctcctgcctcagcctcccaagtagctgagattacaggtgcctgccaccacacccagctaatttttgtatttttaatagagatggggtttcactatgttggccaggctcatctcgaactcctgacctcaggtgatctgcctgcctctgccttccaaagtgctgggattacaggtgtgagccactgcgcctggctgagactcatatttctaacaagctctcaagggtgctaacacaggtggtccagggagcaccctctgagcgtgaggctgtgattcgacactgtcccctgagagcgggctccagcaagaacaggaccaggaaagaggccaagacacccgaacagcattctcaggtgactgagcctttggaggcaggggtggcggcagggagggagacatttgagcctcaaggaggctgccagagaacacaggactctcagaagacagaatgcttaaaatcttccccaagtaggctgggcacagtggctcacacctgtaatcctagcactttgggaggctgaggcaagaggatcccttgagcccaggagtttgagaccagcctagacaacatagtgagactgtctgtacaaaaacaaatgttttgttattagccaggtatggtggtgcacgcttgtagccccagctacttgggaggctgaggcgggaggattgcttgagcctgggaagtcaaggtttcagtgagccatgatcttgccactgcactccaacctgggcaacacagcaagaccctatcttaaaaaacaaaaacaaaagaaaaccaaaaaaccaaaaaaatctcctgcagatcatgagttcaggagtttgagaccagcctggccaaaacagtgaaacctcgtctctactaaaaatacaaaaattagccgggcatggtggcgtatgcctgtagtcccagctactcaggggctgaggcaggagaatctcttgaacccgggaggtggaggttgtggcgagccgagatcgcaccactgcactccagcctagggaacagagcaagactccgtctcaaaaacaaaacaaaacaaacaacaacaacaaaacacacacacacacacacacaccctcctgccaataatggtgcatccaatccctgtcttataagccatgagaagcttcatgaggcaagaaagacgattaaatatttccagaagaaaaagcaaaaaaggcttctgtgctcaagccccaaataccccaattctctccccacccagtgctatggtcacttccggtttcttgtcctaacctcccttgcagcacgggcatcccgcttgatccatgcgagtggacttgcacgtgggagacactttccccctctcatttgtcattttgaaagggcgaggtttttcagttttagtgccagattaaagccgctgaaagccactgagtcagaaggtggagatggcagcttagccagcggagattttccaaaataagtaaaatgagagaatcatttttttaaaactttaagaacttttttaaaacgaattcctgggtcgggcacggtggctcatgcctgtaaccccagcactttgggaggccgaggcgcgtggatcatgaggtcaagagatagagatcatcccggcccacattgtgaaaccccgtctctactaaaaatacaaaaattagccaggtgtggtggtgggcgcctgtagtcccagctactcgggaggctgagggaggagaatcacttgaaccctggaggcggaggttgcggtgagccgagattgcaccgctgcactccagcctggtgacagagcaagactccatctcaaaaaacaaaaaacaaacaaacaaaaaaattccctatatgttaagtgacattcaagatgatacaaggcacttgcttttcctggtccattctaatcaatttttgttttgcttttgtttttttgagatggagtctctctctgtcacccaggctggagtgcagtgatgtgatctcggctcactgcaagctccgcctcctgggttcaagtgattctcctgcctcagcctccccaagtagctgggactacaggtgctcgctaccacacccggctaatttttgtattttggtagagacggggtttcaacacgttggccaggctagtctcaaacccctgacctcaagtgttccatccgtttctgcgtttcaaagtgctgggaatgcaggtgtgagccaccacacccggcccattctaatctttattagtctgtggattaattctttattattatgaattcatccaagtaatacaaagatgcccttcccctgccatatgggatgaaagtccccgtcgtaaccctccacaaatgtttgcttagctggtcttcacagcctgtgccataaaaccaacgaagccttctggctgtcactgtagaaaccgggcacagccccttgatcagattctgtaatcttggtttatataacttgtccatgcctgttgtattgtccctgggtgaaaggtcaccattcacaaccattctattcaaactgcctgttttgtaattggaatttgttgccaacatttaatgtaccatatttctttgattgtgagatgtacattctttttcacatttcaactcctctgaaatcagatcacttctaataagtgatgtaattagaaaacatggtgttactgattaattggcagtgtttattcttttctgagctctgcccaaaataatggtgcccttcacaatcaactgtcttagctctgatgaaatgtggtctctctgtgtgatcctggttgaatggattctcaccaggtgttcagccaacccaggtggagtgctcactgtgtgctaggccagcgcaggcctaagcattgttatacccccttcttcatgcagcaaatatttactgtatacctccttgctttgctggattttctaatgcagaggataaaaacagccacctggccaagcttggaggctcatgcctgtaatcccagcacttgggaatgctgaggagggaggatcacttgagcccagaagttcaagaccagcctgggtaacagagtgagaccttgtctctacaaatccttttttaaattagggagtaaatagtggtgcatgcctatgtcccggctaccagggaggcagaggctggaggattgcttgagtccaggaggtcaaggctgcggtgagccttgatggtgacactgcactccagcctgggcgacagagcaagaacctgcctcaaaaaaaaaaataaaaaacaggcaaggcacagaggatcacgcctgtgatcccaccactttgggaggccgaggcaggtggatcacttgaggccaggagttcaagaccagcctggccaacatggtgaaacctcatctctactaaaaattcaaaaattagccaggtgtggtggcacatgcctgtaattccagctacgcgggaggctgaggcaggagaattgcatgaagctggggggtggatgttgcagtgagctgagactgcaccactgcactccagcctgggtgacagagtgagactccatctcaaacaaacccagccacccttgtgtgatatagccagaaaatgtgttttgtttgaactgtatctttttcattggaatttgttgccaacgtttaaaaattgggagtttgcatgaaaaagatactggatttccagcttctcttgggagcatgggaggcccggcagcactgtgcattgctgtggtccctggtgacttggtggtggctctttgtttagaggagggcctgggctctgggatcgccacgtgggcttgctcgccctggccgatttcacgtatttcctgggcagcctggccccagggcctggaccgggcgtgtctcgaggggcttctgcagggtccctggcagtggctgtgggtgggttgcaggtgtggtgagagacagtggcccccttctcccaggatgtttctggtatctcagataacagaaactcctcatcacttctagtcccctaaatagtctctttctagaaattgtacagagtggatccatgcggtgacagcacttggagctccactgaagtcacatcttcccccctcctcagcctggcctcgggtggaggtttggtggggaggatccggccaacctccctcacctgctcaaaatctctcctccccctccccatcgccagcgaaggctgttttttttttttttttgagacagactttcactcttgttgcccaggctggagtgcaatggcaccatctcagctcaccacaacctccacctcccaggttcaagcgattctcctgcctcagcctcccgagtagctgggattacaggcatgcgccaccacgcctggctaattttgtatttttaggagagacggggtttctccatgttggccaggctggtgtcgaactcccgacctcaggtgatcgaggcgcctcagcctcccaaagtgctgggattacaggcatgagccgccacacccggcctttttctttcttaaacagctttattgagatataattcacatatataattcatccatttaaagcatacaatttaatggtttttagtgtattcagagatatacacagccgtcaccacagtccattttagaatattttattttatttgagacagggtctcactctgctacataggctgtagcacagtgacatgatcatggcccactgcagcctcagccttgacctcccaggctcaagtgatcctcctacctcagcctcctcagtagctgggattataggtgcacactgccacacccagctaatttatatatacatatgtatatataatttttttttttgtagaaataaaaaaatgttgcccaggctagtcttgaactcttgagctcaaatgatctgccagtgtgatcctcccaaagtgctggtattataggtgtgagctactgtgcctggccttagaacattttcttttttcttttgagatggagtctcactctgtcaccaggctggagcgcagtggcgcagtctcggttcactgcaacctccgcctctcaggttcaagcaattctcctgcctcagcctcctgagtacctgggattacaggtgcatgccaccacacctggctaatttttgtatttttagtagagatggggtttcaccacgttgtccaggttggtctcaaactcctgacctcaggtgatctgcccacctgggcctcccaaagtgctgggattacaggcgtgagccaccaccccctgcctagaacattttcttatcgcctcaaaaagaaaccctgtgccctttagctatcactctacattcccacctatgcccacatcccagccctaagcaatcgctcatctttctttcttgtgtagatttccccattctgaacatcccttatgaatggactcgtgctctgagtggccttctatgtctggcttcttccactcagcagcatgttttccaggctcatccacatggtggcatgtgccagtgccttgttcctttctttggctaaagtgtattctgctgtatagatagaccacatttggctcatccatttgttcactgatggacatttgggttgtcatagtttcttcatgtttgtttttacattttttaaaggaaaatttcaagcctgtacaaaagcagagaggatgataaagtgaacacctgtgtagccactacccagcttcagcagtggcccacttgcaaacactcttgccctttctacagcccacccctggctatgtcaaactggacaccaggcaccaggcatcatacctttccaccacttcaggagtgtggaatgtggggccagtcagccccgatgttgtggagtctcagccaaaagggatagaaagagccccctctacacatgctctcacctgttgacacacccagagaaggggtatcatgtgctgcagccccagtctcatttccaagagagcatctcaccagctcagcttgggtcacacgctctcctcgaatccagccaaccctggttatgagagagtggggtcgcaccgtacagggagagttggaggggtaagaaagaagtgagcagacaccccgaaacagatccacgcagcaggcaagtgtgtcgctgtggcccttcacctgccctgacctggacttccttgtctggcttcctcataggaagtgtctacaccactacactcatgaaaagtgaaattcaagggactcacgaggacccctggaaccaaaaactcttaatcccacttactgtctgattttgggaattccttttatggaacccaaagccttttctctctaataaatgagaataatgtcaatgcaaaatacttttaaagaggcaaaacagctgacagactaattcacattaaggtgtggatgactgacaggagaggtcccttcccaagagcggggtctgcaggggagggctcaggacagtgggtgctgcagaaggaggcaggtgcaccttaggattgggaatggagactagaaccaggacactggggacacctaagacaagcttcaccagccaaaagcattgccagccccagctgagagtcacacactccttaaatgtgttagaggggactcatttgacctttcgatccagcctggctgtggcggccattccagagggtctgcccatcgtcgtcatggtgacgctggtcctgggagtgctgcggatggccaagaagcgggtcatcgtgaagaagttacccatcgtggagactttaggtgagggactccagctggtggaatccttacacgtggaattgaatgggggcttggctgtcagggcaatccagcctgggggtttcacaagcctgaggatggcaacttctcttctataaactggtgtttgttgtaccaggttgctgcagcgttctctgttctgacaagacggggactctgactgccaatgaaatgacagtgacccagcttgtaacgtcagatgggcttcgtgccgaggtgagtgccaaaggaatttacaagccttaaggatgcacccagccaggctgtctcctttctaaactaagcacacaatgtcttctagaacacaataaggaagaaataaattggggtcatcttataatctccttgctaacatgactgattttgtttttaatcatcccatacttccttttaatagatatgaccaatttaaggtagcctccttttttagttacttattaattataagcacattgcaaaatttaaaagctagaaaaaatcttccataccttccacgataaactaaccgtgattagtccatttgtggtttgtttgtttgtttgtgagagacagagtcttgctccgtcacccaggctggaatgcagtggctgatctctgctcactgtaaccttcacttctcgggttcaagcgactctcctgcctcagcttcccaagtagctgggactacaggcatgccctaatacgccgagcttatttttgtattttctagtagagacggggtatcactatatgttggccaggctggtctcaaactcctgacctcaggtgatccgcccgccttggcctcccagagtgctgggattacaggcgtgagccaccacgcccagcctgttttattttttaagccagggtcttgctgtgtcgcccaggttgcagtgcagtggtgcaatcatggctcactgcagcctctaacttctgggctcaagggatcctcccacctcagcctcccaagtccttgcgtgtttttcagtgtcctctgcgtgcttggcgtaattggaagctctctgaatgtgcaatttttttatcctgatattttttctacaaaactggccaaaccaaggggtgaacaggtgatggtccatgggccagtgcttgtttgaaaataaagtttccttggtgtaccaccacacccatttgtgtacatattgccaatggctgctttcatgcctcagtgtgccgcaacggcagagctgagtagccacgacaaaggtggtatgggctgcaaaggctaacacgtttacccagcgctgttcttggaatagaagcactcttctatgctagttcttagttttcttaaccatcacttgtactggctgcagagtatcccactgagtcaacttgctgcaacttactcatgcctggtactgtgtccatccatgacgtatccaattaatcaataatctttcagagaacatcttcatactgaaagccctgtccacgtttaggattgtgtccctggaatggatccccaggacagagattgtgggccaactgggggagcatgtttttgactcttggcgaaaccctttcttctgcctcgccctgcaggtcagcggagttgggtatgacggtcaagggactgtgtgtcttctaccatccaaggaagtcattaaggaattttccaatgtctcagtgggaaagttagtggaggtaggtgtcaaaagcgccatgagggaaataggcatttacattgaggcttctggggctcctctctgaaaagggaaacagccattgaacctactggttcttgacaatgactggcccatccaggggtgaggctggcacagcactgaaaaaatggcctcaaaagtgatggagacatcagaagtaagacgacagctaggctgggcacagtggctaatgcccgttatcccagcactttgggaggccaaggcaggagaatcacttgaggccaggagttcgagaccagcctgagcaacgtagtgagaccctgtttctattattttttttaaaaaaattatttaaaaagaagagctagaagcctctgtactcatcactgcccactgggaaggctctaaggagactcctgcccagagacgtgcccgatgaatggtaaaaagtgagcctgtgatgaatttcccctattgttattagtgagcctgtgatgatgttcccctgttgctgtgatgagtcctgcggtccgagctgtactcaccctttcacaggggctccctcctccccatgtagcaggcacccttcttcctctgtacagttcagtgagcgccacttgcaaaggacctgcctccaggggccacttcactatcacagcaaacgctgtcttggttttgcagattaaaaatcaaaaatatgaccaggcgtggtggctcatgcctataatcccagcactttgggaggccaaggcgggtggatcacctgagttcaggagttcaagaccagcctggcccacgtggtgaaaccccatctctactaaaaaatataaaaattagctgggcatggtggcacacacctgtagtcccagctactcaggagcctgagacaggagaattgccttgaaccagggaggcagaggttgcagtgagctgaggtcatgccactgcactccaccctgggtaatagaatgagactccatctcgaatgaatgaatgaatgaaacaaaaatatgcaaaactagtaataataaaaaagaaaagaaaagaaatgggcagagaagtaatgcgagtgtccaggctcaccaggccgggaaggaagagcgctgggaatcccactctttttgcttgtctctttttcattttttaaatatttatgtataaattgaggtagaagtcatctaccatgaattcaccccgttaaagtgcacaattcagtggtttcaatttgttcacaagttgtgcaaacttcaccactgtctagaatactttgtcaccccaagtggaaatgccatcatccccattatcggtcgctccccgttaccccacactcgtcaccacccgtgcacctgcctccctgctgggttccctcatgataactttatgggaaccaacattcagcacagccaagaaatagtcacgatgtttcttttaaaaagccgggacgctgagttgttttaaagagcaagtcttgtccccacaaccccagctgtaaaaatgggacaggcccacaatgtctaactttttcatgagcccagtactaactacagatgtccggacaatccccttttaggcgggctgtgttgccaacaatgcggtcatcagaaagaacgccgtgatggggcagcccaccgagggtgcattgatggccctggcgatgaaggtaggaggtcctggggtggctctgcggggaattctttcgctcggggctggattcattggtagaaagccagctcctgtctgagctaacaggagtggggacgttaggtaatcatggaagaaaatggcccacactggccttgggccatctgttggtggtggaggaggtgagctctgagattccacgggacttcagcaagttctgcaggtctctaatccctccaccagcgattccaaaagaatcctatgagcttccctgtggttcaggccctggtcaggtgttgaggcgacagacagtggaacgagactccctatgcacccaacacgaccctgtgctcaccgaggcaccactgggaggggctggttcctgggaatgtattcgattgactccggggttcagtgttagaccctgagctctgtggctgtgcagggttgccccaggccattctgtacccagcaccaggtaccaagtggctgcttgcagtgtggaggggatgggtgggagctgatgggggcctgctgcattctgtgctcagaggacaagttagaagaaggagaggcagaaaacatgggctgggaatgcaggtgacaggaaagcaaggagaagagaggacaaaggacatgggaaaggaggggccggcagaggttaagaggagggagcaaaggaaggaagaaggtggccccggtcagctcccacgtctgtttccatggccacttggcctgggtccctcctcttcagccagagctggggctcccctggacactgtgggagctcctttccccgacccgctccgtgctttctgctgtgtgacttgtctctgactcgggtgtgatcagaaccctctccatcaaggtcaagggaaaagcccgactcagggtgctcatcccccagcacggacccctcgctgccgccgagcctggcccctgcactcaccctcccttcctgcttcctcctggactttgaccactcctgcctgttctcactggcgagtgccgactttctcttcaagttcactccagtttccaccccagcagacacctctcctcatcccgggctcacttcactgccttgtattttcagcttacctgtcccatcactgagcaccagggctcacttcactgccttctgttatcagcttacctgtccctccctccagtgcaagactccaacctcccacaccactgccttcccaaagctggtgctgggcgggggagaggtggtcgccctctcataagcccccgtgttggtagatcaggtgcttttccccagtgtaagaacattggaaagtcattacaggctgagtgcagtggctcaaatcccagcactttaagaggctaaggcgggaggatcatttgaggccaagagtttgagaccagcctgggcaacatagcgaaaacccatctctacaaaaaatataaaaattagctgggcatggtggtgcatgcctgtggtcccagctactcaggaggctgaggcaggaggatcccttgagcccaggagtctgaggctgcaatgagctatgatcacaccactgcactccagtctagatgagagagatcctgcctcaaaaaaaaaaaaaaaaaaaaaacaaaaagattgggcacagtggctcacacctgtaatcgcaacactttgggagaccgaggcaggtggatcacctgaggtcaggagttcaagaccagcctggccaacatggtgaaacctcatctctactaaaaatataaaaattagctgggcatggtggtgcacacctgtaatcccagctactcgggaggctgaggcaggagaattgcttgaacccaggaggcggaggttacagtgagccgagatcgtaccattgcactccagcctgggtgacagagcaagactccgtctcaaaaaaacaaacagaaatcatgacatcgtattatttttcttccattcacagaagagaattctctctgcaatgtctgtaatagtgaatggagctcatttcccgttttaaaatagtgctgagtctgccccattcaacaactcctcgccgcccagaagggaaggtgccggcctgaccgcctggcaggaatgacacccatgtgtcaccttgcttccgccaccagccgtccctgcagcctagagaggagagaggttccagcacccagaagagatttccttgatgtgttataattttcctttttcctggggcctggcttaagattttggaatacagaacaaacactggctggcatgtaggaagtgctgcctgtgtgacaggcatggggcaagcactttgtggttcttacctgtctcacctgctctaaatggcactgaggccaggccagtggttcccgggcttttcttccattattgctcctggattagggtcttggggttactgaaataaaacaccactggctggtgatttagtgtaaccaaaacacactgaaacacagctctgtggccagaagttgaaatcaaggtgtgagcagggccaggctccgtctcccagtttctgggtgttactggcagccccgggcgttccttgactcgcagacgcatccctgccttggtctctcacaccaagctctgtctctgtcacgaggtgctccccgccacgcctctgcgcagcgttttcctcttttttttttttttttgagacggagtctcgctctgttgcccaggctggagtgcactggcttgatctccgctcactgcaacctccgcctcccaggttcaagcgattctcctgcctcagcctcccaagtagctgggactacaggcgcctgccaccacgcctggctaactttttgtatttttagtagagacagggtttcaccatgttagtcaggatggtcttgatctcctcaccccgtgatccacccgcctcggctgcccaaagtcctgggattacaggcatgagccaccatgcccggccttcctcctcttatatccagtcatgttggcttagggccaaccctaatagcctcaaattgacgatatctgcaaaggcgctattccaaatcaggtcacattcagaggttccgaggttaggacttcaacatatcttttgtggggtacaattcaaccccactaaggagatggtttaggcatttcttccctaatcaccccactccctccccatgaaatttaatatggtagatacactgtattgtacgcatatctgcactttctacgtaaaaggagtagttttttgtgcccctgctgcaccgcattttcaccccctgtgggacagtgggatgcatgggtcatgactggtttacacctggggaaactgagattctgagttgtcacatcactgatccaaaagccaccaaagagcaacaaagggccaggctggcaaggaccccaggctgtggacggggggctggcaaggaccccatgttctggacgcagggctgtctcactgactcagggggttccgtctgagaaattgctacaccttcaagtctgaaacattcctcccggcagaaacactgcaggtttgtttctaagcagatttcagatagaagctgttgcaaagaccgtcttgtctgcccttcagccaagagaagagacttttttttttttttctaggtgggacattccaagagaaatggccttttttctatgtgctaaatgcttggatttcttatctgccagaggtggtttgaacaatgaataatttaaatggactgagctttgtatagagattggcttcggatgactcactaaaaatgtgtcattttattatgctagatggacttaagtgatattaaaaattcatatataagaaaaaaagagattccattcagttcagagcagaagtggatggcggtgaaatgcagtctgaagactgaggtgagacctttcaatcttcaacctcttctctctttctgcccgggcccccacccagagataaagcaaaatgcagacttcaaggataatttgaaagttcctggctgcttctgtgacgttccaaatacatggaaaaacttaatcaccatcatacctttgattctcttgggtctgcttctggctttttgtttaaaacagaagttcttaaagcagggtccctggagtagcagcggttgttaccacgcgagactttattagaaatgcagaatctcaggttccatgccagacctcctgagtcgaagggtccaggggtgggacccagtaaccttcattttctgcagattctgatgcaggtgcaaatgttgagatcgaccagcctgtaatccagtgactgaggccctgctgctaacaccagtcgccaacttgccagtcctctctttgcagccctgtgctaagttttttatacttcttagctcatctccccgtcatactggggagcaaatccttcagtacggaaggcgtgtctgtgtggtgcatcagcgtgtgcacacgtgttgtccctggctagaggaacacataccaagctatggccaccccgggtggacattacagctgatttttaaaattttcttttcagatttgttgtggcttttcagattttccttaaaagctattttttaaagtttttgttgccttctaccgttttctccacccctcctcttccctcccactctttctagaatctatcatgtctgcccacgcagactgctcagctcccactcagggctgtgggcagctcagccagctcatgccaggcccttcctgtgcatggatggacacatgtacatttcaggggcttagaagggattatagattttcaaaaaacttttagacctttaaatcttttcccttgcaaggcaatggtaatatattctcattgaaaaagtatagaaatatgacataaaaatgaaagcttctttcattccacccttcttccctccctccccaccacccacccagaggtaattctattttaagtctgggatggagcattgcagattttaaatatgcaaacgacaacatctggatggtattttcaaaacaaggtcactatttatagtgtgtgtaatttgctttttccccctaagattttcttttaatattatgtcttagatgtctgtgttggttaatataagcttgttatattaacatattaattatataatatgtaatatatattacatatattacatatattatttaatatatattatgtaatatatattataattgtataagaatatattagttatatataatatataatatacatataaataatataatgtaatataatacatataaataatatacaatacatatgtactataattaatgtattaacatctgtaattaatattatatttattaataacattaatatgttaattacatattaataacatatataattaatattatattatcttataacagtgttacattcacactgtgcacccacgtgagccaggtatgtccggtattgaggctaggggtacagtgtgactctcactgacccagggcctccccccgtggagttcatagtctacatgtttgtcatgacagagcttaagaaaaacacaggaaaaatgatcagctactcatgtggcttcactattacaagccaagtgctgggggtgggtacaaaatagacttggtgctgccctagggaggcaacagtctaatggaaatattcccagttaatcacacccccaaaggcacagtcccagctgggatgatacctcccgtgcatgaaacatacaagacgctctgagtgaccataacaagggaactgaaaaaagaacaagggtagtacaggttgaagattggccttgttctttctctggactgcaaaacgttccatggatggattctagaacttcgcgaacctgtccagcacctgtgaacagcaccagcctatgataaataactccgctgcaaagatccccgtgtgtgtctttgtaaccttgtgcagagtggggtgatggtcagtatgaaccaaggcttccagtgatagtggatttcttccctttgtcttttctaaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcggggtcagtgcctgtggtcccggcccagagctttaagcttgcatgtaacattgacttttaagtgcattcaagcagggtccctagtcaaggaggtcacccgtcccaaggagtcaggcagcatgctgacggcaataatgtgtgcttggaacctgatggtcacatgaaaggcacagaggtccccacctcatcccagttccttagtgacccccattaatccagagaagagggtaccctcccttgctgagtttcctaaggcaggtgaatgggctgcaccccaaacattgattttcccaataggtctttttgctcattgcctcttgtcaggaaaacccgaagttcttttcagtcaaggaacatattttttcccttagccattttcaattttctgcagcagagccagtgccatccctgatgggctgaactgaacattaaatctcacatttcccttggtgtcatttgtcaccctggccagttacagaggaagcgtttagaagtgctcctgagcactggtattcccttgggggaaagtgagaggctttgggttggccttactggctcaggagccttggttttccccttcggggaacagagtttgtaggttgctggcaggcttgctcagaggtgtacggggcgagacccttgcggctttctggggcacagtgaagccagcgccgagcacgtgtcccctcttcccgagtgaggggagcgttccccaaagcattggcactttgcccccccaaatggtttgtgttgcgctgggtctacaataggcttacaggtaaatactgtgcctcagtttccccatatgcctaaggaaggcaggagagcagtgacttcattgattgctgtgaggattggaagagacggtgaatcccatcttagcttgccctgagccttgactctgtttcggtggcagagaagccaggcccagcttctgcgagccaggtgatctgagaggggctggtataagaaggtccttttcacctcgctgacaccagcgacggggctgtggcgtccctcctgcacagtggagagattgggagacaatctggcacgtgggtggcagctgcttttgtcatggttgatacgaccaagccattcagtagctccctgttcttgtcacatcacgcctctgctgacgaaatggctcacttaagagtggacacgttagtaagtaaacatcccacgtggcactggcctctaaatctgcacctggcacttgggccccacttgtgtgctgggcaccaggttaagtgcctgtgtgaggccacgccctgaatccccaccgggcagaggagccggcccaggtgacacagccctgcctagtgcagccagcgccttcgcccggatgtctgctgcggagcgtaatgacgcgttccagggacttgctccaggccttgcgggagagcgtaatgagaacgggtcagtggcggaggagcagtgagaccttttcctgtcttcccccagtgtacacgcaggtccttttttgtttacaaatggacttgtcttccacctgtggctgggaaaactacaacctgggaactggccttagagaaggcctgtgcgtttttccaatctgtgtttagtctgggatgttattcctcagcaggtgaccgtggactgatgcctgctgcctggcaggcctgggacagtgcccgagtgacttagagaggcccccaacctgctagatcccctggagtggcttgggctttgagaccccccaccccacatgcatccaggggaagatgaaaaaccccacggagagggaaggagagttggggtgaggggagcacggaggcaggagtatcctcttgggatagagcgctactaggtggccactagaagcaggggatgctcctgggttggcaaagcccaggttcagggaggggaggggaccattggaaaaggggaggaagggcgccagcgtcattggcgcagtgtcatgactgtgtaggaggcatgccagccccatctttggtgtcagtgagggggcaaggatgttcttacaccaccccctctcagatcacccaggggcaggagctgggcctggcttctgtgccacagaaacagagtcaaggcccagggcaagctcacagcaagagtcccctcagctgggttgctcccctgtcaatttttcttaacctctgtaccgcgcccccaagactgctggagatgacaagatgagttagcacagagcaaatgagggcaagaactgttagaaacgtcccatcctgctccacctcacatgtcccattctgggccagctcacaggtttctgcagccacttttgttgggaagtggggtgggtcttataccatgagtggtgtattagtttattttcatgctactgataaagacagacctgagactaggtaatttacaaagaaaaagaggttgaatggactcagttccacgtggctggggaggccttgcaatcatggcagaaggtgaaaggcacgtcttacatggcagccggcaagagagaatgagagccaagcctaaggggaaacccctcataaaaccatcagctctcctgagatgtattcactaccacagagcattgtggggaaaaccaccccatgattcaattatctcccactgggtccctcccacaacacgtgggaattatgggagctacagttcaagatgagatttgggtggggacacagccaaaccatatcaagcagacagcagtggtattttctgctatgcagctgtttctggcttccttctccatctgttgtgcacctgcgcaggcctgagagccgctggaggcatctctgccctccctttcaggctagggacttgttgcctgagccctctgcagaccgaggaggatctgggccatggtgggggctggctaacaaagggctgcgcacgttgcctcacacctgtaatcccagcacttggggaggctgaggtgggcagatcacctgaggtcaggagtttgagaccagcctggccaacatggtgaaatcctgtctctactaaaaatacaaaaattagctgggcctggaggcgcatgcccgtaatcccagctactcaagaggctgaggcaggagaacggtttgaacccaggaggcagaggctgcagtgagccaacattacaccactgcactccaacctgggcgataagaacaaaactctcttaaaaaacaacaacaacaaccaacaacaaaaaacgacggcccctaagcccccggtgacccctccttactccccctctctcctcagtgctggccctggcttctgggcccgagctggggcggctgacgtttctcggtcttgtgggcatcattgaccccccgagagttggcgtgaaggaagcagtccaggttctctccgagtctggtgtgtctgtgaagatgataacgggggatgccctggagacggccttggccataggtaactgggacagggtcgggggtgaggacgaaaggacccatccatcctttacgatggggggctgctaccaaagggaagcctccgcaaactcggtcaggagtgctcacgcctagccctacaggcttagaaaagacgctgagtattcgtgtgccagcattccaatttctgaggtgttctcgtttctgaaatgttggcaggttctgcaaaagggaagttctcatggatactgaggacctactgtgtgtcaggggcttttcatccgctgtcttcacaggcagcatcatggccatgtacagtttcagtctgccttctgcctctagctgtgtacccttggcaaaccattgaaccactctgaccctcagtctcttcatcaatagagggctagcagcccttctcctctagttactttttttttttttttttttgagatggagtcttgttctgttgcctgggctggagtgcagtagtgcaatcttggctcactgcaacctccacctcctgggttcaagcaattctcctgcctcagcctcctgagtagctgggactacaggcacccaccaccgcgcccagctaattttttgtattttagtagagacggggtttcactgtgttgcccaggctggtcttgaactcctgaactcagggaatctgcccacctcggcctcacaaagtgctgggattacaggcatgagccactgcgcccagcccctctagttactattatatgggtggtctcagcctggtgctgggaaaaggttcacgggctttggaatcagagccgtgtcaggttccagtgttactccttaccagctgtgtgtcctcggcaaagtcacttctgtttccccatctttaaagtggggataatgaggcgtttggtgtaagttaatcctgtggatagaaccgaggccgtgcagcatggtaggtcctcagtaaaccgtctccagcatggttttattcttggtgttccccatggccgaggtggggccgggagtgaggggtggggacgcgggcctcagagcaggccctcagaacaggttcttctgaaggaagaaacatcggcctgtgcaacgggaagctgcaagccatgtccggggaggaggtggacagcgtggagaagggcgagctggccgaccgcgtggggaaggtgggtccccggaggcttggctggcagtggggctgggtcacagctttgaaatctgattcttcgtcttccccgtctccgtgtccaggtgtccgtgttcttcaggaccagcccaaagcacaagctcaaaatcatcaaggttcgctgggcaaggcaggcacaggctgcgctgctggggccgggccagagacactgtggctcgaggagctcatgcgtccgtcgggtgacagtgcagggcccgaccgtggcttccttctctaggtccagggcagctgccccgggagttaccttttcatagccagggggaggggaggaggttgagcaggggcgcgtgggcagctcccttggagaggacgaggctctgaagttgccagcaacacttgcgctgacagccccttggccagaacacagtcacgggcccaggtttagctgcaggggatgctgggaagtgtcatctgtagctgggcggacacgagccccaccaaacctggggataattttaaagaagatgggagaactgggggacctttgctacatacagtgaaaactgggagctgtaattggataacgtagagggaaaaactaaaagagaagctatcttttttttttctgggggtggggttgtaggtacggagtcttgctctgtcacctaggctgcagtgcagtggcacaatctcggcttacttcaacctctgcctcccagggttaagcgattctcctgcctcagtctccccaagtagctgggattgcggtgtgcaccagcacacccggctaatgtttgtaattttagtagaggcagggtttcgccatgttggccaggctggtctcaaactcctgacctcaggtgatccgcctatcttcgcctcccaaagtgctgggtgctttttggctttattccttttactcaactccgtgcctccgtttcctcatctgtaaaatgggggaactattaatgccgtcagctgattcacagggttggtagagaattaaacaaagccaggcccatgaatctcttggcacacagcaggagcccaataaagagctgatgtgatttttctgactctgaataccaaaaaaaggtagaaaatgtgcttggttttctcgcctgtgctctgaaagtttgctcttgagctcttttagtagacgggctttcttctttcatgttatttttagctctacagagtaaatccctatgtgagttactcctcaaagaaggtagtaatacttaccaggtaccccatggtttccagggccgcactgttgattactgtttattactgggactggataacctttatgagcctttactgaccgtgctgggcaccgtcacatccgtcatctcagtttgggcctcacaacagccctgggaagaagaaactgttgctcccactttgcagatagggaaactgaggtcaagagggtcaagggctcgcccaattcccacagctaatgtgggtgaagctgggattcgaattccgggtgccctccagacagaggtgtctgtggctggccacagggtgtgcatggccgggcactgggaggtggtcgtcaggctgcaggccttcattgcctgctctttccaaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgtaagctgcccttctggttgtttttcagttgcaaaaatgcctggggtcaccagcttctccctggaacctgctactgtggagatagaggggggggtctcgcggagtccccagggagagctgaatctcggggctcgtcagtgtggcaggtgcccccaaccccaagtaccaacagcctctcatagcagggtcatggggtccatgatgcctggggctagtcacatgctgcccccaggggaatgttacggatatgaagcagagatgggatttgctgcctgtgggtgcatttcatgtggtactgggaatgcccgcctggctcaggctggtgggcagcagctgaatatgtaaggaaaacctgtggccaaatacgtgctcacacttgagtgtggggtgagaaaggattaaaatgaacatcttccgtttgaggcctgcgtgttgatacatatatctcaggcattgcaaagagacctgggcagaaacacccccatcgctgaccacggaggtgctctctaggttctggggcttgcacaaaactatttgttctgtttcacttttctgtatttttttcttaatacatttaccttcctaattttaattagttctgagactctcctcataagctaatcgcagtggttagttgggggtgagggaaaactttttaagcctgatacaaaaaatccaaataaacaaatattgaggctaggtggatcgtgcactttacaaaggtgtctccacagttgattcgccataggaagccttaacacacttagaaaaaaaaaaaaaagtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgtcacaatttcagagcctgttattggtctattcagagattcaacttcttcctggtttagtcttgggagagtgtatgtgtccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatggtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaagcaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactattgcaagaacaaaaaaccaaacaccacatattctcactcataggtgggaattgaacaatgagatcacatggacacaggaaggggaatatcacactctggggactgtggtggggtcgggggagggggggagggatagcatcgggagatatacctaatgctagatgacacgttagtgggtgcagcgcaccagcatggcacatgtatacatatgtaactaacctgcacaatgtgcacatgtaccctaaaacttagagtataataaaaaaaaaaaaatttaaataaaaaaaaagtcataatatcagctctatagttcttttcaaaatattttagtaaaatctggcggtgggggcacccacggtgcgtaattgtttttctacattagtgaccccaggtcaaggtttaaaagggcttccgcgaagagccttctaaagacagaagcaggcgatgtccttcagcctccccatccctccctccttaccgtcctccggacctcatttttaggccgaactggttttgctgcgtctctctctcctctttggtaaatcgcggagatgcacggcgcacttcgggagtctgggcagggatggggccccctgggctcggccggagagtaattcatggtctgattggaggcatcaggtgtacccttggcacagaagggcgaacatggctcaaggatcagttcccagtggccgaggggcacctgttagaacaccaccgtctcctacaaatgtgtccccaagaatgccagcaaggggaaccagcaggggcccaagtataacatcaatctgggcgagtcaccactgccccttgcagcaaccgatgcactggtccagccctcacgcaggcccgctccgtgagtaaatggctctcttctcttgcaggaatgcagtggaggaaggcaagggtattttttacaacatcaaaaactttgtccgattccagctgagcacgtaagtagaggccagcattccgagtgtcattaagcaccacgcctggcgggcggccgctgactggctgcgtgtgccccgcaggagcatctccgccctgagtctcatcactctgtccaccgtgttcaacctgcccagccccctcaacgccatgcagatcctatggatcaacatcatcatggatgggccaccggcgcagaggtgaggcagggccggctgggagccctgtgtctctttacccacctgcggggcttcctccaggggctgctggctgtgccccaaggctatagggatgaacaaatacagccactttccatcaggagttcccagaaaactgaagtgtgttgcactgcagtgagactgggagtagaaggcagaggagaaagtacctgggccggcagagctgggtgaggatggaactttctgctccctctgcctggatgctctctctgggcaacctgcatggctcattctcatgcttcattccagtcaccagtcactgccttcaggaagtcttccctgattgcactcccactcaatcccctcaccctgctgtatttttccctagagaggaagatacacacagacacacttttccttatggatctgattgtgatctgtctcccctttagaacatcagtttcatggaggcggagtttgtgtttcatccctgatgtctagagataaagggcttgccactcagtaggtgctcaggagtccacccgctccgccacttaatatccccttcaacaagctggccaagtggtgtgggggaaggaatgcgctttggagtcaggggacccatctggccacgtgtgcgtaaccgtatgagcacagagccagtgcttccgctggagctcagtgctgctgttatcaccagtgatagctgccaagggaaagagagtcctcatttgtgtccccaaagccaagtgtgagggttacctctcctgccagccctccctgggagcagaagtgggaccaggaagctggcctcagctgtgtctgagcggcagggcctcacccggccactcccaccataccgcctgctgcgggtctagcctcaaccctgctgtgtggagttggctggaggctggtctctctcagctgatgaggggctctgcggagggcggagcctggagcctgtttctccaggcgcaacgttggggggggtcccctcggggtgatggagatcatctgggtgtatggaactgtgtgtggttggccttacggggtggtcttccttcactgtctgcgggacagatggaggggcacagctgcccatggacccaggctctggggcttctggaaggtgccgaggagggcaggtgcgatgcctgggggcgttcagcaaatgcctggccctgccccctgtgccaacttggcctgggaggctcaggcacagctgtttcaagggtcctttatttcattcctggttcatttcaaagtgtctgtgtcttgttcggagcagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggaggtgagcgagggtcaccccggcctgttctccaagccctggtgcggtgcagacgctggggactgcagtccctgccctcctgccacagctcacatctgggagaggcaaacatgtacacacaccggacaatgtgatgccatcagaggcgtggggtgcatgaggcaaagggactgggtgacccttgaaagaagggaggtcgccaggtgtgtgcctgggaactacagaggccagcggggtggagatgactttgccgagacgggagttgaaatgtacatgaggacaggctgccccctgttcccttgtcaccaggaaacaatttgaaatctgctaaatatcctcctgtgttacactctagaggtgattgtttgctttggatctaggcctgggtcaccttttcatggcctgcaggttcagggagctctatgccaggacgggccacgatctaggtgggaaatgaggcaggtgacccatgtgaccacaccacagattgcccatgtgcaggaagcgggaggggaccctggccgggtaccctgcctccattttccctccagctctccctctactactgacggccatccttcagccttccttgtaggaaatgaccttcactctgggtttaactggagtggcatcacctcccagggagacagttacttcctggaggaagtggtgtttcctccacccataggtgccctgcccccatcctcatggtggcagcaaatcagcatgtgctggggagaccctggggtagcagccactgacctcacacctggaggaagctgtgtgaccgattcatgagcttgtaagtggctcccagccatgccccaggagcagtgaggcaggcctgtgccctttggttcaggatggaggttgtctcttcccgcctaacctctcacctttgtgctcaccttccagatgcctgaagacagagcaagcactccccgcaccacgacgatgacgttcacttgttttgtgtttttcgatctcttcaacgccttgacctgccgctctcaggtgagacccgggctgaccctcctcgctgcagagctgctgtgtgttctcgacagcagcgccccgaccctgcccgcagcattgagcggctctggctcagcgtgggcagtcagagctcccctgcctgtacctggggtgtggacagcacacaatcccccgtgtgaccttctccctgcagaccaagctgatatttgagatcggctttctcaggaaccacatgttcctctactccgtcctggggtccatcctggggcagctggcggtcatttacatccccccgctgcagagggtcttccagacggagaacctgggagcgcttggtgagtggtggggacgggaacgacaggtgacctcgaccagggccatggggggcggcagctgccaggtggggagctgcagcccaggaggggtcagtgcgggaaagcagagctcaccaggggccggctctgtcttcagggcccttctgtcctcacaggaagggactctaacgtgggtgatgtgacggatgcacagaaacccctaggaagaggcctgtcactcaagagtagtagggtctggggcccaaggggcaccggcatcccaggcgtcgggctggaggctcagagcacgtgcagggaggaaggagggagcaaggcctgtactcagcctgggaggtaccccagctggggagcctggacttgaccctggggccagtaatgtgacttagagatctggtcacctgaaggcagggagctgggctgtcttccagttttggctgaaagggacatgattcagtcaccgtggttttccaagggcacacgccctggtgtggagcccaggggactccccgacattgtcagccaagcgagtgtggcacctttctctgaagctgcggttatggcaggcatggggcaaggggagggagccagggacaagtcatcgaccccacccttttccccagtgtgctgagagccaaccccaacccggaatagaggacgagggaggccagtgaggcagcccccatgggcccaccgcctccccgccggcagggcccagagtgggtcatggctcagatctggagggtcatgggattatgcatcagacctgaggctgcagtgacaacggtcctatgacctccaggcaagactgggatggtcaactctgccttgtcctccaaaaagcagtgtcagtgtgggtcaccagtgaatgccctgtaggaacagacaagaggaccccccaaaacactctgctcactggctgtttccacccgccgggaaggaagtcggcttcccacgcctgaaggggttgtgcttgggcagcccgtacatcaggaatcatcaacagggagccagggatggttcctcaaaacagcatgtgacaggagcagagggagacgctgggaattcatcccagggaacatgtcgctgggaattcatcccagggaacatgtcggggtgcactggacagggagcccagactggtcactcaggacatttgcaagcagcagggcactgggacagctgctgtagggaaaggaaactcattccccttccagcccgagtccataacatgctcccagctgcctgccagacccaccctgtgctctggagctgcctggtgtttgcctggaaccacaggcaggcccttctggaactgcagcattttggattctgggttaggaagatctccctgccttcaggggaatgaaaagggctggtcctccgcacctctcactttatcaggaggactggcagggaaggcgcttcctgccggcgcaacagagctgcagcccgtcctgaatcttttctgttttctcccttggcagatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttattaaccatgtctaactacgtatctgtgccacagcttgcagtgaggcaggccactcgtggcagatacaaggggctcctgagaggcagtgggtaggatggtcacactctgcccattgccctcctggaggccccatttcctcatcataaaatgagggacttttaaataaagtgctatgccgggggataatta
